United States Patent 9,487,797 (GENOMIC PLANT SEQUENCES AND USES THEREOF) - sequence listing, part 61

SEQ ID NO: 70773 - DNA, 18004 bp, Oryza sativa
tagttcatcaatggtcaaagacacgttgatctaatggctgagatgattctgatgacgtggctagctgagagatcttctttatagcaatcattgcacttagtgggttccaattatataggaagaatggatttgtaatcaagttgttgtaatcaagttgtaattttatagttagcagttatttgtcctctaaattttatgataattggtttaatcttatttagagtaaaggtgggaacggattctattattaccttaaaaatattgttacttactataaaaaatgcatgtgcgttagaacggaaaaaaactaatgttatggtaatgatctatctatctattaacctattaacttaataaagtaatagaaaaaattagcctccacgttagctctccaagaactagaaattctcatattaattagagtataataaaaaaataaggagaactcatttaagacaaggactctttttttcctttttttaaaaaaatcatgttatatatgtgtagtgtccgatcgaatacctgcatagaacaaatcttttgcaaggaaaaaattacctgagctggatagactaatctctctatgtaagtaatacaacataatacaaagtattcctattttttattttttttgttgaatacaatttaagaaaagaaattaaattcggaatttaaaaataagaaatattgatagatgagattagagttcatatagaaatacaattaggaataataaaatttcagaattaaaaaaataggaatactggaagaagaatctagagtccatacagaattaaaaaataattaatattattaatttttagtttaaatttaaattatatatcatgacaaataaataattacatttttttactccatttagctataaatagtttaatttggagaagaaaaaactatttcaaattttagcaatttttaatgcagaaacagtttaaatcgattgagaataaataaaacgtaattaggcccatatttagaaggacggctcaaatatctctttttcacatcatggcatgttaagtgaacagggcccaagtggccatggcccaagtcggcgtaggagcgctgagagccaccggattcgatcgaacggttaggatcactcgtgatttagataaagcattgcactgttgaatcctaaaccctaattcattctccttcctctcagtggcacattcctccaccgtgagcggccgtggcggcgcccttccctaccacgtgttgccgcagtgccctcctccctgtgagtagcggcattgccttcccccaccgcgaccgcgtggggcagcgcccttccctaccgcgagcggcggtggtggcggtgccctcccgcggcttcccacgagtggatccggcggcgacggcggcttcccgcgggagaatcaggcgatgacgaagatttaagataaaatttgtgcgtttttttattattcttcatattccttttctcttttgatgaattgtccgattggattttgtatttatttttgaatttgtgctttatccacccttacacgatgtgttactcgcgtgtgtggaacggaggtcatcgttggatcggacttacggaccaaaaaatgagtgatgaacgaaaagttgtgttaacgtcaacttttggtaaaattatttagtggattcggttaaggaaagagcacaatcaactgatggaaagcttatccagaagagtatgagttcaagaaagaatcatgaagactatgccgtggcagtttaattctatctattaattacgtaggatttagtaaatttcctttatctttagaaagttttatctagtatccgattagtacttgtatattttcttttgtatttaggaaacatgcgtcgtgtccaatatggactagtatctacccatgagtataaatatgtatatacagggtcattgtgatctatcctcgatcaatataactactcccggcgtatcgccaccctcttttccaatgtatttatttattatcactgacggaacttagcacctgacgcgggctgcattgacttcgatctccggcgaaggggtaagccctatgttccgttggccctggtgaatatatcggctacattggtgttgttcaaggctacatcgcttcgatctcttagatcgttctagttcggtcgatatatttgcctacctgatgtttcgattctattttaatagcattgtgtttagagacacatcggtttagttgggactgtctcgattaggtctgattttatgtcttagcctatatatctctacaatcacaatgttgttttaaatagatttgttagatccatcatattagacaaatttatcggctcattgagtattagattattatatgcaatctcgtgttgcatcgattaggttctacctactaaattgttgttaataatcaaagtcttgtcaagctgatatgttcatgctaatgtttcattggagggttagccgcttatataatatgttaaatttattgttgatggttttattgtcttagttaaatttaagacatgaccactctgaaaaacaatgaaaggcttggttgtttagatcttatactttcttttatacttagtactgcattagtcgtacttggaattgtaagaactaacttgctctttggttgacgataaaggtagcatcagggttttcagccgatgagttgtctcaatattgcactggcttataaggattatatacaagttgattttagccgattggatcattacttcattatatcatcatcgactcttggattatttgttcaagttctttcattgcttatctaagcatcggaatatacattgaacatatagccgattatttaaagccttatcgacatcggctaagtaccattacatcggcttgtcaaccaatcggttatttgatcataactatatatatattgttgttacataatcaaattgactagcacatctgcatgtaatcaaagtttaggatatgcactagagttaagcatttctttcattcattcgttttttttcacatcaataagttgtaaatttgttaagtagttaagattttcattgctcgagagtgaacggtctttacttgggcctcgccggtgcgatgccacagagacggaaacttagccgcgtcatgacgacccgacacgaaccaccgaatccaacggatcgacacccgttccacgcgtctactcagccaggaaaactccccgatccccatcccaagcggaaccaaaccgttcatggcgatgcttataaatgagcgcctccacagctcctctgccacttcacaaagcaactcatcaacagccaacaattcgagcagagcagatattagggaaggagaagaggtgagacttgaaacccatatcgtctagcccacttcattgtggagctagcccgaaaacctctagttgtttctcccctgtccgccgatccaccatggcgttcatctggccggggccgccgggagcgcagccggtgggcgacctacgggtggcgcagctggcgctgctcgtcgccggcaacgggctgatcgtctcgccgtcctacctcagcagctgcccctgcgacgacggcggccggtgcttcttccaggacggcgtggcggagcagaggtgcttcgacctggccaacctcgtcaccgccgtgctcgggctggccctcctcgtcggagacatggcattctcgacggcagtgcccggccggtcgacgcagtcgcaggccctggccaccgttgctaggtggctcgtcgggctcgccaaggtcgccacggttgggaccttccagcattggatcaatgccttttacctttgcctcaaaacgtggtccatcacgtcttatattatccacccgtctttgcatgataaccctgtcctcgtctttgcataactctttgtcgtgctgttgtgatgtgattaggctcaaattgtttcattttgaacattaatttatgttcaaactatgaggaaattgattatatttgtatacgaatggattaatgttctttacaacgttggtatatttattttaaccatgtttggtatgttcacttcctgggttgttctttacaactgaagcaaatttatgattggagctacatttggagtcacttttttttccttgtttcatagtagtataaaagttactccaatgtagtttattttctttgcaaattgtttgtccgaaacgtcatctaattatacatgtcatgcgaaaactacaagttacttaaataaaatctatttttcaggtttaaataattataactcaattaatcatacgttattttcttattttatctgcacgcagttacatcttcagcagattcaaaagggacatctagtagcataaacactcacatactcagagaaaaccattgacctgagtaatgacccggttagtcactaaccgcgtccccgtaggaccgtaacgaaccaaatggagcagcgtcccacgcggataaaccacgtcgtccccgtcgatctccacgcgcggctgccagagtcgatcgtcacctcggctagctcggtctcgccggtgacctcaccgtagacgacgacttgacctgacgaaactggaaccaacccaacccaaccaacatatacgagctcaccccgcgctgtgtgtgccgccaattcacaaatcacaagcaagaacacaccaagaacccgaactgtcctacctcgatcgatcaccagcagccagccatggcggccgtcatcgacttcctccagttggagccgccgcgcgagccgcggccgcagccggccgtgcaggcggccctccccgtggcgaagtcggcgctgttcgtcgccatcaacggcctcgtcgcgccgtcctacctgtggtggtgcctggcctgcgacgacggcggcggcggcggcggcggcctccgccggcgctgcttccgcggcgaggccggcggcgacgtggagcagatgtggtaccagatggccagcttcgccaccgccgtcctcggcgtggcgctcctggcttttcacgtggcctcctcctcggcgccggcggcgatggcggcgtggctggtctggctcaccaaggtcttcacctgtgggactctccagtttggcctcaatattgtccacttttgtatcaaaataatttacttcaagttgatacgggggttggattctaatctttcgaggggataattataacacattttttttactgcttggatgcaatgccgatagctgtaaatggatttgaatcgatttgagtacataataatgtacgaaggtagattcaattttgtcagagctgcggcgtgctaatgtagactccatcgtggctaattgacggaataaacgaaacggtatatttgcaaacggaaaataatttgtaaataaaacttttatatacgtgttcttagcgattcaaaacaaaggctgtaaaataaactacgatgaaaaaaaatcccaaaatcaactctaaatttaaggttgaaaatttaaattttggtttataagcataagccaaaagatagagccgatggttcttgagatattttgtctgctctttgtgagaatttcttctattagaatcgtgatcagcttctcgatcaatggcgttgaccgatcgacatacaacggctttaggtcatcagaaaaagaaaaagaaaaagaaaaagaagaagaagaagaacacgtcagtagagggtccttgacggaaaatgatcttatcaagtcaaccatcgattctgggccgccgaatagtgatcggacgggtacgaagatgttatccaagactcccaattatgggagggttgaaacgatgaatcatcctcatgaaggggtctctaacgtaaaatcattgcctggctggcataacatacttttcctagtcgatcaggattgcagaagcattatcggacggtgctggagaacccatgttttgatcgaacctgtgagttaggcccattaagaattaggcccatgcaaatcaccctcggttgaagcccaaagcagtggctgtggcggccgcaggtacaaagatctaattaagttaagagattatgctgtccaaggcaaggcacacctttttattcctttttattaccatgccagtaagaccaaacaaggttttcaaggcaaaatagcaggcaaccattggccaattctatcttcgctcttgattaaccacgatgaaaaatccacaatcaggattctcatcacattattggcacattacggccaataacagaacactatcaataaaatgaataaatcccacacaaaaaaccaatgtggtgttgtgtgtcttgtatcacaacacctctaagatctagcttagttatgtacagatccttttgtttcccctaattaatattactcctatatcttcccctcttaggtctgaccatgaaattctaggcacccctctccttgagatagctcggtgtccttctgtgccgcctgagcgaggtggtgtacgatccgatggagccgtcgcgttgcagcacgatgtcagcatggattgcagagtttgggttcttctgccggtatcgatcatggtgactctggtgcttctcttccactgtcgcctcgatcctcatgtcaaccttgttctcaccatctacttgcttggttttggtcacatcgtccttcttgttatcttccacaacgacggtgaacacaaatgtaccaatttggaggtagtcattcatgtccaatatgggctctagggccttgaccacctccctcatgctgggcctggactttggtgatgggctcaagcacttgtaggctaccaaagcagcctcttgggcccctttgtaggagtattggccctccatggctgggtccatgacgacccggtgcaactggtcgggcttcttgaggtactttcttgtccaatccaccagactttgctccctatggcgacgagagcggtccaccgagtgccgacccgataatagctccagtagtaccacaccaaaactatacacatcgctcttgtcggtcaggtgccctgtcatgatgtactcgggcgctgcatacccgtttgtccccatgacacgcgtcgtgacatgggtcgcgtcgccctgcggcccatccttggcaagcccaaagtcggaaagcttggtgttgaagtcctgaaatcaaatgaatcagagatcgggttaggcagggatcacagttgacaattacaatgacatgcaggagacagacgacaatgtttctgtcagtatcatgctagtaatcacgccagtcggccagtgccattaactggcataatgattctgtacggatatgatgctagggatggatttttattaggtgctgtgtagccatctattcctagagaagacagcatgagctgggatctctgaaccctgaaggttgggccatccaagaaccttccaagttgcaatcatgtctaacgaacccacacacccagccaacgattttggaacgtgtggcacgcagactttgacagtcaaatctagacttgataacttgacaagtggtatcccatcaaaattttcagaaataagaagcgaaaaatggtctgaaagttagtaaaatttttcacggcagtttgaattttcgctctcaggacatggtagttttttttttcctttaacgactgaaatttctactgcactcgagtgaaatgactgcgaaaagtacacagtggaatcaagaacgggatggtgctcaccgagtcgaggaggatgttggatgccttgaagtcacggtagatgaccggcgtgtcggcgtcgtggaggaaggcgagccccttcgccgcgccgacggcggtctgcatcctcctcatccatggcatggcgccatcgagacctgcacggacaggaggacggttcagcgtcagctaaagtcttccccggaattttttcagagctgaaacttcagcgatggcgtaagcgcgctctaagcgcaaatgattcggttaaccactcgcgtataaacaccagtaatctcccggattctattgacgattgcgacgggggtaaaaaaaaagaagaaaagattcaacagttggtaattattctcgtgtgcttacttttgaagagatgcttctccaagctcccgttgctcatgtactcgtacaccagcatccggtgttcgtcctcgtagcagtagccgatcagcttgacgagattcttgtgcctcaactgaccaaggaagaacacctcagcctgcaagaaagaaaggttcgtagattaattagcacggtgagctaaagctcgagctagcccaacaatggcggaaggaacgcatgaggtggagagtgacgtaccagccactccctgtggccctgcgtgccgcagtcgaggtcgaggtacttgacggcgacggcctgcgcggcgaggccggggcggaggccgtcgtcggcgcggcccttgtacacggggccgaacccgccggagccgaggtagttggcgcgggagaagccgccggtgacggccctcatctcggcgtaggtgaaggcgtacaggttcgagcccgacagcgtcagcgacaggtcctccggcgtgagggtccccgtcgagctcaggctcgacagcgacaccctcgacgccgacgacgccgacgacgacgacgacagcagccgctggtggtgaccaccccctctgaccctcctcctctccggcggcacgtcgtcctcaacgccggccaccccgccgccgccgacgcagcagagcatcgacttccacgacgtccgcaactcagccatcgaatcgatcaaatccaagatgaacaagaagccaagaaaaaccaatcgcccacgaacacgaagcagcagagagccagagaccgaaatgcagagacggagacagcgagtaccagagcttgtaaagaagaagaagaagagaggacagagttgaggaagcgtctgcaccggcaatggcgagatatgtaggcgctgtggctgtggcttgtgccttgaccgtgtcgcgcggcacgaaaccacgcacggacggcgacgccgagggctgcggaaaactgcgtcaaatccggccacgaaacgactcaaaaaaagcggagtgggtgagtcccccgcagcatcttggtaagttggcagagagtactattactgtttccgctgctgcattgatggttgaatttttttttctttgaactttttaatttttagttttaaaaataaacatttttcaaaacgtattttcaagatattaaccttttgggctacgctagccgaactggtgtaaaaaaacaacattgtcactccgcgttatttggtcacgccgatttgacgggcgtggccacgccatccttgctggcatgacagaataaaactatcatgtccactgcgtgtagcgtgtcagtattgttttgccatatcacgtcgattggttcggattatagaaagaagttttgaaaaggtctatttttaaaattgaaaaaaataaaagttcaaaagattaaaaaaaatcctcgctggttccatgtagaaacgatgaaaaatcattctctcttttttttctttttgaattttgaaaattcattctttcagacctgtagaacggtgaaaaatcattcttttattagaccgatctcgtacagtctcggctgcttttcaccgcatgtactggcactgtgggtttggtcatttcttccttgccacggaaggtagcaatttttctgttctatttttggggttggaatggaattctctgcgtgcgtcactgtttcttactctctgcttaaacgtgacgctgacatacttgtaaaacaagtgagttcttgggagggttgcttatagcggaattaatccagcgtgctccatgctgatactaaactgattataacagattaagcaattccaagtgcttggatcatgtgaaaaatttcgtgcaaagtatttcattctttatatgttgcttctagttgggtgtttctgcttttctttttttccttttaggctaactgggagtggtcagactggggatgctaaaaccagagttgttttgggaggcaaagcagcggatgcaaaggaggtgaagccatgagctgcatctggttgctacctgaagcaggtagatctgcagcaaaaggaatctgattccagccgcagttcctcccacaatgttctggctcaccattctcgttttaatttaatctccatgatccttccacgcacgagtgaaatgcaattatgcaattgcagtcgatcgagatgagatgatactgtgataggcagttctgaactgaaactgaaccgcacgctccgaacaaccgtacaggatgcagacaaaatctctgctggaatttacaggagatgggaaccatcctgtcctgcgctgcagatcaaggcgcataaattatgatagttttgtaatttaaaccctgcttaggaaaatacgcaagctggaaggaagcatcaatctgagctgtttgctaacccggtgttcagcctagctgtcgtgtttaaattcagttgagcttcttttctgtttcctgatcgatttgtttatccgcgacacagcctcgcacgttcgccgataaagaatgttcctctcaggcttggattagattattcccggaccgtgccgtcctgttcttggaccgtaagattagtttactctcctggttcctaaactctgacagaatgagatcagcagctccgataaaaaaggaagcagcagagcatgttgttcttacggggcaagaaagaggattaggagaaaatgagcgaagaaacactccgcgtatatagctaatgctccttttctgtttgtctcgttaggactgcatggaaatttctcagcatttcagctctgttttctttttatcacagttatctctctcgttttcattttttcagaaaagatgataatagtgaatattattccctcatttcttgacggcagcattaacgcattggatgcggtaagcggattgacctgccaccgtcctaatacttttcttctactactactatttctctgcaaaaatggatggattatactgtgactctgtgagccgtagcagctggcacaacgactttgaaccgaccttggatagtggatgcattgtaactgtacaatacaatttgtacaggaggagtgtatgcttgtaactgtacaatttgagctgcatgtctgaaaagatcgccgggcacgagagccatggccgccgcgtcgtcgatgggttcgagagatgggggggaaaagcagagcacgcctacgacgtggggtgcatggctcgatgcgtgggcgtcggcggcagcaaaagggaaaaaaggagagatccgtctctgctttcgcgaagaggaggaggtcacggccgtccgatgaggaacggatggctcagatatcaagcgcaaacggtgacgatgctgacaagaggggagagattccgtgcatctctccatttcgaattcggggcatgggggcggctcgctccatctcctacccacacctgagatctggcgagcgagtgacgacgtgccgaccaccggccaccacaataatattgctctgtttttcttttttttttgttatcttattattagccgcaacaatttgaaatctaatatttgagttgattttgaatttttttatcgaagtttaatttttatattggcttttaatcgttaaaaatataagtacaagagttgtttacacataaattgttttttactttatttgtttatgtggtgtttggattcaggggactaattttagtccctatcacgtcgaaagttggaacactaattataagtattaaacataggctaatgataaaatccattccataaccctatactaatttgcgagacgaatttattgagcctaattaatccatgattaacctatgtgatgctacagtaaatatgtgctacttatggattacttttgctttaaaaaaatcgtctcgcgaattagctctcatttatgcaattagctttattattattaatctatgtttaatattcctaattagcgtccaaatattgtaacgctccgcttttcgtgagtcgttaaaaactaactcggcaaaatcctaattgcgaaaattttcgttctttgtgtgagagtctaagttgtgccaaggatcccaatttaatctcgttgttccctctcatcgaaatcaaaatcctccccctcatccaaattccttttccgattcgagtctctgaaatcaaattctgaaattcaaatccttcctttgaatcctcgccaaatacttctacgaatccagaattattcaaatcctgcctcgaatcctttccttgactccaccctatgttcccgagaacaaatacccaagtattccttttgaatcttttccatgacttctccttgagtttcccttgatacatccctaaaccctcgagttcgaatatcaaatttgaattcgaatccaaaccctaaatcactccaattctatccaaatcagttttctctgtaaaagtctactttacctccctgtatttttggatggaccgattttcctccatcggcccatctcccctcccagcccatcatctttccccctcgcacgtgcgttgcacgcatgcgagccgagagagagccgtcgctcgctctctctgtttctctcgctctctcgtcttcctcctctctctctatgtttctctctctctcgttcgatctccctctcctcggtgccgatttcccgccgtcgccgcccaaaacctccaccgccttcgtccattcccgcgcgcacctcgcgaggtggccgactggccggtcgccgccgacgccatgcgctgccgccttgcccccgctccatgccaaaccgaccgccgccgtcatcgtcgacgtcatccatggcccccgccactccacgccgcacccgtccaagagtgggagaagcagctgctctccctctcctcctcctcctcactctcccgctcctcattatggcaagggaccaagcccctttttcccttctttttccctttcccgaccactgccggcgtcaccacctctgcgccgcttgaccgctcgcgccacccgcctcatctctttgaccgcgccagcccgcgctccagcagttcgatttccgccgctcgatccaccgccttcgccactcaacgcatccacgccgtcgccgctttcgcaccgcccacgaaaccgccgctaccgccagccgagcacttgaccgccaaggtcagttctcccctccccaaaccgacctcgcctccgctataaaaccaagccacccaaaccccttcctctctcgttttcactcgcctcagtcctcacacccaccgcgccattgccgccgaaccaccgtcgccgccttgttgctgctcgtcccgctctcgccgttgccgtccgttgccgagcaccggaggagccggtgcgtgcgtggacgcgtgacgaggagctccgggcaccacctctccctcccttcttccccggccgcgccctctcggtgtcgtgccgcctcggcgtcgcgaccacctcgccgtgacaccgaccgcgccgccaacgctacttcctcttcgttggtgagctccccaccataatcctcctcctgccgcgcgatgcgccgcgcccgccgccgctcgccatagctcgccacgcgctcttgctctgtcccggaggccgcctctcgtcgccagccaatctcggtgccgcttcgtccaatccgacgccggaaacggattccttgaaccccggagatgctcccacccctttgaatcgaaccctcgtcgtctcgtcgtgttttccccttttgctctctggtgattgccgcaccgcaatccaccgtcgtcggctcctctcgcgtcgattcctctcgccgccacgctcccggggatccccttgacctccccctggctgccccaaggccgtcggccttctcctttgtctccgcgccatgtcgccgcttccgccgccgcctaacgccgccgtgcgtgcgccgccggtgaccatcgggtcacgcgtcaccgcgtgcgcgtcgcaacaccataccggttcggctaagcccgagcccgcgcacccttcgctcttctcgcgcgcggccacgtcggcgtgccggcgagattggccgccgccgccggccgtcgtcgcgcgtcctcttcctgatccgagctgtggaatgagttccccttctcctcctcctgccgccagtgctagccgccccttccggctcgccgctgttcgccggatcccgccgcgcgccgcgggccgtccgatgagccgcccggcctcctctcccttccccatccgacgtgacgtccacgtggcagccacctcagccccgggcccgcttgactgggtcaagtcgcgcccagtcagcctcctccatccgtcttccctcccgtgcgcgcagtccacggcaagccgtgcggctgcacatgggcccgccgccatccgtctacccggcgcgccgcgcctgaaccgcgcgcacccgaaaccctagcgcccgcccccgcgtgcgccctccccaccgtgaacccaaccaccgccatgtgggtcccgcgcggtggaccgcgcccaccccgtcgggcctccctctctccccgcgcgccctaatgggccgcctccccgtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgattgactccgttcagcttccagtaattccgtaaaattgagatctatttaatggcactactaataggtctaaataggatctttcttttggtcttttgtttaggttttcgattatttgcatatagttgcggttatcggattttcgtcgatcgcgggttttctcgaagattcatgaagcttcgtgaagaccttgaacaaggcaagtcaccctttgatcaattgcccctataattaaaaagtcattattattttgtttgcaacttgcattactagaatcacacacttaacttgtttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcgattcagggaaacctcgcatgccaatagttgggaacgccggggcggggtcggacaaaccgggttcctggtaaggcaaggacgagaagcttgctcacataccgatcaaggtggttggagttgatttgtgaatgcctaaaatggcctatacttacgtgaggatttgatccttctatgtggcatgaggtaaccctgggtcggcttgggaaatgctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagagttgtttgcctgtgctttgtgaaaagttgttgtggtgtgggaatcgtaaccagaatcagcctatgtggcagatggatgacctgagtggtcaagaaacgaatctgtgtgattcgggatgtctgcgggcatcatagactaggcttcccgagtggaagcggattgttgtgctgctaggcagctggactctgggagtccgagaaaatgaaaaaggctctgggagccgattaatcaagtggaatggctctgggagccgagaagtaatgatctgacccgggaggtcggtacattactaaatgagctgttgaaaaatatctcttaaagtcgaatcgagacgcaagtctcttttcggcccaaacttagaaagaaataaatcacttagtgatttcaaaatgtcttcaaataaaagatttgcaaaacaaccttgcccctcttcgaatcttgcaataaacacctaaattcccgtgacttgctgagtacgaaagtactcacccttgctctatataaatatatatatatatagttcctccgccctgaagttgaagatgaggtgaagtgaagattagggtttcgtcctggttcccagccgtcgcctgtggtgttgggtattagaccgttggttccgctgctgctgttgttgttggtgttcgcctcgtccgtgtcgtcggttgtattctcgggctgtctgagctgcaacctaagttaaggtaaataagtcctctatttattttaaagattgctacgattcatatttgtcaccgtgggtaccagcactatgtcctgggactggtaccgagatcgcggtttcgtaggaagcggttcgcgccgtttaccctacgacacgctcctgtcaggtgccgttgtacggcggtatcagattggggtgtgacaaatatccaaattgatagggctaaaattattccctcccatctaaacaccaccttatttttcatgtcttatccattgtggagcgcaaacaatacgagtgcatgactacttcgatctggtgtgttcttgtcaaatgttcagatatgctgacttcttgcgttgcttatgcgtcatgaatatacagatttttgcactatctgaagctcccaacatagtagtacatggctacctctgaaggtgtcaaactgtcaaggtgatcgaaaaggaatgctaggctgctaatttagcttcgacgcatgttcagttcgacagacatgctcaacgtgtgtacacatcgaacacactgttgtcaacgtgcatgaatccgaaaatcgcatgaatataatgcatccatcgttaagttggcagggcggcagggccctacgctcgtatgcatggctgcccttcctcagccgagacgaaggtgcatcacacacgcacgagaaccacgcgtctggtctgaccatggccgacctgacgaccatgcatgcgtgtgtacacgtactagcactctctgtattctctactctatctgaatctctgatatcatccaggtgatgggaatggttatatggattggattaacctggacgtcattttaatttggatctgtctgaccttttcccggccgtctcgtaatctcgttacagtgtcaacgtgcagacggctagcggcttgtttttgtccgagccgtttggaccatctgcagagcggcgttatgccttctgagtttgaccagcgtgtgtgtgtgagtgtgtccgtccacaccgattgtttcgagtcaaaattggctacagattcacatgctcttttcaactcctcggtatgtatatgtgtttttttgatacttgaattcgatttggtttttcgtattatcttgttattattactgttgattatgttaccccagttactgtggaggtataattgagtcgattgagaaatcatcaccgtaaagtcgtgaagacaaagttgtggaggcgcaggtaccttaccagctggtttcttcgatatgtatatgtgtttttggatacttgaattcgatttggtttttcgtattatcttgttattactgttggtttctgttactgtggaggtataattgagtcggttgagaaatcatcacgtgaactcgtcaggacaaagtgtggaggcgcaggtaccttacgagctgggttccttcagaaatctggtgttcggcagatgtgtccatatcttatccatcaacggatatggtagtcgtagtatgtgatgcatgcagaatggcaaacgtcaacgcctagttaggaatcccgtacacctaattactagatatcttgatatatgatt

SEQ ID NO: 70774 - DNA, 640 bp, Oryza sativa
caattaggcagcagctcatggatatatacacatctaccacttaaccaaagtaagcaggcaaaaacacaagattggtggaggaactctgattgaaatattgaattaaccaaagtaacgccatagaagcttcagtattgatggtccaggtgagatgcattggcatatggttcaacaagatcccagtttttactgtcgtgtgggtcgctaatagggagaggtcaatcgctgagcccgacgttaacacagctcaaaaaatcacaagaggaggcctaggaggttgcactcctcgtcggcgacgaagagcagcgacgacaccgactcgatggcgccggagcgcgtcccgcttcttgctggcaagcttggacacgacgagcgcggcagacgccatggcggcggcctcggcggcgccgttccaagtgagcatctccaccagccggtccaccaccgccgcttacgtgccgacccgtcggagcgcggcctcgccgagccgcgggtttgtcgcgaccgttccaggcaggggcggatctacccattaggcggggtgggtcgaccgactcagctacgactcgtgttgccccacactttcaagaccaccttattcttttatagtagtcatggactatcaaaattaggtataaca

SEQ ID NO: 70775 - DNA, 15086 bp, Oryza sativa
agatcccgcggcgctgcggcggctgggcgcgcgccaccgccgcggccacctccctcagcgcctcgtcgtcgggctccatggcgatcggtggttggggttgggggcgtgggggggaatgggaatggggagagataagatggaaatggtcaaggagaagggcgcggcgagggaggggggtcggacgaatggacgaccatcggagcgcgccacccgtggccggcggagtcggggccgcacgaggtgatgagagaaagaggagaaagaggagagagagcgggtgagccgggcttactgccaagtgccaacggtttcaaagatggagtatgaattaaccctcttctccgtttcaaatcacttttaaaactgggaaatgccaggctgaaaatggtgacaggaatttctgatcgatcgagtgtgttttcgaccgtcatttttagctatatataatttttgttttctttatttaatttcttcctgcgtcatattaatatcgatactgagaaatttaagtaatttaagtgatatatatagtcgactaccagctgatcaagcgtcgtttccgaatatattgctaccaatcccaaccattttcacccccaccccaccaggtatagtattttttaaaaatttaccaactacttcatcctatttttctatgaacgtccatatatgatcttatcttatttcatttgtacaatatttaacatctatacatatgaaattgtcccagaaaacctcactattaatttattttcatcagaagtaaagcatgcgtatatttagctagattgttttatcgttttaacatttaaataattatgtcaaaacacttattaaaatgcacgtgcttattttccgcgcttattagaagcattcaaacaattatccaaaaagctcactattaatcgagagattctttttctcactgccctcgtcaatacagtcataataatatactactctcacaggaaaatgcaatgcttttctttgggaatgatagtttgaatataaaattaacaagcaaaacacatgtgcattgcaatgagtgaaaaccaaatatattatcacttatggcacgtaaggctacatatagttatcaagtttcacaaaaccctatatatatttgaatattgattaattgcagcatatttaaagctattttttaagcagggaaaaaagtaaactatcaaccttagttaagaacttaataaataatttttcttcatatacattttatgttttaaaattttaagtaaaattgtgctcaaaatatagaagagtgggttttttttgaaatatttagaccataaaatctatggttatgtgccacacttgtaatacctatctttttctacaactttcatcgtataacacgaggttttttcgacagtgtcgacgtggtgggaagctatcacaaattcaaaagatgctccaaagaaagctttgcgcacgcttacactcctagtagcctgggaaatatggaatgaaaggaaccgtagaacatttcagcaaaaggagctctcgacaggaagccttttggctaaaaccaaggaggaggccaagtcgtggtcattggtaggcgcgagagatctcggtagctggctttctttttaattgctcggaccgaaggtcttgagccttggtttttcttttgcacttgtaaaatttattcctcctttattcaatgaaattggcagcttgccgattcgttcaaaaaaaaataacacgaggtttttttttgaaatttaaattgaaaaaaggagaagacgaaacccaaaggccattctcagcggtggtgactggcgagcgacaaacacagcgatggtcgctgctcccaccctttaatgctaaatcgattccatgggaaaagtaaacccatttggcctcgtttaatatcacacggcgtatctctcatttggtcaccagtagcggcggtggcggagccacgaaggggtgtctcttgcccggggaaggattgcaccaccgcagtccgccattgagtcgccgtgtgcgtttgtggggaaggagaggaagaataaagaggagaattctttgagtcccactgttgagttagccggttggatcgggtcaaaacgccacgtcagcaaaaacgtcctctgaaaccactgagaaagttattttgcaccggtttcaatagttgtggggttaaaatatccggtattgaggtttaagatacggattagattaaagctatactatgagggtgtcaaagtggacttatccattccgaggcgtgcacgatacggcttgggcctagaaggcccatgtaaggagggccttctttgagatggatccgaatctcgagaggctgcatgtggggccagacggccagttagtatggtgggcccacttgtcaggacggaagcctccctctccgactccctttctccccgtcccccaaattcgcatctctaccctcgccgccggcggccaagcgccaccgccgaccaccgccgtcccccgcgacctcgccgtcgtcgaccacgacgagcggtggccgccgccgccgccgccctcctcgagttcgaccccgttcatctcatccgtcgtcctccgcgagataaccctccatcgctgtctcgggcgatgtcgaagcagctggtgtcgcggctgctggggatgttccgctcgcgggcgcaggtgggcgccgacaagttcggcaaccgctacttcacccgcgtcgaggaggtcgacggcgtcagtacgtctcccacatctccttcaattcaaattcagtctcgtaggctacatcaatggcggcggctcatttcttggatggctttgaccagtgaaggagaaacggtgggtggagttcaaggggagcgaccaggatccgaccactgttccaggttacctcttcttctctttcggttgatcaacttcaatttctggcctgtgtagagaacctgatatgattactgacttggcactttgtttctgcaggcatgtatggtttgtgaacttttgattctgatttctgaagtatgaatcgacgtgcttggattttgctgatagttgtgtcacacttgtagttgagtggatttgctggttgaatggacaaaggaagaaagctccgacaccagaggtgagagtatggccatgctccacacatgattttctgcaaatgttttgagcaggctattgatgtacagcatgtttccattatactgtgtaggtgacattttgatttcatctgattgtgatgtatcactgcactattgtaggagttggctgagctggaagcaaggcgtgaacgtgtcaagcaaaatattgaatgtatgcataagatgattacagcttatatcctctcttattattttctctttagccctatattattaataagaaggtgttctttacttttcttgttaagcctacattaagcatcgcacaagttttcttttgctgatgttgcggtggtggagatggtggttactggttagcgtgttttacatatattgctgatttatgttgtgggataattgtaaatgtttgggctcaagaataattcataacattcgtgtaatgcgtattgtttgtttggtgactatacatcaattactgttacttaccgtgttttagtaaaaccaacttaaatgcatccagccatacatcttgggattgatggcaaaattctttattgtcttaattttcagtttatctttaaaaaagttactacagtatgtttactcatgtatattataggatgcctattggttctgttaagcttatgttcggaaatgactatgctacatgcaacttccattaaaaaaacaatgaaactacatgatggacttttgtcctacttcccagttcccactgatctcacttgtagaattattgctggttagtgggaaaatgttaattacatacatatgtgccatagtcattctgttctttttttcttgaatgttcatggattttgctccactaatatatttaatctgtttcaatccagtgctcaaaaagaaagaagaagaggaaaagaagaccggtgtccgaccagtcaagacggttggtatgttctttctggatctgcttaagagttgggaaaactgacaatttgcaactccttatagtggcacttgatcatttgtgggattggcaacaatcaaacccctgttcttacttcccctcattgtttatcagcatttttagctttcttaggactttatgcatttcaagttctttgtgttcatggcttaactgatgttacatatctatcatgtcccatcaacaccaatcaatgtgtttctgtttgcaattccttctttctaacttcaccaacagttaaaacttttgaaaaagaaaaacaatattgtcatcattcttttgtctctgctccttagcaactccagattcttaactgttacttctgtcacttgataatatgtatgtattttcatttatttttcctgggggttctcccttttctcttgatggtttgaataacgatattcctccaaatatagggaagtttgaatctccaaatctcaaaagttttattcagcagtttcctgatacttcgctagatcagagaaaaggtatataatcttatactcttgttccatttctgcttgtggttccatttctgcatgtgatacaacccctttaacatccatgataacatttcaatctcactgtttaggacatgatgaggtatctagatcaaaggatggaactgatacagaggatgccaccatagatactgacaggtgctttccaattctccgaaatatataaattgtgattcgatgttattattttgtatctatttcatctagcatacagtgccactggatagctactgtttgctcttgaactaaattctttttggagggcattgctacttccccatttagcattgctttgtgatcttcttatgcggacataataattgttcttgcaagtaaaatataacgaatccaccaaagtagcattactgtatgccatcatggatgatggatctgccaatgtcttacagatacctagttcaaattgtcccagtaccatttcattgttgcagaatatagaaggcatgctccttttgacaacagcaactgtagttaatctggagctaagagtgaaggaacaatttgactattattaaggttattctcgtgtttgtgttctttcaggtcttctgaaccgacaggaactggtgctaccttcaaaccagggacatggcagccaccaacttgaattacaacaaacatataattgtagcaggtgaaatggtgctgcagtcagcatcagcattttcctttgagagtgtactatcttccagttatttgatgaagaaatggagatttatttttactgtgattaccactgtacactccgggagttacatcaacaaatgcagtatccggatgacaacagatatatacttaccaatcttatcaaatacatgatcattcatgtgcctgactaattagttttgttattgagaattatggaacaccacgagtgagctggttctggaggaggcatgcaaatatttttgtgctacatctaaaaatctgatatgttgggctgaatttgttaactgtgcgtgcctttggtccgttagttgaatgggctaaactaactggtatgggccttttcggccattgttgcgtgtgctaaatttcttgataaagcagatgtatcctaatcctatatgtctctagtatgggctgtttgtagagtggctttacttggctcattagtatatttttctctttttttaaaaaaaagaaaaagaaaagatgacgccatatttgtgctcgactcgggttacattttttgccattgcaaatcttcctttgtctaagctctgagtatagtcggaaaggcacactatcctttcagaagcagctgtatcagaaaaggagtgaaccgggtctgcagaagatgtgcaattttctttgtaacatctaaaagttgatcgatccagttttccaacgcagaatccactacatttcatttcatggcaaaaacagaattacatagcttcaaatggcagaaacaaaatcttcaggaacacacttttgacaggtgggaaaaacaggcacaaatcaaacagaaaatagaatcttcaggaacacacatttgacaggcacaaatcaagcagaaacaaaatcttcaggaacacacatttgacaggcacaaatcaagcagaaacaaaatcttcaggaacgcacatttgacaggcacaaattaattagaaacaaaatcttcaggaacgcacaattaacaagcacaaattaattagaaacaaaatcttcagaacgcacatttgacaggcacaatcaaaatagtgctgtctagaagtgtactcagtaaattctagtaatattgttcatctcatagatcacagaggaaccccgaatcctatcaatgtacagaggaatcccgattcccgaatactaatatttccgatcgactatagcgtaaactagagacaacatgatcaaaactcgtgcaccctagtcatgtagacttcctgaaagtgactaatgagcacgaaaaccatctactcacatatgacgctaaaatcttcggccgggattcgaagcttccaaacctcaaggagcctgcgcttcgcctggcggacgaagtcgaggatggtcgtctccgccggtggaggcgagggcggagcagcgcggcgatccggcggcgaggtcgcaggcgcggggtcgggctcgggggcgtggtcgaagagctcggcgggaacagggcgatccatcagaatcgcctcggccaagccctcgaacaggaggccgacatgccgcacggcgccgccgccgagtcgctggtggcggatcgcggcgccggcgtcggaggagcctggaggcgtggcggcgaagcgtggcgtcggggaggtcgtggaggcgcggcctggcgctggcgccgttgcggatgacgaccgggcggttgcggaccaccacctgggcgggcgcgagcgggaggacggcgactcaccggcgcggggggcgagggcgcgcgcgtgctccacgccatggagagagctttgacccgcatcacgtagcccctccttcctccgtgcatctcaacgagcttctgggcgtccgtcccggtgagagctaaccgactgcgtcttcctcttctccgcgccgctcttcctcctccgtctcgccattgccgcaccttgcgcttgcgcttcaatcgatcgctcacgacgccgacacacgcgcgcgctctcaagtgcaaatctaagaaggacatttgaacaattgccaaacttaatagtgtcaaatactagttaaatttcgctttctcttgtatacaggaaaaagaaaagaagaacaaattgaaacatatctcccactctcgtcagtgtcagacggcgccgacgcgatctcctactcccaccctcgcgccaaaaggagatcccccactccgcccggcttaattcctgtcgggttgccgacttgcaaccccgatttgatcgaggtcgaggatcgtcgctgctgctaccatgggtttgctggcgctgacgcgtctcatggctacgcagccgcctcgtcgccgccgccgccgccgcaacgatgcccaagcccaagcccgaagtaagccccccctcgatcacctccgcaacctaaaccgattcatgtatctaggttgagaattgagattgatctaagtcggctaggtccttaagatcttcaatttagtgagattgatctgcaagcatcctggctccttttttttccctgattgatttgagcagggtagtgtagtgctcaagtattccttcctgttccaatgtggatttgtttgcaaaaaaaaaagtagtactagtttcatcgttcagggaaaaaacaatagtttgatctgtaaaaaaaaaaagagtaggtatatttgtggcgccatattttccaatagtcgacttgtatttacattgtaagtcctagattacatatgcaattttagtgcatttataatgtaggtcccaaaattacatatgtaaatcaaaaaattacatagtaattatatatgtaagtggtgtgtaactactatgtaaatttataaatttaaatcttacattggaaaagttaaaaagcaaaagcatatgcagtccttactttctaggagatgatcaggagaagaaatcgaacggtccgaacaggcacaaccgaagacgtgtagcgatcagacggatagcaaagccgactgagatcagccccaaaaaatgtcgacatctttttagcaagtctgaagaaaaagtggttcgggagaagattttaagagatacttgaacaacggatggttccagaggaggcatccagtatcaataaaaccacgagtgtaacagtgcttatgtgcagttccaggaaaaaatagaacattttttttctgtttgtgcttatgtgctttgactttgttgtttccttctgttagtatctttattaattaggagtaaccattaccatacataatattgttgcagatggagtgattacttccatggctaaacggaagggcacactcctccaagggggtggtagttctcagggtggtaaaagattgagatattcagggccagacctcccagaggtatgccataagagtttaggctttgtttaatcctctatgtgaaataatactccgtacacaataatgataatgccttcatcacgaaagaaagaaagaaaacgttaataaggagcctaccaaaatctactgagatccttcttcagttaaaggcagcaatatgtaaagattgcagccatctttgaggcattgtgaccgtaaatacaaagtgatacgagaacactccctaatatacaggcaaccttgtatagaatacttcctattccagtgcactaactttttctttgatgcatgtcctagtaggcaacatgccactacactgcgaaagagtcccaagtgcaccagctttttctttgatgcagaacatttcatgctgacattcacagatcatctgtggtagaatgttattctgcgtggttctgttttccttagttgaatatttgcctttatagtctcaatgttcaattgttctttccatgcttgtgcaggacatttggcgccatatacatttcctaatgccactgcgagatgctgcccgtgctgcttgtatttctcaagcttttctacgttcatggagacaccatcctaaccttatcttaagaaagaaaacaatgggcttggaacataaagcatataggagggttggtatggcaagggatttcactagcacagttcacagcattctgaaaaatcactcgggcattggtgtgaagagactgaagcttgacatcatctatgatcaccgcaatctcaacatatgttatctcaataattggcttcagattgctattacaccaggaattgaagaaatcactctcttgctgccttcaaaatacactttcccatgctcacttttatctggtggcattggaaggtcccttcagtatcttaagcttgtcagatgcgccttccgtcccacagctagccttggtttcttgagtagtctgacaaagctgcatttatgtgaagtgcgtattaaggatgacgagttaacttgtcttatttccaagtctttggctctgaagcagttggaactcctaaactgcagacaaataatctgtctgaagataccgtgtttgctggagcaactcagctgcctgaatgtatccttgtgcgagaatctgcaaatgatagagagcaaagctccaaacctctccacttttagctatataagtaacctagtagtagaactctcacttaaacaatcatcgcaagtgaagaccctagatatcgactgttatgacgagtccaactttctctgtcatgttattaccaagtttccaaatattgtcccaaatcttgaaactcttaccttacattcaattgatgaggtatactcgggcactttatatttgtagttatatgtgtgatggcataatctgtaggcatgcattcattccctaggatatataattaatgtgatatatctttatgcagaggattaatacgccaatggtagcttccaaattcctccacgtgaagcacctggagatttattttgaaagtcttgatcccgacaaggcctttcccccataatatgattatttgtctttggtttctattcttgatgcttctcctgttttggattctttcatcttttgtgtaagttcccatcccttcctacaattatactccctccgtcccctaatataagggattttgatattttgcttgcactatttgactgttcgtcttattaaaagaaaatcagaattattatttatttttttgacttactttattatccaaagtactttaaacacaacttttcgttttttatatttgtattttttttgaataagatgagtggtcaaacagtgcaagcaaaatgtcaaaatctcttatattaagggacggagggagtatgtagtatctatggtgaagcaatatttaggtgccattatttttttattgtatatgcaggtacaacagggagaaatgaagcatgattcagtttttggcgacgcctcaaatttgaggacgatgcctggacacaagcacgaaagcctcaaggatgtggaaatcattggattttgctctgcgacgagtatggttgagctaacatgttatttactcaagaatgcgatatcactggaatatattacattggcactaagaagggagatgatcttggaagcccatagaggggtcatggcaatcgaaagatacatcagggggaaagttccatccaaggttgagttaaccgttctcgagctttgcatctggtgccatgatcttgaacgtttagatgccttagacaaaggaaaattgatcacattccccacttcttgagttaggcgacatttaattattgtttacacgtgtacaatcagatgtttagttacctatgtaatttatccagtatttaacttcgtaatttttacatggatgagcattggaatggttggtcatggtgtctctctccatcttgctttaatgcttccgatgtctcccgatggtacttaaccagtgtacaatctgatgtccagtcaccttgtgattaaatccaatatttaaatttgttattaagagtgtgttggcagtgctctagctttgactccacctctcttagagctagagcacagccaaataattttagtagtgggctagagtgatatgaaaaaaataaagagtgattttaggaggtatcatatttttagtgtaccatgtttgatgaggtagtaggaggtacgaaatttgcactaaaaattttgatacgtttatctctgcaataaaatttctcaaaaataaactagagagaagcactgtaaaatttctcaaaaataaactagagacgtgaagtagggtgtttttacaactccaatctagagttagctcctagagttagattgaggagttggagctccacaaaacatgcgctaattttacatggatgagtgttggaatggttcgctcatgttgtctcccggggtcttgctttagccgatcagtaagaattaaaagattgtccggatcatcaatgctagagcatgaaaaattcgaagttgtgaaatggcatgtagcctagtggttgcagtgacctaagtagcaccccaaggtcctaaattcaaatcatcatagaagcgaatttcagattgaattatttaagggctaagttccctgtcttagtttaaaaaggttacatatatccagtaaaaaaaaaccttctctagaaaacaatgaaaaattcggagtttaattttggtgaaacatttagagtttttctagcttttgcagtctttcattggctgaaattaaagtcccactcaaaccgatcgagtcaggactcatcatcatcaggagaggcatgctgatttcctaatctcttcagaagacagtagattgataaatcgaaaccccccgatttttcaacccgatccggagcgaggagagtcgtcgtcgtcggcgtcggtgtcggccttctcgccgctgctacgatggggatgttggcgctgaggcgtctcatggcggcgcagcgagatcgtcgccgtcgtcgcaaggcccaagcccgtagtaagccctccctcccctcctcgatcggcctctcttttttttaaagggtattttttattggcctctacatccaactggatatatacggcaattgaaatagggaacttagctctgcaaataacccaatctctgaaattcgctcctatagagatttgaactcagaaccttagggtactacttaagtactcaggtcactgtaaccactaggctacatgccctttcgtccggtgaggtcttgtgcgagcgacaagctagctaggctcgtttgcatctatgttgagattgatctatatttatttgaccgtaacgtcttccccatagcagagtgaatagcaagcatcctttctagctccattcttttttttcttttctgtttgatttgatttgagcagggtattgtagtgctccttcctcttccaatgtggatttgttttgtttactatatatgaaaaaaaaagtagcttaagagaagataaatgatgcagtgatcaaacaatggatggcagattaagatgcaaattctaccttgactttctaattaagaattaccctgttcttttttattaagatataaattatatctcgattttcattagaacgttttttttaaactgccaaatgatatgtttcattctaaaaccttttatatagaagttgttttaaaatatcaaataaatccaaattttaagattgtaataataactaaaacttaactaatcatatgctgctaatgacttatcctgcggtgaaaaatcttcatcttcgtataagtcaaacggcaactaagacgcatttacgtacccatttatgtttagagaaacaaaactccccttaggaaacgttgcatgcaaaaaaaaaaaaatcttcactttgttgttttcttctgttagtgtctgtattattcattattatacattatttgttgcagatggagtaattacttccatggctaaacgaaagggcgccttcctccaaggggatgatacttctcagggtggtaaaagattgagatattcagagccatacctcacggaggtaggacataatattgattgtgaaatatttattatacgtagcaagtaaaaatatatcattgctctaacttgagtctgcatacattgagtggacctatgctaagccaactaaaaataagcgacgtattttttttatagtattttagtactttgttataatgtgggcttagcaaccgtaaagtcataaaccgaaagagtttatttttctttttaaaaaaactagcatatgaatatttgatttttatatttttcttgttcgaggtcttacctgtggggggagctcccacttttcgtgggtctcatatgatagttggggacggtaaccaccatcaccaccactatcttcttaactagtcatatccccgttttttaatacatgacgtcgttaactttttgatattcgtttgaccattcgttttattaaaaaaaatgtaattattatttattttgttatgaattgatttgtcattataggtttttaagcatgacttgtattttttttatgtttgcacaaaatttttaaataagataaatgatcaaacatatgtttaaaagtcaacgttgtcatatattaaaaaaatagaggtactatatgaaaaaaactgcatgtttcaaaaaaaggggaattcctctttttttttctcagttaataacaaagaagcacaaaaagccaaatcaacttgatttattgctaatatttgcagatcacatgtggtacaatcttatctgtatggccggtcctatttttcttagttggagcaaactatttgcctttataatcccaatcttcaactgttctttccccccacgcttgtgcaggacatttggcgccatatacattccctaatgccgctgcgagatgctgcccgtgctgcctgtatatctcaagcatttcttcgttcctggagacgctatcctaacctcatcttaacagcgggcacattgggcttggaactgagaaaaaattggaaggttcatatggcaaggtatttcgatagagttgatcacattctgaagaatcactcgggcattggtgtgaagagatttagtgtggtcgccgcaagctcatatgtcatctgaacaattggcttcagattggtatcgcatcaggaattgaagagatcactctctcgctgcctccggaatacagcttcccatgctcacttttgtctggaaggtcgcttcagcatcttgagcttgtcaattgcgccttccgtcctgtggctgggcttggttgctcgagaaacctgacgaagctgcatctgcattctgttcttatcacggatgatgagctagcttgctttctttcagagtcttttgctctgaagcatttggatctcagcgattgcagagagatggtgtatctgaagataccatgttcgctggagcaactcagctacctggatgtgtcctcgtgccgtctgcaaatgatagagagcaaagctccgaacctgtccagtcttagttattctggtaacctagtagaactctcacttggacaatcatcgcaagtgaaaaccctagatatagaattctatgataaggccaacttcctctgttatgttattaccaagcttcaaaatattgtcccaaatcttgaaagtcttaccatacattctgatgttgaggtatactcgggaactttatatttttagttatttgtgtgatggtataatctgtagccattcagtcagtccctagaatataaccaatagagaaattttacagtctttgagaagtatctcgagatatctaaattttatactaaaaattttggtatctcgaaataccttatctggagatatcaagttttatactagaaaatatgatacatctcagtgcattctttcttgaggaattttttttatttataattttttttattaaaagttttacaaaaataattttccattttgaaaattgacggaaatagtcgcctaccgccctctgggagggcga

SEQ ID NO: 70776 - DNA, 948 bp, Oryza sativa
aaccaaggataatttagcaagacggaattggaatgggtgtttacgatattgtttttgcatgaaaaatgagtctattcaacacctgtttttggattgtcattatgcaaagtttatatggagagcggtttagttctctttttgcttatacctccctagaagtatatctcatatgtttgacagttggcttcagggtgtggacaagaaaaagagtaaactgatacttgttggtgcctcagctttatgttgggctctgtggttgtgtagaaatgatagggtttttgacaaatcactatctgtttcctatatgcaagtaattttcagggcaacatattggcttcgactgtgggctcaactacaaaagtgtgaggaagatggagaatttctgtctgatggagattcaccaataaactggaataatgttttccttgtcatattaggatttcttttatttttggttggtgtgcttgttttattttggactgcgtctttttagtgtgctacttcttgtaataattggctatagctctcctaaacaaaggccggaatgttttattccattatctaaaaaaaaatctaacaatgacagtatgtgttgcaccctgcattgtcatgaccgatgcttcaaagaacctctttgctattcaactgttgtgatcttgtgattggtatcctattcatttcgatggaatatgattatttccctttcttataccatgtttagcattgccaccttttcacacttcttttcttagcatttagctaataatcgcgtaatagagtatatgcatccttaccaaggatttaaatctccggttatagctaccactatagccggagatagttgttaggaaaggaatcatctaagatatgctgattttgccgctacacattctcagccgctaatagctggtattagcgggagatggctggtaaatagacctcgaatta

SEQ ID NO: 70777 - DNA, 15299 bp, Oryza sativa
agtgtgctacttcttgtaataattggctatagctctcctaaacaaaggccggaatgttttattccattatctaaaaaaaaatctaacaatgacagtatgtgttgcaccctgcattgtcatgaccgatgcttcaaagaacctctttgctattcaactgttgtgatcttgtgattggtatcctattcatttcgatggaatatgattatttccctttcttataccatgtttagcattgccaccttttcacacttcttttcttagcatttagctaataatcgcgtaatagagtatatgcatccttaccaaggatttaaatctccggttatagctaccactatagccggagatagttgttaggaaaggaatcatctaagatatgctgattttgccgctacacattctcagccgctaatagctggtattagcgggagatggctgctaaatagaccttgaattagcggcagctaagttgttggtgggccaaaattggcaacgggctatagcccatatccctctcctatgtgactaaagtactaaccctaactctctcctatgcaatgcgtactccatctctttgcagcgaccggcggcggctgcgcctggaggcggcgcgacggcggtgctcgcgcggctacgtgcaacgacggtggccacaacgcccggaggcagtggcgacggtggcagcggccgccgctgcgcccaatccctccctccccattcttctttgttcttcgtttcttctccaagcggcagctgcatccagaggtctaatcttctcccctaagtgtgttcagtatacttatcatgtgacataatatttattttgttctagtgatgtactatttatctttaattcatgtcaattttttggaaaaccgctaaatagcttagctgcagctatagccatctatagccggctatagccgatgaaaaccatagccgctaaaaggcttagccggagatttacttgaggtagagactaggatattacacttcttatctagtattctaaactggcagattgtcctgccagctgattggtcgagacggtgtctaatagtatacgacacgtggaaaaaatataacagcgtatggtcggatttcacggttggactttctcgattaatcgcgtatctgtgcacgtccgtctggccgaacgacttcgcgcgacggcgcaagcagcccactccgctcctgcgtgcagccgcgtgggccgaagcgcagagcaaacctcgccgcgccggtcgtgtgggcctgacacctagctggaccgtgcatgcatgatccccgaatttttttttatttttaattttttttattaaaagttttacaaaaataattttctattttgaaaattgacggaagtggtcgcctaccgccctctgggagggcgatttttaaaaatcgtcatcccagagggcggcgaaagtgacgtggcagacggccgttcgctctcgggcgacggccgccaacgaaatttgcaggcggcccccttgccgccctccgctagggcgattttgtactgtgcggggggccgcctgcaaatgggcggcgagggggcatggaattttgcaggcggcccccttgccgccctgggggagggcgattttttcctcccccctataaagcccagtcccccctctctgaaatttcattatattcactaaaaatccaaaaaaaacgaaagagagagagggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaatttagggcatagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggtatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtaaagggtcctatcaatgcaggggatgttgttggaccatcgatgcaaaatgagaaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaagcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctagtactggttcctagagagagtgcacattgcagtggtgcgtatgaggcccaacatttgccttatacatgatcgttatgcgggtatgttgcgggctattgactacttgcagaacggttgggatgagaagggacttccagctaagtggcctgatgttcggagtcggtggtgcatgagtcacatgggtgcaaatttctacaagcaattcaagaacaagcattttgtggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcggatacttccattggttgctattgttgaattcatccttcacggcacacaagcgtactttagggattgatacaagaaaattggtccgtccatggccgataacaacatagtgtttggcaacgtagtgacaaagtacgtggaagataaaatcaaaaaggcacggagacatagagttgttgctcaaggcacacaagtgcatcggtatgaaataatgtgtgttgataggagcaggcgtggtatctatcgcaagcaagccgtacaggaatgtgtcttgaaggcggatggtggatgtacctgcagttgtatgaagccgaagcttcatcacctcccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaataagcagccgcgcaaggccaaggcgtcgtcgcacagcaggcgattccatggtgtaacaatgctatcgatttaggaaataaaatgctgttgtgatgtgatgagtgttcggactaaatacttgtatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcactcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagactgctggagacctgagacgcacacgttccaccttccctgtggggagatggctccgacactgcaggacgtgtcgtacctgctcgggctaccgctggcgggagcacgagttggtcccgtggacggtgtttttgggtggaaggaggatatcactgcgcgcttcgagcaggtgatgcgccttccacacctaggaccggccaacacccttcctccgtactctacagtcgggcctagcaaggatcccctggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtgcagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacatgacatgtctaattccgatcatgtttattgcagcgtcgttacgctcacgtccaggtgagacgaggttacccggactacgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagtttggattgttcatttctaaatttttatgataattacttcatcgagccatataatttacctctcttcacaggttgactcgacggggacagctagcaggcgcactggctccacgtgtacagcagtacgttgacgactgggtgttagctacagaggaggtgatcaacgagctctttccacacacggaggagaactaccgtgactaccttcactggtaccttcctcgcactcgtgcgcgtgtgaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgctgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctatcgtcggaacaggacctcgacctacggtacctgtttcacacggtactgctcagcccagaggtttcttaagttttgtttctgtttttgtacgaaaacatcaccccgtcgtaactagatgttccatcctcgcaggacctcgtttgccttcgagcgcccctagcttcggagcagtgcgacctacagcaccggtttcgcacggtacagttcagcccaaagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccatacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatgatgctagaacaacttatgctcacgacaacacactttcggcgcttcacggtagtgttagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacatgaaaatggaagcgccattccttgagcgtctcaactggcgaagcgatccttttgctggttggtttccaccatggtgtgaccatcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgatggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatgaatgtacataggaggatgtaaggaaatgttaattcgtacaatggattgacacagtcagagttacttcaagtggcgggccgataacgcaacctaaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcaatggatcgacaatgtcactccatcatatcatggccagaagataacagagtcagcaacacaagtagagtatcaacgattgaaggaccacgagaatgcaatgcattctgaccgacctagaaggggccgataggttaccgcatgcttgattcgtcgggattgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatattaatacaaaaatataaagcacagtataaaatcgccctcccccagggcggcaagggggccgcctgcaaaattccaggcctcccgccgcccatttgcaggcagccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattccatgatccccaacgtcccgagcctaacatccctatgtgattgaaaaaaatctttgtataaaaatacactatactacatgtcaattaaaaaaattagcaaacatctaaatttacctaaaatgaaaataataaataggaaactagctgatgtacagaagtaagttgcagcaagaattttgttaagatggttgaaaatattttaataaattaaatcattacatgatttttttcatgtatttttcattgcaacatgatggatacaaattaccacaaaacacatttattagagtatatatttcctgctatatattttgtttgtagaactatctactctctccatcccataataagcgtagttgtgggtttcaatgcccatctttgaccatccgtcttatttgaaatatttttatgattagtatttttattgttgttagatgataaaatatgaataatactttatgcgtgatttaacttttcaaatttttcatacatttttcaaataagacggatagtcaaatgttgggcacgaaaacttatggctacacttataatgggacggtggagtatatatttatggaacaacatattgtttttaagaataacgagcttttgtttttaacgtaatatcatcttcaggaagttaaatagtatgcctagcataatacactcaccgatcaggatagtatatactattattgtaccttgatttgttcatcggccatctttttttttcccgaaacacataaacccattaaaaattcatgcaagatttctatatgtattagccacaaactagcctgcgcgtcaatagacgtgctctttttctagtgtttttctaaagagcagttttcccgtccttaaaaagatgaggatttttacagtccatcagggagaggaggtcctaaatcctgtatgtcaatatagttagatctgatggctgatgatcctcagtaccgtgaggtattggagtacccatgcggtggtacccccgcccgcccgcatgtggtgagcaagtggaagggcaaaaatggattttcgcatcgtttccagatgcgctaagtcgctcgttcctttcctgatcccctccttggaatggcgcatcctttcctcccaagatcgccggctgcatccaagaagtcaacgacctcagccactaccacctatcgcagccgccgccccctttttctccttctcctccccctccacccttctcgtcccagtcctagatccagaggtcactagttcgattccccatcccattcttctctcttttttctcttctcccacggtggacgcttgatttttccatggtgatggaggagcatcaactctggtccatcgtacatggtgctggagatcgatccacctgaattttggcttctcttttcctcacccgatgatgctcctgtgcccaatttttttctcacacggtggtccatggcaacggaggagcaaatgctatctagttcatggcgatggagatccggtgtagattagcccacggaggagtttaggagctcgtccatggcgaaggagattcccggcctggattggcatttactcctgtgctgcacttcgcccaagctctccggtgacccccgcttccgaccgaacgagcatggtggatgagcagaggatgcgcggtttctgcctcacggggaggggaaggacctctcaaccgttgttcccatcgtacccttttagattgaagggttggattttacttggtacctggaagtaccagtacttagaggtcccagctgttggaccgtagcaaagctctaaaaagataccaggcaccaccatatctaatcaggtaccaaattaaataatatttgtccatgaagaacgatcgcgcggtcgaaaaaatttggtacctcctctcgtcaagcatggctcctactatacgcggtaatctttctgcacgtaagttgcaggggcaaaattgttttttcgcgttggttggattatttctctcacgaaggagccggccggtcccgttcctcccttttctcgcaccggatggcggccatcgccgccccatccaagatgttgccccacgccgctctccactccaccctcaccacgatgtgcaacggcccttgacggtcaatatctaccagatgttcattcccctttctcatggattatgctctggtgtttgaattctcctaaagatgaagatgaagatgaaaattaagtgttttacgcaaaacgagatgataataacgtgtgattatttgagttttaattattacaacttaaaaaagattaatctgacattttagaacaactttcatataaaaagttttcgcacgaaacacaccgtttagtagtttgaaaagcgtgccacgaaaatccaaaagtttatccgaggattcgaacggggaggcagaggtcgccgtaggccactgaggcaacggcagcctcgacgcccgaggagcatgaggcttgatctagcgtgcgctaatttgagtaggaggtcgtagcctcgacgttggacagccatcgctaggcaacagccgattgcatgttcagtggttatacatgccggttcttaattttatcttgttaaaaaatggaaaacgtctctcacatatatatatatatatacacatatatatatatatatatacacatatatatatatatacacatatatatatatatatacacatatatatatatatatatatatatatatatacacatatatatacatatatacacatatatacatatatatatatatatacatacatatatatatatatatatatatatagagagagagagtattaggaggtggagtaatgtggaccattcatcaagaggggcatggtacagaatgaaaattattataaccactggttgtggagtaattaactagtaaaatattagtattttaagtggatggattactcggctggactgaaccggtattgatcggtaggtaaaacgtaaatcgggcattgatttacgcatcgaatagatcttcacagaaaaaaggatcagaacgtcttctttcttcttctgcattggtttgttcttgttctagggtttgacctaaactcactaaaaagaaacaaagggagaaccgttggaatcattgaggattcaatataagacgagatagaccggtcaatggttaggtgaagcccatcttgtaagatctccttcacgcagttgattagttatttatgtagttcacaaattccttcgtataaggggctgaaataagatctctgttctaatagggtttgaataggtggacacaaaagaacactagtacagatcctctcatctgtgacggcccatcacatacctaggcaacgtgggtcgtcagaacgaagtcatctcaatcgggcctaaatttttgccattgtagatgtactcgtcggggtgcatattcctatagcctgtcaccgatgacactcatctgtgacgggctcgaagttaggtctgattgagatgacccccactatctcaatcgggcccaaatactgagcccgtcacagatgagtgtcatcggtgacgggctccaaagaaggcccgattgagatggccttaatgcccgtcaccgatgactcttatcagtgtcgggcttctatttatgcccgttagagattagtgtgcgcccgttagagatgatattttttttgcccgattgtgatatactttgcacactatatatattccagcagtccgttgtctgtagttatcccactgttcactatgttggtgggaggttgaagggggcaaatttttgtaatttttttgcaaacaaaaactggaaaatcataaaagtaagcaaaagggtactaatcatttcctattaatttagtagtacttatgttatgagatgttaactaatattttgttcattgtttagcgatggatcgaagttggatgtacacgactggcctgatgcgtcagtacaaggagtttagagatggcgtattaagttttatgaaagccacagtggaggataggataagaagaaacgacaagtacatgtgttgtccatgtagcgattgcaggaatgagatttggttggatgatgaaaaggaagtacacgctcacttgatacgccgaagaattgttcccgatcaagcttcctacgcgcaggctcatttcacagtgctgcaacatatggctgaagtaacccagtgaacttcagcctattatagatgagaagacaggaagagtgtacctcccaccagcttgccacacattgtcgaaggatgagaagatcgcaatgctatcatgtctggcagatattaaagttccttcgggctattgcgcaagaataagtaagtacgttaaattggaggatctaaagctggttgaaatgaagtctcacgattgccacgtgctaatcacacatatcttgctagttgctatcagaggcattctaccaccacaagtccgtcacacaatccaacggctttgtgccttcttcaatgcaatcggtcagaagattatagatccagaagacctagatgggttgcaggcagatattgtcagtaccctgtgtcacttggagatgtattttccactgttcacctagtgaagcaaacaaaaatatgtgggctagcttttatgagagaaatgtgaccattcgagaggtacatgggaattctgaagtcctacgttcggaacagagcaaaaccagaggggagcatcattgaaggttacacgaccgaggaagtcattcagttctgtatcgattacatggccgagactgatcctataagagttcttgcgtctcgccacgaaggaaggttggcaggtgtcggcacaactagcaaaccgtcattccttctctctgtggcatgccaacgtactaactttgcttcattggggttgg

SEQ ID NO: 70778 - DNA, 7064 bp, Oryza sativa
tatttattaactagggatttagctctaggttaattaagataatttcttcgggcaatttatttaaccaatttttaaagcaagaaaaaggggaaacttctgggcgtgacaaacctaccccccttaaacggaatctcgacctcgagattcggaagagctggcgaagaggtgcgggtgggtggcctcttcttctgagtgatgactccactgaactttgcagaatctgattactttgtttctggtccttctctcactggtttcgaggatacgagtcggcttctccacatacgtcagatcttcctgaatttcgatgtgatccggacttgcctgttcctcaggaactctcaaacatttcttcaactgagagacgtggaacacgttgtggatgccaagcatgttggagggaagctcaagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagattgcgcaattctcaatctttccctaacagctctgactttttcttctgcctcatttaaaacttctgtaccaaacaattggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattgactcgctcggtctggccatctgtttgtggatggtaagcagtactgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcactggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctaacccaccagaacttctctttgaggtcttggtacatcttagtactaccggaaagaatggaatactgagtttgatgagcctcggttagtatcaggtcttttaattccttgttttcgggtacacacaatctttctcccatccagattgttccttgttcatcctcaacaaaacctcgggcttttccaactctcatgttctttttgagctctgctacttcaggatcacttgcttgagctatgcgaacctgctccaccagtgtgggctgtgcctctagggcaaccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtgaagatgtattttaacttttgtgatctgtatatacctcacaacggtaaccgatgagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcatttagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccatagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaatttcataaacaccttgttcatcaaattcatgaagaaggcaggtgtattagtgagtccgaaagacataactgtgcattcgaacaacccgtaccgagtgatgaatgctgtctttggaatatcctcttcgtggatcctcaactggtgatagcctgatcgcaggtctatcttagagaacacagtagctcctttcaactgatcaaacagatcatcaatccttggcaaaggatacttgttcttgatggtgacctcattgaatgcgcggtagtcaacgcacatcctcttggttttgtctttcttctccacaaagataaccggagcaccccaaggcgacgtgctcgggtggatgtatcccttctgtaactgttcatcgacttgcttcttgacttccgccaactcgttggctcccattctgtaaggcctcttgtggatcggtgcagttccaggtaccaagtcaatccggaactcgatatccctttttggtggcattgttgtcagatcgtccggaaaaacctttggatactctctaactatgggaatatcctccagcttcttagtggttttctccactgctacctcttgttcttcaccagcagcctggtttaaactgatccctggcttctgcggcactagagactggaaggttaccacctctccttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggggctgactgcgcctcctctgcagatgcatgagtaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgggctggaatctttagtgaactcggagtagggttgaggctgtgctgctcactgttgttgtgactgccactatggtggttcttgttgaagctacccgggtggtagggacggtgctgccggataatcatggtggaaggtccaccgtgatgtcccatcgtgaaacgaggcttctgactcttccctggggagtcctgaactgagctgtcttcctcttacggtttattttgttacagtgctcctcctgacggatagccttatccaccagcttctcaaagtcctcataatctctagagatcaactggttagtcaattcatcatcaagaccagacagaaacttctcacgcctcccgtcatcggtacgcacgtcctcaggggcgtagcgtgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagttggacgggtcaccatgtagttgtcccaccaaacagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgctgctgcacctgttgcaacacctgatggtactgttgctgcatctgttgcatcatcactgtcatcatctgagtctgattgtccaacacctgagcaattgttgggttctcgggcggtggggacggactgttgtcagatgcactgttggcacatgctccattgatcagctcttcgctgccactggcgttgttcgagtcgcgtgaaccattccttatctccatctgaaggggataggtagaaatatgagaaaaggaagaaaaacagggggctcagaaactaatctttcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaatcgagggataggactgacatctaaagtagacaagggataggaaccaattcatgctcaaatccaaattaaacaaagcaaaagaagactcaaataaataaccgagcatgatgatttttatgcatagaacaacatttttcacgaaccgagacaaaagacactaatgcaactgactaaacaataacttaatgcatgaaatagatgcatagtcatactgatacgcataaacttaccccaccgaacataggcacgacctaatgcatatcacccgacaattcccgaccgactgccgaataaattccgaataaacttttactaaatccctagaatgtccctagtcgagaaatccaattaaataagcgaccaagatttttcccacaaatcgaaagaacaaaccccaaaattttcccgaaacaaattccaagtgcaaaagggcatatgtatatgaaaaaaaaaagggttcagagggctcttatgtttccagttggcttgtcctacggtcaaggtcggctctgataccaacttgtcacacccagaaattctcgaaccagaatttctaagctgaatgtgcattaaatccctgtccagggccagccagggtacacaaacgacaattgttgatatacagacccacgtcttacaaaaatataaaagattacaaatgcagtgggaaagataaaagcgagctaaaccgggaagcttgacttcagcagcgggcgactccactccacaggcaaaccttgacggcagcgaggaaaccaacctctctgagacagctccaactgagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaactgctgtagtaattattcaatattaaccaatcactgtccaacgctacaccacgttgcaaaaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgaaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccgaagacctcggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgctatgggtgcgaccagcaaaaccatgcactcacagcccgccattcagaatattttaataaactgacacccttgcggtggcaccaatctaaagctatgccaatagacaaagtctatgtaataatgtgatccctttttgtgtactagttgagctaagcatggctaagcatttcctaaaccaacatctaatcattttgatacccaggttatcaatggcatatggtaaacaataaatggctaagtaataggacccatcccacatgacattgtaaaagaatgcaacatttaatagaaatgcagggtgtttgtaaattgggtacaatatgatcaaatctaaagcatgacttgccttgctctcgaactgatgagacctcagcaacgtcttcgagaaactgcggatcgacgaaacggccgaaacctacgcgacaaacaaagcacacaagcaaaacatgctataagactactgaaacaggaaacaaaaccatttttaatggattctttgcatttctcttgatttactgagacttgaatggacttaaacggagctcagatgaattacttatgaattttagaagataaactgtgtttttactaataaagaaaaagtccttaattaat

SEQ ID NO: 70779 - DNA, 24818 bp, Oryza sativa
  unsure (1)..(24818): unsure at all n locations
gttggccggagacgaaggagaatggatagctcaccggtgtgcgaggagaaccgggctccggtggggtttagcggaaaccgagcggcggccgaggtggctcacgcggcggcaatgctaatggcggcggcggctctagcggctgcggcgcacgaccggaggtggcggcatgcggcggcgctagtggcgagcggcgcgtgaccggtaggaggcacgggagagcgcggcgaaaaggggaaaagggagagggagatgcggggaagctttataggggctcgagaggggcggacatggtcgggaaaccccccgatttggccggcgacgtggggggagaggaagagagagagagagagtgggggggattcaaatcgaatcccgcccatttgcgagcgcgcgtgcgggcgggaatggtgggaagggcgacaatgtgggtacgcgaagtgggggcccggcgtggagcgaaaaagccgccggcgcgcacggtttcgncggcggttcccgtcgttgggcgggtggctgaaggaaggggacgacctgacaggtgggccccccctgtcagcgtcccggagagaggggaaaagggaacgggccggcccaaaggaaggaggccgagcgcgggagggtgtgggccgacggcccaatagagaaaaaaaaagaaggaaaagaaaaagaaaaagaagaaaggatttttcctgggatttaaaattgcactttggtgatttttaattggttaaaattatttccaaggctctgaaaattccactaaaaatcttgttaatgcattggagcatggggaactcaagaaaaattccaccatgctatttccgattattaattgcatttattaactagggatttaactctaggttaattaagataatttcttcgggcaatttatttaaccaatttttaaagcaagaaaatggggaaacttctgggcgtgacacctgtgttttttatggctgtttttttttccataaggacagaccctctacacttgttcttatggatgaattattatggctgtatcgtttttgcgtaaggacagaccctctacacttgttcttaatttcttttgggggtgggggcagttgcaaatgatggtaattgatgcataatttctgagcaaaactgagaccaaacttattttatgtcatgacttgtgtttttttaggtacaaaaataatatatatatgacttgtgtagtatgggctattttgggtgattttgagggaaatgggatggatatgcatagaaatctgttattaaatgaagttactgaaattatggcatttaggagaatacgaagtgtcccggttgccaaatctggtttggtcgggttactgcctgcacggtaccgaccaagacaaattggtaaacagaacattttgttcaaatacaacatttctagaaatctgttatcgttaccaatatcctagattgcttttaaggtcatttctttagggaaccccattcccataaattcagtatccaaagatggttgttgtatgtatgggaataagggttccctaacgaaataatcttggacgcaatctaggagtttgctgatgataacgttagggatcttggataggaagggttttggttgcctgtgtgttctatctgcgttcgccttgtcggcagatatgtagcatccatgttccttaggcggagcaaacgggatctcgacctcgacatccatatcgcacaagaacttgctaccgttgccactatcttatggtagtgacattgatagcaagttcgagtgggatattgatgtcgaggtcgagttcccggctgctccggccgtaatgaacatggatgctatggttctgtcgacgaggcaaacgcaggtaggagatagaggtatatcaaaccatcagagaatgtgtgtagatgcaattttgtgtttaaaaagtactttctccccgtacaacagtgacataggacatgtcatagcaaggcgaaccaatgtcgacgaccactactgggactacttcgagccggaatcctaggacccagaataagattcctagggaagtctacaccataaaagaggtggacgatgttggatatccgacggctccgatgaaagatgtcaaaaagttccctacgatatgcggagtcttagggaggcggaacttcactattctgaaggaccacattgatctggtccctcaagaagaaaaagaagaggcctggaggcagttcaaggaaagcttctgataccctacagaggccgaggcagggctcaagcggcaagctatccgcaagatggagaattgttggaaaaatttcaagacaacgctggtcacggagtacgtcctcaaccccgcctagccagaaccatttgggaaatacccattcatcacctgacccgtgtgggatgagttccatgcctccaaatcaacgaaagagtctcagaaaaaaaagccaggcctaccgtgatctgcaggcaaggaaccttcacccgcaccggcttggcacaagaggctacgcggggaaacaagcagaatgggacaaggaggatgaagctgcagcagaatctaacaccccacaagtgcttgctgatatcccggtccagagggcaaggaactgggcaagggcaagggtgaaaaagaatagtgacggaactctttcgttcccaattcccgaagatcaagcggtgtaccagaaaatcgtaagttgaacaaatagaataagtttcattatgttgtatcgtattctttgtctaacgcgtcctaactttaccccaggtcgaactgaatgctgagagacaggcctcccaagaggtctgctcacaaaaacgggaggatgacatcctcatgaaagcgttgggaaacgaagaacaccgtggacgaacaaggggcattggctccaatgttccatggaagtttgggtttccccaatatgcgtggcagtacaagaagcacaagctttccaaggcgcagaaagctgcacgcattaaggcccaactttgggaggagcttaaagaagagctcactgccgagctgttaggtatggaggctcggatggaggcacgcatcagggataggtcgaccgatgccactcccggtcccatagtacaagtgagccccacacagaggcgtagcagctgcgcattcaactgaggctccggcagaatagtctaaaggccccgccgcggtggaccacataacggtaaaaacaacttaataacgcatatattgtattagcaccacaatacattgcaacatatactaaggacactaatgaatctatcgcaggaacgcacatcgtgtaccctagtcgttagggtgacaccaggatttgcaattcctgtcgcagagggtcaagcattcaagcctaccccggagacccaagtgcatggggcgcagctgctagtcggcaatgccaaagttcaagtggacttagtgaagcccgattgtgttggctacactatcccacacccacctaatgacgagattctgacccttggggctgcacatgggacctttattcaatggcccaagcacatcattgagatcaatataactccaaggccagcgccaagttctcgtccgccgccgacgcgtccccatccaactgttgtatctctccattcctgccgttgaacaaagagatgaagatctccaattacagtatgatactgattttggggacgacggtatgaaggtcgacagtaggccgcacctctcccctcttgccaaaagtagcaagagggcgaaatcttctccacccaagcttgacacacgcagaaaagctgctggaacggggagaggaaaagtaaaggtgccattagccccaaagaagcttgatcttggcaaggcgccagtagctcctccaaagcttccagccgaattcacattcggcatgccattggtcggagacgatgccttattcaagatgggccctgcatgcaaggagttgcacgggtactacatggagaagtccaatgcaaggaggaagaatagagagacctacatgttgggccagcatgatggtcagccgtttctcgggcctactgccttcatcgccatagacttcaaagatctatgggacctctacagggtgcgagcgatcgacaccaacctccttaagtgctactccttgtaagtatttcttggtacacgaaatggtaatgactgtccataaattacgcttaccctgactcttgtcttgctcgtagattaacctggaagcatgtccatcataaagcaccccatattgccttacttgatccaactgtcgtcaacgagacaacgctgaaaaatgattgagcaaacatggtgggctatatcaaggactgcttatttgcccgtcaagacaaggacttcattatgtgtgcctacaatcaacagtaagcgtgtactatacttatactcaaatactcgacgcgtacaactgtagtatgtaactggcaatttaataatttcgcaggcaacattggattcttttggtaataacactgaagtggagttcagtacactaccttaactccaatatcaagccagaaatatacgattggtcggccatcgaatctgccttgaacgaggcatgggaccaatacgtggcaagaggcgggaggcataaggatgggcatcccaaactcggtcacaagaaagacttcccaatacgtcaacaagttggcgaccagtgcaggttccatgtctgtcataacatgaggagcttcgcagacaaggtgacattgctcgaccttgaggtgtgtaattcagttgtttatacacacataggacgacaaatttacaagtatgtagactaacttggcaccgaacatgcaggaatttatttcaaggattccggaaatcaacttcgaaatcattagagaggagatagcacaattcatactagatgatatcttgtcaccgaaagggatgtttagagtgaagtcctaggtagctcgtctcggaatggcagaacatttgcaatgcatatgcgacaaacatttgatttttgtaaatattctttgtaatacaattatattctttagagtaaagtcctaggtagctcgtctctgtatatacttgcatttctagttacatataaaattgttccaatttattacttagttttgcaggttttgatgcatgtcggcggtttggagagaaaaaaaggatgtgaatgacatatatatgtgaatgggttgtggatgtgaatgtatatgtgtttgattttgtgaattggctgtgctatgatggaatatgaatgtgaattggctgatgtaatgctgggaatgggtctatatgaattggctgtgatggtatatgtgaattgacgctgggaatgggactatgtatatatatatatatacatatatatatatatacatatatatatatatacatatatatatatatgcttctgtcatttttgcagcgggcatggctagcaaagtcctgaggctagccaaaaagacaaattttattttttttggttctaaactcatccctgacgggcatttagctaatgcccgaaagagataactcatccgtgacgggctatagagtcaagcccgttagagattagtcatcagtgacgggcttttagaatacacccgatagagataagtcatccgaaccgggactagtttgattcaacacgtggggtcaaacctatcggtgacgggctctggctgaatgcccgatggagatgactactcatccgtgatgggcttagtggtgtgcccgattgagattagtcattcgtgacgggctcctaactacggtggtttgactggtcatactcatctgtgacgggcttggttgtcggcccgattgagatagcatccatccgtgacgggctttagcccgattgagatattttctcacatcagtgacctttgcccactgacggggccttacccgatagtgatgaggctttcagcccgttaaagataagcgatcctgttctagtggaagtcacgtgcggtggacccgcaaggagaaaccgcaaggagaaacaggcaagagggagaagctctagcatggtcatgtgtttcggacaaaacataaatctatagaaaaccatgcaaatgaaaacttttacgctagtataacatgttctttggaataaaacataaatttagagtaacgtgtgtgttcttggaacaaatcgtaaatctagaggaaatcacacaaataagaacctcaaagaacacaacctaaatctagagaaaatcatgcaaatgagaacctaaacgtacgctagtatcaggcaaatgacttaagtggtacctatacagtaccgatttaaatttggagacaattttgccattttctctctagtagcaaatttatgttttacccttggtacctaagtacgtacactaatactaatacttaaatactgtttacatggtaccatgttactgataattaagcgttggatttttactctttggaatgcaaaaactataaaagctctcatatatatactcccttcgtttctatatatttaacgccgttgatttttttaaatatgtatatacactagaaaaaatagtacctgtgcgttacaatgggtgaagtctattttaatcttattattgttatatggtttagttaagataaaattcactatggaagttcgcttggatatatatttttttagaaaatcatgagctgcagttagctaggagtccgatcgtcccaagttagcatgtgagtttttttaaaacagatttcttatatgattccttctgtaccaaaagtgaacgatcttaaaaaccgactcaaatacagatatatatttccaaaagcaaacaaacttaaaaaccgactcatacacggatgacgtaccaaaatatcggtaaaaacaacttaaatttttgtgatagtagagatatatagaagtcattactaactcaaataaaaatatactgctatatgaattatattgttgaaaagctcccctagagcaccaaacgaagtttaatccaatcgaacgtgattgcaagcttcagtgggatcgatcgatcatgcatgacatctcgcgacatcctgctaatccctgcaatcctgttctttctcacatccacgcgtgtacgtgtttgcgggaccgccggggtggaggagctttggtgttccagggatgtcgtcgtggttcatggtcgtgtagccgatttcattgtcggcggagacgccgacatcctcgacggcggtgaggacgaggagagccaccagggacaggccgacgacgacggtcaggttcaccctagctttcgccatggcgatccgagctaatatagctagcttcacagatgatcgacgggcacctcgatcgctcgatctccttctctttctcctggtttgtgtgaatctgtgatgagttaattgttggctaaggctaactgattttatagtgtagcatatgtctaagatatgagaggattaattaatggtccaggagtgttctagctaggggtttgtattaccgcatgcattgatgatttcatggtaaaaactaacaatagcatggatcatgcagggatggatggctcattttggccaccatctaatgtatggtgtggatatatatagcttttctaaagttaggtttctgatgtgcggtgcaactgactactgtaactgttcgcttttaatttattggccgtagttttgaactaacaatccctgacagtggctttcaacggttcataaccgcctgcgaatattgtgcttataaattctatgataaaaaaaaaggctatatgtgatgagttgtgttactgcccatatggtttcatggcaagatttgtctataccgattggaagatatatataaaagaaaaaggctatatgtaccaacttttttcgtactaacactgaaacataattgactaatgcaccagaagaaatactcattacgtttcaaattacttgtcaactttgtcctaattaagtcaagtattcctaactttaactattaaattcaagaaatttatgtgtgaactatatattataaaagcatatttctcatgttgaatcttaaagcataaagcactactaaaaaaacctagataggtgttggttgggaacccaacataggtgccggttttttccaactggcacctagaaagtgatacagatgagagaaatcaaaggtgccggttttgaaaccggcacctttgtggtcccaagaataaaaaaaatcggctcgatgccaaacatgcccaattatcgagccactcgccaaacatgcccaattaatatttatgttgacgccaaatcgtgttgtcatgttatgtgcaactcgcaacggcacccggagatgcgccgccgcagggaatggtagatatatgccaccgaacgaacacccgggagggacccatcagggttaacgcgtgctagtttgtcctaggttcaactggccagttaggacatcctgtaacgccgacgagagacgacgaacaattaagaaattggagtagaatatactttgcatggcataggtagcaaggaggaggaagatatggaatacagagggtttggacaataaattttaacgattgattggtggttgtttcaatcaggcttagtcctctatatttataggagaggtgaacttgtttcccagggtcttttccacatccaatagatgttgaaaccaattagaactcaaaaatctcagacccaagaaaaaaaaacctgagatccgacaagtcgaactgctggtacgaccgcccacatgtcgccagtgaggccgccccccgcagatgaattagaccggccctatggtggcggtccgaccggcctcacgtggtaagcccgggaccttctcaaatttgaccacattttcatattattactctaggtgtgatttcgatgttaaccatacatatgcttgtacaattattcatgccggtttattaaaaaaaagaagaagaagaagcaaccaacccaaaaagcctggcaaacatatatcgtctctgtcccctctataggatagaaataatatacaatggcgacggtttcttacagcaaaacaccatatataattttgtggtatacatccatcaacagatccacattcttacaatgctttctagcaaagatcatggcaaattttgccaaagctgcaactatatatatagagagagagaaatcattactaacccacataagaatttgctgttacaatacttatattatcgaaaagctcccctatatagcaccaaacgaagtttaattccaaacgaacgtgcatcgctatagcatcagtgatcaatcgatcgatcgatcatgtcatcttgctatccctgcacgcctgctctttctcacatccacgcgtgtatttgttagcgatgtcgccggggtggttgagctgcggtgttccaggaatatggtcgcgattcatggacgagtagtcgatgacctgcgcgacgacggcgacatcctcgacggcgatgatgaggacgaggagagccaccagggacgacaggccgaggacggtcaggttcaccctagctttcgccatgtcgatcgatcgagctagagctagctagcctcacacagatgacgacgggagtagtcttctggttggtgaatctgtgatgaattgttggctatggataactgattttatagtgtagcgtgtgtcaaagatatgagaggattaatatggctgggtagagtgtgcgttctaggggtgtgtattactgcacgcgttcatgatttcatggcaaaaactaacaataggatggatcatggatatatggatggatggcttctttttggccgcatgtaatgtatggtgtgcatatatatatatatatatatatatatatatatatatatatatatatatatatatatatatatatatatatatatatatatagcttttctaaagttaggttcctgatgagatgtgcggtaaaacatgaatatcgtaactgtttctcttttagtttagtcttgaatcgtctctgatagtggcagtgttcagaaccacctgtgattgtgcttataaagtctatgataaccctttttacggttgtgttattgtctatatggtttcaagatttctgtctatactgattgcaagatcggaattgctaaaaaaatatcgcaagttttttgggaaaaaaaactttcaaatgcaactatatatagtacagttgtaatgtaactagactgtaattacactataattacattgtaactgcactataatgacattgtaatctctatattaagttagatacaaagttgcatatattactttaatacttacactggtggagaagtgctttttagtcccggttcgtaaccccccttgtagtcccggttttcaaccgggactacgaacccgggaagtcccggttcaaataaccgggactaaaaatcgatctctagtcctggttggtgttaccaaaccaactgggactaaagatatttttttctttttttttctgtttttaatattgaatattgacttcacaccatcccctcctatatccaaatcatcacatatcacagaacatctccaaatcctcaaatcctcaaacaaattatctccaaatacatcacaaactcttaaaaaaatagatcatctccaaatacatcacaaactcttaaaaaaaattacatcacagggttctaaaaaattcatcacagattcacatctcatacaaaaatacatcacagattcacatctcaaaaaaaaaagaaaaaaaatccggtcggcggccactgccgccaccccgcctcccctttgcgccggccacccgccgccgccgcctacctcgcccgcgccggccgcctgcacgcttcgcaaacttgtggggtgaaggaaaaaaaaggaaggagaggagaggagttagagataaggaaagagataagaagttagagaggaaaaaaaatgagatagagggaggagtttgttgtgtggacgggaaaagaggatcggtactagggattatatagtgtgttttgatttttattcccagttagtaacatcaaccggaactaaaaataggtttttagtcccggttggtgttactaaccgggactaaagatcctagggccctggcaaggaatcaaccggaactaaaaatgaactttagtccctgttaccaaccgggactaaagatgatttttagtcccggttggtaacaacaaccgggactaaagatcttcctcttattaaccgggactaatttttagtcccggtttttaatggaatcgggactattatggatttgggtcgaccgaccaaaaatggtttctctaccagtgttatatacaaattatattatagttacaatataattaaagtggaattatattacaattatactacacttagattttgaaagttttccgttaaaaaacttgtggcagtcttttagatagcatcttggaatatataaaaagatgagcttaatttactaatgtacaagaacaaatactccatatgttttaaattacttattgttttaactttgccttaaatcaaacattactagctttgactattaaaatctatatattcatatatatagtttgaaaacattgaagtatatatgtaattataaaaagcatttgttttgatgttaaactatattttttttaaaaaaattgatattcaaagttagaaaggccaattggctcatgtctgatatgggctgctagagacaatacaaccatgtacatcgcatatatgtgtttacttaaaagccgtgggaatggctgaggattagtgcgccacgtcagcaattttttcaaaaaaacccctgtgtttttgttaattacataccagttcccatcaacatcgtccgtttgatctcgcggcagggtcgatctaaccgtccacgtgtccgctgcggcggcccttcctcagccgtgggatcgtcgaatcgggaacgaacggcgtaaatttagtccacccacacgaaaccctagccctccctccccggcctgtctcgcccgcagccacgccgccgcctcgccctttgcacgcgccatggccgccgcatcctcgccctcctccagccatcatcgtcgcgccgctgccaccaataagggaggccgtggcatcagctagtgatggccccgcgtctgtcgcccgcggcgagacgcgctctccgctccggtcagtgcggcgccaaatccacctcggggacatcggctgtctcgctgcggtagaagaaggtggtaggaccattgggggttgaacagtgattgctaggagatcgaggaggataaggaaggagaagagcacagctcagttacggctgccacgacgatagctgctggtcggcgacaactacggcaaggccatcgcccagtgccacacgtgccgctgtacatgtcaccacgccgtcctctcttgctccactagaatctcctcatctcctctccgtcctcttcaggtgagtttgggggccactttttgcaggcttgcaaccatgcttctctcctgcctgtgctaacgggtcatggctgttgttattgatggtactgcaattttactgttgttgtattccacagatatttgatttgggcatagttactattgattacaatctcacttatgcatatttaaagtaaatcatgtactcatccattccattgaaaaatagaacttgcgctgagttggtgatctttagatattaccaatcatttgttgcagtgtgtttttttgaataaagatcttttggacttgcttgaactaatatggcatcttgcctagagcaactgctgatttttgcctcattatgaacctatcaggaatggccaattcgtcactgattattttcttgacgttcatgattcctaacactatgaatggatgagtgacaagtttgacaatgaggtatgtacctgatcctgtcattttgtctttttcttaagaaaagcagggtctacccttatgtactttttcctgcagttttgcctacattatgcatgaatctaaaaagtccacctacataattcatcaagcctacaggtgctctcctacgatatctcacaaggatttaggtatactcatatttctgctagacccaaaatctcatgaacgagtatgtatctgtgttctctatttaacaatgagcgattcattgaagctagaatgctttagatatgataatttgaatcaaggtcgctaattgtggttcaataccaaatggcaatgctggtggccttgctgtagttgtcgaattaactatgaacctatctcagcagctgccaaattcatgaataatttcccccctttttcctgtgttcatatttctatcatttacattccttttgcaggaatttatacatcctacaaaagacagaacaacatagtaggatgatatgtttgggtacggacttcaagattcacttagatttgattaaaaaatgaaaaatatttatcacatcctaccttcacagctgtttattttttctgagttaggagtatgtagtactccagataatcaaagagtccaggattattaaatatgtgcatgttgtgtttacatggcgagaaaaggctacatgaccaaaatctttgcttaattcgtgcaccacacacatgaataagtccgaatctttccactggtcatttcttttgctcacggccaatttgaagagctatgaactattcgtatttctgtcctcaaacaaatcttaatcctaatacttgaaagaaaaagagagattcaatatgtatctttacttcatgcaaaaacacattgctcctttgtattttgcatttcagaattcagttttgccttatgaatagcttttcatcctagaattaactaatcgaacaacaaattgatgttgggaagatctaactaataatcaatatctgctgcaattgtttcttaccattcctgctctgtacttgcactgatgataccatgccttcatagcatataactaagcgtgcattataccttcttatctgtttgttgtgtggattggctaagcaaacataatggagtgctattctttgtatagacatgtaatttttttctgtttgtaggtaatttttacataaatgtgttgttctgaactaataatccagtgttctgttcaggctttccccattcatttctattaagtgaactattgtatcagctctaatttcccttttatgtgcatctactgaataatgttgcagggtctagtgaaatctattcatgtattgtgacctgaaaaattaatcaaggattgctctttaccgatgaagataacatacggaaatatgccaagcttgcaaagttgatttgattgataagaaatccatgtcccattatcaatgcgttcaagagtcaagaatctgtgctggtaatgggtactacatgaacttttctgcaactacaggtttcaagcatttgctccctttctgttctatgcactttccaaatttatcaaggcaagcacatggatcatggacgttatgtactaatgtacatatttgccaaactatcgcctttctaaatatggaacttttcatgtttcagaatttaggtaagatttagggttgccacttatatttagtgatcagtacaaattcaaagttttgtcatttttctttggtgcatcataggtcaattgagattcattcttgccaagctttcatcaaaattctgacagcttgtgttttacacctacctgttttttctatgtttacttacaagcatgaatattggtagagaagaatagtactatagtttgctcatataagtaaaccaggatatgagatgatttggtgtggcctgagacaaagctgaattaatcagcaagtttttaatcaattattcttgctaaaggcactttgagaagttgttttcagtttgacaaaaataataaagaaaacaacaagaagaaaagttgtttaaagttatttaagtaaagttgtgagctattatgtgatagtgcatcaaatatttgtaagatagatgtagccggttactctgaaaagtaaaattgaatgaatcaatgcccatctttcgttttttctgttctttaatttatattttttagcgcatataatcctttatgttgtcgattgcacaatataaaataatggaactttaccaatgccctgcaggtgaaaactttacattatagttcatcattctatctgacagctaataagacttttagagctccttcaattactactcaagcttccgtgtagccatgccaataggattagcaatgaagattcccacgcatgctcacacatatgcatgggaaaactcatgtggttccgaaactaatgttgcatcatatatctcaattaaatcaagttaactgtatactgagcttgatgttgcatatgcattgtcttgaacgatttgtctattgcggatttgcggtttgccatatatgaaatggttcttgaatgcatcagaagtctctgtcttttttttcctatgcattgttaggcatcgttcgtttaggggtgataggggagattggctctcgtttttcgcgcgcacgcttttcaaattactaaacggtgcgttttttgcaaaaaatttctatgggaaagttgttttaaaaaatcatattaatccatttttaaaatttaaaatagttaatactcaattaatcatgagctaatggctcacctcgttttgcgtatcttcccaatctcctcaatccccttagtctatggacagcgctacgctgcgcgcgtttattgctagtattattaaggggcgcggattggggcgatggcggcgcgggccacgtcacctctttttcctcccgccgtccgatcaggcgtgggcggctgggattgaggcgcgcggtgtaaattttgcgaaaatcctccggtttatgcgtaattcgatttaagtcccttcggaacagtagctatgaggtgctattttacgtataggcccttacaaaatcctcatattccacgataaggagagaaaaaatcgagaataaggactgtgctgtaaacagtgaaaaccgagggactttttcgcaaaatgtcgcccactaaccccaaaccctagccgccgcccgcatcctctcctccctcccgtctcaccctctccctctccctttccttctcccggcgccgccacctccgcctcacgccgtccccgtctcctcgcgccgccgcctcctcctccgccgccaccgtcgtcatgtcctcgtctccgtctccgcctccgcctcgcgccgccgcacgccgccaccgccgcgagaggagctatcggaagcgccgccccggaggaggaggaagagaggcgagagagcggaggacggagagggatccggcaagatgggagtcctggcgttctaccggtggctggcggaccggtacccgcagacggtgtcggacgcggtggaggaggagcccgtggagctcgagcctggcgccttcgtccccgtcgacctccgccgccccaaccccaacggcctcaagttcgacaacctctacctcgacatgaacggcatcatccacccctgcttccaccccgagggccacgcacgatcctattcccccatcccctctgtcttctcgtcttctaatcaacccattctgtgttcgatctcaccatggatttggactccctctcctgcagccggcaccgaccacttacgacgaggtgttcaagtcgattacttttgcatataagtaaatctttctttgtttttaattcactggtttgattctctggtttttttttttttgggatcatgtttaggttcttgttggatttggtactgatctcgttaggtttcttggcccgttttcaggtgcggctctgaaggggaatttcgtcgaacaagatgaatgcgttgccaggaacttcaagcaggcggccaaactgctgggcctggactccaagctggagaagaacttgctcatcccattcagggagatcaaggtgatgattctagcgcagttttcttgagatatggtagtctgttttctttggcttcacttgctcgaagtagttttctgatgaacatgagagagagtgttgaaagttcttgctgcgaccaggttcaatggagtaaaggattttctttttggtttggagtgccaacaagtctgtggttgattgcaggttgaatgcacagttccgaaagatgatgggactttagcatcttacatgttgggtttagggtttaacatgacaatgttaggggacctatgaagggtggaatcagataccgccatgaggtgagaatattgattgattagtgtgttcttcgtaatacaagctggtgcctagctatgattgagtgaaaatttatattagttgaactcagttttctgggttaataatttctctggtagtacaagcattaagattcaatgaaaacatcagatgctgatcagatttcacctttggatgcaatctatttctaattttctacttctgtgttagtaaaacttatataagttatattaccatttacttgcaacaatctatcaatatcagacctgaaattgttcaagcttgtctcttcagttccagctgcacattttttttgtatgggctttactgatgatgaactccggtcacacaattgtaggatggtgaaaaaaagcctatattctgctgttagacaattcataattaggtaagggaatttggtaaagagtacaatttactctgcaagaaacatagatttatgcttgctaatcccaatagatcatcgagccatcactttcttttacagtagtaacttcgctcaagaaaatgtttgccttttaaaggaaaagggataattttgctctaccaccttgccagggccagagttgtgtgcttgtataggttaaagtcagtttcttttgcaggaaaatgctatgcctttactctctttcctaaaaaatcggttttgggttatgctgttacagtttctttccatatttctttttagatgttggggcctgtgtcccaactgcatgaagatttcatgcagaacatttaaacaagtagcaaagcttctgtctggccatttttagacaagttgatacatcaatgatataattctttctcaatattttgtggttcaggaatttgatattttaggccaccgactgggtcttcgacaccacagaggaccgcgcctgccaaggtgattatcgccttgtttaacctctcagcaaggtggattatttttaatcaatccaaacatggcattgcggtgatttctcgtgggatccatgcgccatccagattatgttgcgcagtagtagagtttgcaagaattatttatttgttaacatatacgcgccaaacaattccacccaaaagccttaatctgtgaaaagaggttgggtaatctactcaatacttaacaactaatatgctgcactgtttatgttaatctgtagcttggatgaatctgatgtaacatattctgagtgcttgggtacagtaattatcactatgtactagacaatacattttgaccatgcgaaggtatgtggaaggtgttatcgctttttttttcttataaaagatatgctggttgttagtgttgccattttgattatgactctacgttgctatttgcatatcagttatcagtggaacttttactttttaaccgttgtactgtaagccacttcaatacaggccatcatatacaactagggagcacgttttcttgtgtgctactgacaaataaaatacaaagtacatttcaatgagatttgtttacagcttataagtgatgttctttgttttacaccatttttagtcatcgtacaaaattaggctgaaattgttcttaatgctattcttttcagcacaaaagtccctgttgctactgtgcatgaagatctttcctctgtggctcctcctcctgtccattgccctcggtgttataaagttaccatttgatatttctggtctgggtaatctcctaatgtaaggtgttagtttgttctattattctattctcgattatacaagctgtggctttaaagaaatagcagtagatatgatatggaccattgaggtcacttccataaacttggatctgggtgtgcaacatttgtcagtacaccattgccctcggtgttataaagttaccatttgatatttctttgatctgatcaaacaaatcttaatccttctttcatagcaccagcactgttgcatcttttgcctaaacatattatgttattacgctgtcacactgttgcttgtcctctatgtattgtccctaacaaattttgctgtaaacatgtcctgtcaatagtcatagccatcactaacaagtgagctacgtatctatttatttcagtacaccaaattatgtgctattatgatgttgcactacaacatcacaattgcacatcctctaactctgctttaatgctctaaatatactctgttaacaaggatatccatcgctattattagctgctaatgaatgaattgtatccaggcggcgcgccccaggctctagtactccgaatttttttcatataataattaataacctcaaagttaaataaatagtaaattcgaatcagtaattagaaaaataggaaggacgttgggagcaacaacgtctcaagtggacgctggagagacgacgtcctttaatggacgctgtaggctagcacgtacatctagctgatcccagcctagcccaagaactcatgctgcaaaggcccaagtaaagttcctccaaacaaaaacgggagaaaaaaatggcttgcctcacctgcgcgtgtgcgtcgtctggagagcgctcacccttctccacttctgtcctcattcgcgcggcaagccggcggcggcgcgacgcccctctcctctgcgcccctatccgtttctgtgcatggttccagcctggtccctaggtgaatcctagcttccgattccctctgctactgccgccgcacaggtataatcgaagaccccttcccctgctgctgccgccgccgccgccgccctccaatccctttctgcaaggccttgcatctccggtgcccttgactgctcctgcccctgttgctatttgattccatattgtaatgcagaaatactagattaatattatttataaattagaatgcaacccagtctattgtgtttatcaaatacagctagataagatggccaccaatgatcggttcagtgatttgttatggatgcctcattgtcagcataaagtttccaaaatatgggatagtgtgagttgctagattttttttctacgttattcgtccattgtgtgtaaaacttcaaacagactgtatggtttgactaattgatgaaatgtatttttacagcctactaattgcattaacatacggcttcatcgtgtcggcattccttaccactcattatgtcagacagctttagagaatcttgggttctttcagattgcacggatgaaggaaatcaataatgataaatatttgatatcagcactggtggagcgctggcgacctaaaaccaacacttttcacttaccagtgggtgagatgacaattacgctacaagatgtaagttgcttatggggtttacctatccatggtagaccaattactggccaagctgatggctcatgggttgatatgattgaacggttgcttggaattcctatggaagaacaacacatgaagcagaaaaaaaggaaaaaagaggatgatatgactatggtgagttactcgcggtactccatcagcttaagcaagttgcgtgaccgctttcgtgtaatgccaaagaacgcaacagaacgtgagattaactggtatactcgagcacttgttcttgatattattgggtccatggtttttactgatacatctggagatggtgtacctgcaatgtacctccaatttatgatgaacttaagtgaacaaacagagtacaattggggggctgctgcactttccatgttatatagacagttaagcatagcatctgagaaggagagagctgaaatatctagacctttattgttactgcagttgtggtcttggtcacgtttgccacttggtcgacctgttaaggcaatgaaaatcacgaaagaaagggaagaagaagatgaacaggaggaattggactattgccttgtatttggagcaaagtggtgtctctcacatgaatttcgtgccccacataatgcgggtactatttctattttgattatatcatatgtcccaattatggttttttttcttggtgtacttgtctacttatcctatagtaatgttatgcaggtactgaatattaccgaagtcaaattaatctgattcgagaaggagtaattgtttggcagtaaccttatggatgaaatgcccatccaaatttgtaatgatcgtgcttggtggtttgctagattgcccctaattcatttctggattgtagagttccactacttagatagggtgatgcgccaatttggtcgtcgatagaacattccacctcatcctccatatggcaaggttgagcaccgcaaactatgtaaaatcaaacatggaggaaaaatgcgcagttgggagatagtacatgctaaatatatacaccaatatgacaatttggaagcagtaatggtccaagaggaccaaccttttgatccagctagcttgccagagtatagacgttgattccaacaaaatggtatgtatagtgttttttcgatgctcagtgcttgggaggtcttgaaaacccaatcccatatccccgggacatatttgaatggacaggctacatgcccagtggtccaccactagcacgaattgtaagttattttgtacaatccatagtaaacttttgctgccattttggttcaaactacaatactcttttttttttctaaatgcagagcttacatgtgataaagaatgctgcttgggggatcaaatgtgcaattactaatagctgtaagaagttaggcaagtcaatactcaagacatgcttgggtaatttgagagatctaaacctagagcctaggttgcaaaatatgctcactgatgctgggttgccaatcaatattgaagatattccgtctgatgatgatctctcagctcatgttcaccacccaagtcctccgaaagactctaattctgatatatttgatgaatgggtgtactcaggaagaggttttgaaagatatctccatgcaggtgggatagctgcaacacaagacctaggccaagtgacacggatagatgagtagagctgtaggtttgagattctttcgatgtgtgagttgctaagatagtggtccatgggttgtaatagtgaaaactacagcttgttaacaacgtgcttgttttagataaattattatactactcctaggttgcagctctaaagttcagtttgtgtcgaattctatgtagtgcatgtgagctctaaatttatgttccatgtgggtgccactatatcaactttttttactcactcactcttactattgcaggcaaatatatgtaatatatatgtaagaacagagatctagatagcccatttggatcgataaacaccaaaaccaaacatcagtgtaatttttctccataagtcgtacaaatataacatatgtgatgctgactcagttccatcaacagttattacaatatctgggcacaagatgctataaagcaaataataacaaaaaggggcacatctgatcgacaatgttgcgtccataaggctggaagttcctggtagttcccaatcagttgtatgttcagcgaaatgatgcacctatgaaataagaaacaatcaattcctgtcggtgttgcatagagcctccatgtgcaactattgtccgtgcattcagccacaattttggatttgctactggtactgtacttcacttcagcattcttttctatgtgaaactcacctatggcaattttcaggtgctcttttgaatcaaaagtcttcccccttgctagtggactatcaaattgcttcttatgcccaaagaaactctcatctgcaattgtttcctttagtacataaatatcactaaaagcctttatgggatttttgcctgttgcatgcataaatggaaatgaattgatagaatgaacaacaggctgtggttcaggatgctcatcatctgtgctatggtctgtggatccgtcagtatcatgctcgctgtcgtcatcttgttcaattctgtcctctgcaaggtccgtctcctccccaacataatcatcttctgcaattttttgttgcatctgaaatatgtgctggcattatggattccatattaccttgagaggcaacttgtgctggatggattgttctgtgctgcaaataaacatttgtgtcattcctttcagtttgtctgcttgattctgtaatttgactcaaaactacttgggctggtttacagtccacatataactcaataatatgccaacttgcgcgtgtctgtgtcttttcaaatatcatcttccatcctctttcttcataaatcggaattagttggaaataatgtggcccaggagccccgatatcaaatcgagcttggatactaatgatatagtcatcctcagtgtatccgagtcctctgaaaatttcattcttgacgtcttcaaaagtgctacggttagatgttggaaaagttattttcggaggaatagtatattccggacctgtaattccattttggatactcccatccacatatgctagaacaatgatagtcattttctatcagttactcctgcgagggaaaataataaatcagcaattttagttttacgaaatctattacttagttcataataatttacatcaattagaagctacgttgcagaaaacacttttacatctaataagttagtctaatttaagattaggaacgataagaccaagataaaaacaataatacatgcagagagggtgtgtacaacaacaatagtatattatccagatcagttagggcatgcacctgttgcctcatggtgagctgccctacggctgccactcgcacttgtagacgaacaatgcaaacagagtgttcgtgatttgtcgtgagtagtatctacgacgccacactaagacggcgagaggcggcgtgacctgacgcgacgagagcggcgcagtcgcgcggctcccgactcccagggttcaggacgtcgtgctgattgccgacgattgctgcgtgtgatgctgggccgattcacgtggtggatgctgtcaacgacaacgtccatcagtggacgtagttcctcccagcgtccatttgtggacgttgttgtctgtagcgtccttcctatttttctaattactgattcgaatttactatttatttaactttgaggttattaattattatataaaaaaattcggtctagtactagttaaaagcctgtgtgatgcagcatattttcttagaaagaaaaatacaaatttgagttgtttcagtatatatagtaattttttcttcaaagggattcagtatagtaagttgattacactcataataataaacaaaatataacttttatgattttcacaatatacatgcatggattattcacatgacctctaaactttgcactgttcaaatcattcccactatttatgggtgagcggatggttagcagtagttattagcagttatcaaatgaatgattggccaataattaccagcgcagtaactgttttttcatttcaaacaaatcaatttttataaatcatttcaaacaaatcattccggagagggaataaaaaacaagagaggagatgttttcgtggcctccgcggctccacgcaccccacccggtcagctcagctcgacttgatccatcactgcccgtttcttagaaatctggtactgataatataagtgccagttattaaaaaacatactgatgaagatttgatatgtgcg

SEQ ID NO: 70780 - DNA, 692 bp, Oryza sativa
ccctttgaatcaaaggatttatataggaatttcataggattcaaatcctatagaaaattttcctatttggccctttgattcaaaggattgaagctttctaaatcctatgaaattcctatggaatggcacattgcatgtggattttggaggaaatttagcaagagctccaacctcttggaaaatttcctttgagtctatctctctcatctgattcctgcgtttttcctgcgctccaatcaaatgatcattcctgtgtttttcctgtgttttacaatcctctgttttacacttcaattcctgtcagaatcctgtgtttttcctattcctccgttttttctaccctgcgattcaaaggggccctaagtatattgttctgaactaattcctgtagcactattaacctaccgcttattaagtctcactatttataagatgtcttgtgtttgtttctttacgtctcttaaggatgaggtataacttgtataatatatttaataacagtcattgctctttcagtattcatccaaatattgccctctgtctatcttactacattaaatgactattttttttaagttcaaatttattagcatgtcaagcgttgagtacctaataatagtcactggcatgccagattttaacagatgcagctctgctgaagaggcaaaagcaggaaatagaagaacttcgca

SEQ ID NO: 70781 - DNA, 654 bp, Oryza sativa
ggttgttcaggcatgatataaaccactggtggcctcacactgtgtgaccactaactgacaacagaatcactatggagtaagcataacaaacctgacagattactgtggagtaagtgcatatggtccaccctaaatttcaactatgggttatataagacttaaaagtgatcatgtggtccactctgaaatttcagagtggctgaatttgtactcttaagtcttaacacacaatcctcaatcatgacatctgtgtctaggcagcaaatttaaagagtctgacaaaatttaggctcacatagtgttgatttcacaaagatcaatgtacctgttttactgttcacaatcctggcacatatcttcctcaccatagctagacataaaaatcctaaaactgaagttgaattccaggtctatcgcgcggtacttatcgcgagacttgccatatgagctatcagctgatgatgtgtacctgacaagtggctgtgctcaagcgattgagatcatctgctctgtcctagctcgccctggtgccaacatcttgtgcccaaggccagggtacctgttccacgaggcacgcgcagtgttcaatggcatggaggtcaggtactttgatcttctccaagagagtggctgggaggttgatcttgatggagt

SEQ ID NO: 70782 - DNA, 1237 bp, Oryza sativa
tggttgtgagacatgtgaattttggtgggatagtgatggtgaattgagaaataaactccctccttttcaatacctgggcaggggtggtaattgggagggaattcctcctttacttcgcataaacaaatctcagccatccattttcattaataatctaatctccaactaatctctctatcaatttccaccacctctaccaaacaagagactgggatgaaaaatcaaattcccatcttaatctcaccatcaattccttcgtgtaaactcccaatccccttccctcgagttgccaaacaagccgtccaaagctatcgagagatgagcaggagcgaaccacaatgacgcaacacatatatctattcgtgtcacaaactttacatttcataccacttaaaaaagtattaatatgattttttaagcaactttttatagaaagtttttttaaatatatacaatatttagcaattcgggaaacgtgtgtttagaaaataatattcttttttcttctctttgttcaactctcaaaccgcctaaaacttctctctccgtatcacgatcgccagatatatcacacgtcatgcgtggattctacacgtggagagccacgtcagcgctgatgcaagcgcttatgtcgtcgtacgtgctagctcttggcatatatcgatcgtcgtcaattaattatcatatgaattctggctctcgatcgatttagtggcaactactccaaagcgagctagtcaaataatcaagtcaaatctgccctctttgatgatgtaactccggattgtctctctgccattgcttgtcgatttgcaggttaatgaaacaaactattctaatttggctttgttcatgtttttgaacaaacaaagaaagtctgtctttgcttattgctggaagtatcactcgatccgttttcaaatatctatcgttgttgtatattattgtttcaattttgacggtaaattattcttaaatggttagattagactaacaggaattccatgcttacattaggaatccaatacgctgaaaatatgatacccattttacaagacgttttgatctctttatccttcatccttaaacacatatataaatccatgcatgaatttattcaaatcctaaagcgtatttgtaacttgaatcagagaaagtatctttttaggtgtttgcaaatcttttttttttttttaaaaaaagacgagcagttaaagtttaaagaggggatcctcta

SEQ ID NO: 70783 - DNA, 7073 bp, Oryza sativa
ggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcattcgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggtgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgctgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgatgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctcaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggccccc

SEQ ID NO: 70784 - DNA, 641 bp, Oryza sativa
ttgccttgaattccttctttgaccttttccttgacattgtccaggcagaagattcagtatcttgtttttgttcatcatcactggagtgttcatcagctggtgaccttcggttttttccagacacaaactggtggctcaagcgtctctatacaagtaaagaaatatcatgagtggatcatgcgagttgacatataagctattgaaataacaatcatagagaaaccaatgcaggcaagtacaatagcaaaaatatgaagatgagcgaatagaacaatgtgtaattgactgctgaaacatgtattcaggtaactgtaaacaaaatatgtcatggctgcgcattcatggccaacaaacagttctctggcctctatgtgttttctttctttggctctaatcattacaacgatataagcttttcacattcctccaaggcatgcgatcccattttttcctgttaaatgcagctttctttttccccccttatcccatgtttagcatgattccattttttgtgttttttctgttgtttgaccatgggcccactgcgacaaattttaggtcattgtaggggaatatctctggttcctttttaggaaaaggaagcattttatttctggtagaaagttttagtattttaaaaa

SEQ ID NO: 70785 - DNA, 1531 bp, Oryza sativa
tgctcgtgcatccacagcgcggcggcgtagaacccctccttgttggacttgccggtgccgcgcacgccgcggaggttgcagacgagcttgagcgcggtgagcgggtcgtgcgcccacgcggcggcgacgaggccgcggacgcggtcggcgggcgtgtcggggacgacctggaagaagaggtcgaggcaggggttgccagagttggcgtaggtggcggagtcgttctcggtgcgggccttccgcggcgtcgccttcgtcttcgatccgaaggcagcgggaggaccaggaggaggggggttgaagttggcgtcgagtagctggaggaaggggtgggaggcggcgtcggcggcatcgtgcggcggccgcgcggctcggatcaccggagggccgaggaggcgggcggcggcgacggtggcggcggaatccatggaggcgatcgttaaaacttcaggagctaggcgagactgcgagaagggatcgctctggatttccgatctatataggccatggccttcttatttgggccgcaacgggaggcccatgaagatttccttccttatcctgtgccgttgattcgtaccgacatagtggttggacggatgagatggatttgaaccgacattagtgatttgaattgaaccgacctgattatgcatctagtctgggtttcatgcgagtcgtgctcgccacgcacgcatcgcgcatctgcaggcgggcgaggcggccataataatatccacataggaaaacttggggtagtttaagattaaacttaattttgcaataaatgttacattaatgtgcgattaactctttcttacactatatatatgcaacgtgtacattaattttgcaataaaacaaggagaactaaattattggtagtgttaaaccttagataagttttagcactaccaatgttctggtaatgtagtatcaattgtaatagcttggtaaaaattggtaacaatgtaaatgcatagtagcatgtattattcaaagttaccaaatatttggcaagacaagttttggtatgcaaccaaaaaaatagccctatataattcatacattcatacacacattttttttgcagaagaaaaaaaaagagcagataaaaacaaggacacaaccgtataactgtacaaaacacgttgtgcgcaagatatgatgcacaaagtctacaatgcgtgtaaggctaaaggctagatatttgggccgggctcaatgcaaggcccatagaaaaaaatgccttccttaattgtaggctcggctatggcaattagggcggcgtaaatccagatcttactccgttgatttgaaccgacatagtgattggacggacgagatggctcgaaagtcgtgcatgcgagccgtacgtgcttgccacgccatcgcatccggaggcggcgccgcggcggccataaatctcaactaatcgatctctctccttcgcctaatctgctcccttcctccgattcaaaaaaaaaaaaaatccaccgaaacctcgccaccctccgccggcgccgccatg

SEQ ID NO: 70786 - DNA, 8361 bp, Oryza sativa
gcagatgtgctctcaaataaattgaaatgtaaatgcaggaaagaagagtcaccatacaacagtagaatgaaagaaaatctcaagcatgaattgtgtggcaaactggcaatacgtcattgatccattttcataaaacgtacacagcaattgccatcatcattgtcaacgcattcattaccaataccaccagccagcaagacaacatagttttgcaaaatagcaaatctcatatcggcaggccagttcaatctattttctacttatgcttagatcccaaagaacataaataacgtatgttaatacaggatcacgggaacaagcacagtttgcgaaacaagatacttggtcaaccaaaatttaatggattgcagggcagctgagctcgcattgatcaccgcatcttgtagtgttgtgttcttgacacttggcatctatgcccacttagggcgtagcagagcttaatgtcaatatctcggggattctttttattcggtgtaacagtcatactgcctgtgatggtttccccctcacagatggtcagtacatcctccaggtacagaacagtttgcttccagtgagtggcttttgatcttgggcctgcatcaattaaattatacaagaattacaacacagcatgaagaaaagaaaatagatgggcgtaatttggatggttagttgagaagagaatgaacctgttgagaagcccatcatcttatggcatttggtgaaggacacattgaaataggcaacaagagcatggatatagtcattacgctctgctactaactaaatggtactggaaaggacgcatctccaggtgtcattttggaaatatccattgtctgaaataaatatattggaagaagatttagtctaaaatatcacctgaacaaataattgctaagcaaatttaacttgtttcaaagcgttggtaccttcagtaactggcagttagtgacaatctgatttgcatccaccgtatctacaagtggctccatcattgcctgtttcttgatacagcgcatatcaaagccatacacattattccaaactgcaagatatagaacaatgccatcagaaagaattctaataacccagaaagaaacaaataacacacagaacttctgaagcaaaatggattcatggctaatagtcatttgccgttttcctcatgcactacatacattcaattttgtcttctttgtattctgcatcttcgattgcagtaagatgcaaagaagctttgtcaggtaggacaacaccaccatcagcctgcatgacattaacataatatacaagttatatatccccaaaattttaaatattgtccatagaacaaacaaaccaagtttagttttcatagcctacaaaactggcaaacaccatgaacattaatggtaaataagcacttacaagccatttatcacgtgcatatagaacagtgttcagcatattctcgaacaggaggaaatagcccatccattcggagattattacatctacttttgggacaggaagctcaatttcttccactttcccttttattaccgttataactgtgaagatagaaatgatattaacaacttctcaaagtcaaacaagcatgatactgaatggtcatcatagatgatagtaagatagaaaggaaatcaccattagaatatccatttgttttcacaatttcctttgccatatctgccatttgagaacactcaatctgtaaatggaagaacaggtatatcaagtttgaggaaaaaacaatatttgataagaacaggtaatgcgaaataatcctaacaaactactatatatgtaacttgaaatcctaaacaccatgggaactatacaggacaccaacagtttggataatcagcatccaaaaagaacactcattttaagttgttagcgaagagcacaataacagtccaacagataagcttgtatcagcttgcaaagagtcgttaaagtctgatacatgtgaataaaatagtagccttcctgctcttcccaaattctattatattccatgtaatagatagatgggaggaaactacaacatgccgaactagattctaaagttgtggcctcatcaaatagtgaagcagcaaatggctaacagtcttagattaaagaacaagaatgggatcatcaaaatagcttatttagtacaacaaaactatcacagcattaaaatgaaaacataaaagtatgttagaaaactaaccgcatagacatgcttagcccctgcttttgcacagaaaagtgagaggatcccagtcccagcaccaacatcaaggactattttgtccttgaaaagaaagctgttctgggtgataacattttgatatgattttgtccgaaccacatcttttagcatttcctgcaatcagcacgataaagtaattggcatctcgacaacacttggtttgcacatttagatgcataaatcatctgcctaaagttaatgtgcacaaaaaaatcggatgaaaactggtttcttgtgaactgtggtgcaacaaaggaggctgatttcttccagattcacttacttcatgaatacctgcaagacaagtacacctcataaagttactgcgcaaaacagagcaggagcattataaactgcgcaaggtaataaattacacaataactttaggcaaaaccggagcacacagtatcaatgaaaatctcaagacctgtacagatcaaaagctaaaattattcagcagtgcaaagtgaaaatcccaaaagaccaactgaatctcaaaaaacctatgttcaattgcagtcctgataaatcaacaacagaagtacaaaaccaactaaataccaatctgtcatacaaccaccattgccaaaaaacaaaaatgaattgttaccacccaacctgctactaaatgaatgatgcgggtgcacttaacggctaacacgcaaaaaaccttcaatctttcacagcattactgtcaagaacaaccaaaatataatatctcaatccaagtaacaacactacatatgaatatacgttatattttaggccgcacaaattcgcaccagatatcgaaccttccccctaacaactaaaacagcacaaaaatctaaaaacttcattgctctattaattagcattatcatcacccaaaaaagaaaatctgcggaacagtacagcatctccaagaaaccggatcgagcgcgagcgccgcttaccgaagtgggagtaggagtcgaagtagtagtcggcgctggtcttgtcgctgccgatcacctcctcccctcctcctccctctcccccttcctcctccgccccgacggtggcggcggcggcggcggggttctcctccatgacctcgtcggggtcctcgaacctcagcctcgacgccgtcgcctccgccaggccgccgttggcgtcgctgccgctgcccttgcgctgatccatcgctgggactgggaggggtttggggtgattggctggcgcgccgcaaagcaggggaaggagaaagctagggttttggagagggagacgagggagggagagaggttttatagcatccgtggcataaatatcaagtccctcaatccactcctactaggacacaacaattaccttgatgttcatgactttaggtttgggggattattttagggttatttaattaagttttaagttgaggtttttttaccggaaatattttaatttatatttttattgcaaaattttccatttaaattcactactactaggacacaacaaaaatagcctgatgttcatgactttaggttgggggattatttcagggttatttaattaagtttcaatttgaagttttttttaccggaaatatttcaatttatgtttttattgcaaaagttttttcatttaaatattttgtttgaaaacaagaaatagtttccatttaagtatttttattgaaatatttcaatttatatttggactagaaaaatgcctgtgcgttacgacgggtgagctattttaatcttattctattgttataaggtttaattaaggtgaaatttaccgtgggaatttgtttgaaatcatgagctgtaattagattccatttaagtatttttattgaaatatttcaatttatatttggattggttttctactaaattgatgtccttaaagcttcgttttatgagattgtcgatttaatgccaatgttatcaagtaaaggtaaataaaaattcttgcattgagaacataaaatttcaagtttacaatttgtaaaatatggatttagactcctatgcatttttttaataatgttgttcctcgcaaattttataatataataataacagtgaacacaaaaataaattgtatcgcactctaataaataaataaatcatcaacaatacatgaatatcttaaaaaggaaatttgaaccctaaatatttcatttgtaaattaatttctattctattcaaaaggcccaggttttcaaaaaagcaaatatagagctttccccttcgcctccgcgccgccgccgcctctgtccgttccgccgtggtttgcgccgcccgtccgccgccgccggcggccgtactccgtgtagcctactcgtcgctgctcgagctgaaagcccagggtcagggagggtggtgcccacagctacgcacaaacaatggagggcaaagagaccaagaacaccgtcgctgccgctgcctcctcctcccctctcttctccttctccaactccaacgcttccttcggcttcggcttcggcttcagcgcgtcatccggacctcctccgccgccgccgccgccagccgtcgaggtgctcctctccgaggtatatctcgcccgctttcctttttttttcttcttcttcttcttcttcttttgtgggcttatcctactacgtatttaccgggttactttgatgcgagattcggtcgtttcttggttgaattgcaggaatcgcccgtcgcggccggcgaattggagcctgtggtgattgatgactccctgtcgatttacaaggtgcgtctgcagaaatgcttacattgtgtttgtggaaatgcctctgtggccgcggcaagactctgcagtgctactgattctattaggctgctaatagttatctagtatcttagaatgataaatgcaattattactttactaaccatacaactcatgctgtcgagaatgttctgtttatcattgaacatcgcgcgttgggactgctgctgagtgagaaaattatgagattattatagctgtccatcatgttcagtatatgcttcaccaatggaaacaataacagaggaaaccggatgtaatcatgtaaacattgaggaatattcttatcctccctcccctctgcctaaaaccaaacaaaaatgaagaacatttgttagcactgaaatggttctctcagctatttgttgaatcctcccttggtaagtcatatgctcagagcgcatggtgacattccacacacccacgtttggtgcaaacataatgttcactcggtcatcgctgttccaataacttctagggaacttacaataaatttctctagttgttctgctgcatgctacaggtcattgttacatcctcccacaaattcaacttaatctatcttttttgccttactgttttaggggagagcaagtacttctgatgtttttggagtcaaaaactctgatttagtcccagggaaatatgaaggtcaggactgaatacattttgatccttgtaacgtatttcttactgtttgtctttgtaagcttggaaatatatgtgtgcactaggtgggttgaagctctgggaaggttcactagacttggtgaagactttaaactcagacatcaaagaagaccgattgcttttagaaggcaaacgtgtattggaggtgagatacttcacgcctaaaaatattttgagtagaactgtgttgtgttttgatagttaaagtaataacaaaagaaataagactttacaagagtcataacagaataaggtatatccagaatgagttttttctttttggaaagcgaggtatgtccacaaccacattgactctttaagaaaaagctttatcacattctattttccacttgctttttcaactgtttatgttgaagtcactaataccaggttttcgaggttcaatctctctcgatagttagtaacagcctgtagtggaatatctaaataattaagtccttcagtttgatacaagtagctgtaatctcagaagatgtacccaacttgctgcttacagttatccatctctgtgattctgtagctaggatgtggacatggcctccctggtatctatgctattcttaaggtatttatctatattcccctgtgaaattttgtaaatgactccttaactctattgatttctcaaaagctaaaactatcagggtgctgttctagtccacttccaagatttcaatgctgaggtccttagatgccttaccataccaaatgtaaaggctaatctattgaaggaatcatctgaagaaaagtttacatctggtagtgttggtttctttgctggtgactggagcgaaattgacagtctgcttcttcgtggagatgctgacctggataaatcaaccaacagtcatgaaaacgatacagcgtataatggctatgatatcatccttatggctgagactgtctatgcagtatcttccctccctaatctctacaggctcatcaagaaggtcagcatccacaacattcattttgctgatatttttcttttcacttgaatttttcatgtttattatagtttacttaccaaaaatactttgcagtgcctgcgctaccctggaggtatagtttacatggcgggtaaaaagcattacttcggagtaggtggtggcacaaggcactttgttcgcttggttacagaagatggtaaatttatttctagttttttagtcattgagttatttatccatgtacctccataatattactcctgatgacatgcttgtttgcaaactttgaattagcaagattggagcaatacctactttttatgttgcatgaatgttaaacattttcctctgtgaaacactaaatgttatttcttttaagcttatataccaagatagcgtccattgtatgagttatgtttttgtttctttaaaggcagacatcagttgcagatgttttaaatgaatgaatttagcactctttttgaggatatgtgcattgaactatgcatatgcatatgcttaacatatcacatgccaaagctatagactagttattaacgcattgtgctaaaattcaaaatttttttggatactttatgtgtgtattacagttgcatgtcatttggtatttatgcagattttcactgttattttgttgtcatttaggggccatgcagtccgacctacttgctgaagttgctgatggatcatcgaatgttcgggaggtttggaaattatcgttcaaatagactagtattctgcttgtgatcgttgaagaaaccacaaacatgtactggctccatattggtcgagtggaagccttagtttaggtgtttcttgttctattaatgtactgggtcagttctgagataattgctacctcttttcagaggtcttatattgaatacaggaacatccttttactctttgaaaaactcatctaagtaagttttactgagatcttgatagttaccactggattgcatctcttccacttatccccttctctctgtcattatgaggtttacatcgtcttctcttgtactctcatatttgctctgacaaagctaacacttttttaattactctttgcaaagattctgtgtaattccaatggcagacagaactgattcactgacaactgacacagtgacaagtcagcagattaaggaacaagaaacaaaactgtacccccgaaaacatcaccttccttatttccagatgaaatcattcatgccatgctgtcatgcaatgcagccaggaaatttctccagtaattacaagatggggatgttctccgacaaatgataagggagcagctgtgaatgcatgaggaagggacatggatgtgaaaggtcaggggtagtcccatgtggcataaggaatcaaacattagagcaatccttgtccttttcttcatgtttcattgttgctaatgtttgtaccacattggggtcattccatgtgcaccatactgttcatccctccatatgatctgcattcatcttgcagtgttatatatatctttgtctgtcagctaaactcaccttgagcttacaatgatgggcttgcaggaatccagcatcggtggtcggacggccagcttcttccactaccagaggctggaatgccgggatgacggtggcccgccgcggccat

SEQ ID NO: 70787 - DNA, 44636 bp, Oryza sativa
cgtctaccgcgtcctccacgggccccgcgacgaacacaaggaggaggaggaggagggcgatgaccagaccgagtccgaggatggccgccgccgccgcccccgcctccgcttcaagcgccgctgcatcgaccatgccgaggcggcgaaggccaggctgcagaaggaggcgcagctcgcgcagtccgtgctctcgcggtacggctcggacgtcagcttccgcttcctctacgacggcgtcgccgacacgttcgccgagctgctcaagtccgacgtcgagcacatgcgcgccggcgagaacgccaagatcgggctcgcggccaagtggtgcccgtctctccgctcgtcgtacgaccgggcgaccctgctctgcgaggccatcgcccgccgcatgttcccgcgcgagtcgagccaggagtacctcttcctctccgacgagcactacgcctaccgcgtccgcaaccggctccggcgcgaggtgctcgtgcccctgcgcaaggtcctcgagctcccggaggtgtacatgaccgcgggcaagtgggaacagatgccctacgcgcgcgtgccgtccgtggcgatgcggcagtacaagggggcgttcgagaagcacgacaagtcgggcgtcgcaggcttcctggacgaggtgcgcaccgggcacgcgcggctgcatgtcggcgccgcaatgccgcacgagctggtggccgctgcactcaagggcgagcacgacgaggccgccgagctccagtggcgccgcatggtgtccgcgctggcggcgggcgggcggctgagcaactgcatcgcggtgtgcgggctgtcgtcgggaggcgacgtggcgaagccaccgggcgcggcggccgtcgcgctggggctgctgatctcggagctgagccaggatccatggaaggggcgggtgatcaccttcgacgcgacgcagcagctgcacaaggtgtgcggcgcgacgctggtggagaagctccggtcgctggcggcgcccgtgcgcgccgcccccaagggcagcagcctgaacctgcagggcgtgttcgaccgcatcctgaccgtcgcgacctacggcgggctggccaaggacatgatggtgaggagggtgttcgtgctgagcgacatggagctgaacgccagcgcgtggcgggtgcaggacgagctgaaaaccatcaggtccaagttcacggcggaggggttcacggcgccggaggtggtgttctggaacgtgggcgcgccggcgtcggcgccggtggtggctaccgaggcgaacgcggcggtggtgagcggctactccaagaacctggtgaggctcttcctggagtgggacggccaactcacgccggccgccgtcatggctgatgccatctccggcccggagtacgactcgctcgaggtggtggactgaccgaatccatcctctgcttccgtatgataagagacgatcagtagtagcttgtgtgagtgagatctagtgagtgttttctgcactttgaatggaatgagtttgctggatgcttaatttggttgatctaatgaatgaaatctagtgagatatcacgccttggctgatttctcccactcttttctttgattttcgaactgattaaattagtagaatcatccctggcgtaatgtgattgcacgtttcttgattttctgtttcgattaggagttgcatgggcagcttaattcccagctcacactaatcaacatacattggcgcaacatgttatgttatcataagctcatacgccttcgatctaagcagtaattttttaagatgctcaaaatgatcaatagaaaactaattggttcaagatgccccaaagaaaacgaattgtaaatttgtaattggcaatccactccagaaaaatacatgttaaagtgccatatgcgttgaattcgagcaggctagccgaatatgcgttgaattcgagcaggctagccgagcaataaaaatgtaaagcgaaattaaagtaaaagacaacaacataaactgataaacatggatacttagggtattctcaacccaatgattaggatagacataaatgaatatgtcttgtatgagacatggtttctacacaacatccaagatattatgtgagataagtagcattaaaacattatgtgagataaatagcattaaatttaagtatgaaatagtagtgtttgcattagaagagtagtgtctagtattagtttcttgatgatatagagtttatggaaactatatctagtgtcttgggttgggaatgcccttagaactatttcagtttgagcacatcccctgttccattggaaggatccatgatgatgcaccaacaggatttaatttgtgtgtactagttatagaatactagtgattgtgcagtaattagcactacaaatatttgtgtataaatatttgggatacagttagctctactttcttttctcaagcttaattcattcagtccagatccgcgcagcatgttagaccgcaaacctctactctcttttctcaagcttaacgcatgttaaaccgcgaggtcgagctattggagtttcactattggggatctcaatctgactgcgaaacagggaaatcttttatagtagtagctagcaaaagaactaggtgaaacggtatctatatacagtactaatacgaacatctctgaatattctcacgctagctttacacttgaactgggaagccaaaattctggaacgcccaatccgcaagctgaccggagctgaacatccaaagctccgatgcaaaagtcggatgagcacttgagcagtgacccggactgctcttggcagacgattgtttctcgtcaattttcgaatttcaaagcctctaattcccctgttttgcagaatctcttcaaatttcaatcaataaaacagaattcaatcaatggtattcctgccgcagatcggcagatggtggcctttcgagcacggctcataagttgggccggtaacgggttccccggtatccgattagggcccacctcgaacaaacagacacggctgaatgtggcccaaccacacagctccaaagtggtagcatcatcgctacaacaaagcccaggcaaataaagccagttccaaagtgataatctctcatgtgatgcggcatacccaagaattattatatggaccaaagctcttagtgctgccataactaattatggttgtgtttgagagaagaggattggagaagattgagatgcaaaagagataaatcattatagcataattaattgagtattaattattttaaatttaaaaaataaattaatatgatttttaagcaactttaaaattttgttaaaaatataccattagtagtttgggagacatgtgcaccctctctttgctcacttgaatgttgcctaatctcaatgtactactccctccatctaaaagtttaagccatatttattttatcagcaagactaaaaagtaattaattcatccgtcatgtgataaaaccaaacaactatacaaatgcatgcatgtaactaatgagtactaagatgacagatgacttcttggattccggtcaaacaatttaatttagcatatagtgactacaaatgtaccttagacttttataaaaatcagaaaataaaatatgccttacatttttaaatggatggagtattagggcccctgaagaaaaaacataggaattttagaggttttcaatcctatagaaataattcctatggaaggataatcctatagagattttggagaaaacttagcaagagctcagagctcttggaaaattcctttgaatctctctctcatccgattcatgtatttttcctagggccaatcaaatggtcattcctatgttttgcaattctccattttatgcttccatttctattagaatcatgtgttttcatatttctttgttttttctcattccagtgattctaacggtccttaagctttgcttaattaatttgttctaactgtttcagctttaacactcttaggtcccttttgattcataggaaagttagatgatttttggaggattttattcttatggattttttcctagatgatcctttgagtcaaatgaatagataaaattgaatcctatgaaattcatataaaataactaataccatgtaagttttggaaaaaaaaaatctaacatgaggtttaactttcctttgagtctttatctcttatctaatttctgtgtttcacaatcttattaaaatcttacgttttctcggtcctacggattcaaagtgtcccttacgcgtatgccttaccgtaatcagccagctctttactgtactacgtgtataccagcgacaccggccttaattttgtcctgtagctgcccatccaccacccagatcagatgtccctgcacgtacggacggacggccggattgtcccttaaggcgacgctgcggcggatctcggccgtccgtgcgtccgtccgcttcgcctcgcaccaaaccaattttctcctccaccaccgtcagctgcgggccgtacgtgcggccgctgcgcctcactccatccgtaccgcctctgctttgtttttcatggaggaggctgataattaactactaatcaacaaatcaactaaaagtactttatatgtaaattttatatcaattggtttaaaagctaaggcagaagaagaaaaaaagctaaaatcaacaatgaaattaacttttacaaattaaattttggctgcagctaatataaaatggttgagtacagactgaccgttgagtacttcttggcccatctaattcaatggaacgaaatttcaaaattgaatctactttatttagttgaattaggtgggtaaaatatatgtcatgtttaaagtatatttagtgataaaacaaatcacaataaaataaataatacatgcgtagttttccttaataaaagaaaaggtcaaataacatatctaaaagctaacagggtcatatatttagaaaatagaggtagtatatgggaactgaggatcttgttagataatgcatatgcatggaatggacaattggtatcccaagataactgtcttaaattctccttgtggccaaaagaggctcaccggcggccattggtcaaaagcctaaaggatcagtcgcttgagcatcaaggttcagggttgtgatcattccttgctaatactcatctcttacataaaacaaatcaaacgccggtccatcatgatgatgatgatttgatcctcaattcttttaatcttactggtctaacaacctgtcaacctgttaccgattcttatcataccatgtctgaatgtccgatgcctgttctcaatttctcattatgaactttgcaggaacaatatgtactgtcctgtttccttttgagattagggaaaaattgagattactaaacatcggttgtttcagctccactgcaacctgtccttaactccttattgagagttcagatcatgaactcagatagacagacatctttgctgaatcttctcaagttctgaagaaaatggaaggcttggctaccaaatggatcctggtctcctggaaagaactgcagcaaactcactctcacgaaaggaccttcttccttgtccccttctacatctgctactgcaccttctctctctcacaaaatcaccagtgctgctggatcttgctcatgtccatttttactgctgcctaaaagaaaaataaaaggacatggttgcagctgctactgccatttggagctctgctgctattcattttgcagtagatggatgcatcgattaacagacaggcacaaagtacagaacttgggagttttgatttatttatttattttagttttgaaatgggaaagaacacagataagggattcgaaattcaaatcctctagtataacatattattctgtcactctcaatgatatatagacaatcatagaaatttcaccttaataaaccaaaccacccacctgataattaaatattattgttcaaaaaactttggaagtttttgtttgcatggatgtgctatactttgtgccatacaattttggtttcaagaaaatgatctccctacaataacgagcaaattgtgagtgttttttatttcttaaataatggatagaaatccgacatctacattcatacgcggatatacacagccagcgtctttagggagaaagatataccttggccaactatattggtttatccaggaaggagaaggtggttgcagaagctaaaagcagctagtagtactatagagagagagagagagagagggctggtgttagtttggttgagtaaagtggccacacatctagatctaaagcagtagcttctaattaacacaatgtttattgggtggaatcatgtggagttactgttgcaattgcttgctttctagtgctcctatagctgtacaaagcaggcccgaaggcaaagcctcatagcttctctatgatctaacttgtgcctcttcttccaacactctcttaacaaaaagggggtgcaaatgcatatctaaattaaaactaccaacaaattgtccagaattcggtttatataccaccaaaaggtgcactaatactaccactattgccattcacttttttgtccatgatatttagaatgaattcttttagtaaatttggcaaatataaacttgcagtatcaccattggctgtttttgtccataattactcctatttaggaagagttttctaatatataaaggggacaattataaactacttgggcacacagctattgacaggctgcacatatatacttggcgcatattgggtccaaatttgattgattttgacaaaaatggctatacacagacacacactcactacatatggacaaaatcaacttatgtcactaaacccatttgaaataaataatgttgaagttagttctgaagattgtccaagaacgatatacataattttctttctccatcctacactacaaaaaaaaaggattccatacattacagccttgctgcacctgacacagcacgaaaagaaaataaaaacccttacagataattggcatgacaatggcacagtaaatgcaagtaaatgggtgtagaaaaatggagtgaaatgtcctttgcagctgtatcttctgatatttacctctccatgcagtaagtacccagctggcttttattacctgaagaaatgtgggtatatatatagccagccgttgggggaaagaatttactcctgcaacgtttccattcttgtggaggaattcattaagaaacatttaccacaagcccagagagaatccgaggttaaattactcacttgcaggtgtacgttctctggccctttgacttcactgctgctgctgccatttcatcttagtccctttgcatcattcattctgaaatccaagtatgcgtcccagaattctgtccctggcgatgttcagatatcatatcacacagcatattaataaacattataattcttttatcacatatatagtataggttgtgcagtgtagattaagaacatagattggcatgttagattctactactgcattcaggtgaaaaagtttgagactgaagaatgagaaagaaagttcagtaatcagtaataactactaccattgttgtcttatcagctgcagccaaagttttacataccattttagagttgattttgagggattcatttttcaagattagcttttaaacggcgaataataaagatataaaagttttacctataaattatttccgttgcttcgtttatttttctacggcttatatagatgaaccaaccagacaaaaatgagcaattctacggttcttgagaatgtatcatgaggtatcaaaaatttagtataaaatttggtacctagttaccatgaggtaccaaatttagagcattgctaccgtccagcagatggtactgaggggtaccagtaactcccggtactgaagtaaatcggtccatccatcgcgatggggtaggatcggaaataagcgaaagatcacgagcccatcacgtgaccccaattttataatagaaaaagtggtaccttatggtaactcctcaaggaccgtaaaattgcaagacaaaaataagtgaggaaactgaagttgcagacagatcgacataacagaacacgtcttcagaatcctcaactctcgcatcgcatcacctctttctctcctaggataaagcggcatattgctgacctgttcctgaggcaacggcacagaccttaacaacccatgtgacctatgcgaggtgagcttttcaggtattcattctctctcattcactctgtctctctacctatctctgtcttgatcaaggcccttctctttctgctctttcagagacaaggccatgtttgctgaactgaatcctgaaaataactgcatgagcttttgatgctatggaattccaagtagctaccacctgtcagtcatttggcaagttttgcccaagtgtgactaaaatggtctgtaaaactgtttcaaatttggattttagttaaacaagttggtgagaaacatctgcttaattagcttcagtctgaagagtgccataatgcaggagcacagtgtttcatcagaaaaagaaaggactgcactttgatggtgttaactgtagactgacaggcaatgtgtatgtatggcactgtttgtgacttgtaaaccagaagatgtggactgaccaatgtaacagaagacaaaaggccctgagaaagcaatacttggagcctaaccctgccatgatccatgaactgcatgttcttgtaactgcaaacttggatttttgcccggttttttcgtcatgatacgacgtttcgttgtatagataaaacctggaggagtgacaattcttttaagtagtttgtatggatgaacatgaacaaatgaacagttaaaatttggacccaaggtattaaaatcctgaaaagttaatatggtaaaaaggaggttaaaaccatgtcatgtcctgatcaacagaagattctccctgtctgttctctccccaacactggggcagcacggccaaaattacactcacgatcagagctattttctttgaataattgtggattaacagacaggtgtccagtccagcccagagttgatatagtttaattagtaaatcacgtacggaaaaaatttcaaacttgttaggatttcatatgccagaattaacaattatggggttacctgaattgtaagaatgctgctagatctaccaaaattgtccatgttaatttcacggtgttcatgcacgagctagttagactcaccaagccattaagaacaattttcttacaaaaattcttaaggacaattaggacaaggatccggcctaaattgccctgatcatttttaaatacgtaaaaatctacaagatcatgcgaagaggccatgagcacagaagaactgaagatgataataaatggttttggtagctatcataattaccaagatttctgtgaatttttcttacaaccattatttggcttttcacttccatccagtaacagcctcctcaattctacaactacaaattctccttcacacaaaggcataaaaaataagataaaaaacacacataaaaataacaccttatttatacgaagaactataatttatacgatggccgtggacaccagtaaataaattaagaagaaaagaaaaggagaaaaaaagaagaagaaggggaagaactccaagaattctccaagaaatcaaccaaaccaagaagccgggcggccatgggaaattatactggccagatcgcggcggcatcaccacgcccggatccgcttcttcggcggcagtgaccggaacacggcggcgaggtctcgcgggacgtcgacgaacaccaccggcgacgacttcctcttccccgccgccgcagccgccagccgccgcggcggcagcggctttcgcggcgccggcgggcacaccgccggcggcctcagcctgctctcctccgacgtcggcgtcgacggctcttcctcctccgcatccgcctccgccaccacctcctccttcggcggcgaaggcgaagctgagacctccgcctccacggtcgtcggcggcggcgacggggtcgacaaagcggtcctgatcggcggcagcgccgggagggcatcgtcggcgggggactccattgctgcctgctcgaattggcggcgaattcgcgcgagaaattgggcggagtgggatcgaattctcgttcttgcacgcgtgcaagaagtgggtagaagaagaagaagagagagagagaggagtaaggtcggggcggtagcgcgaaggcgttaaatagcggcctcttcaatggaggagagagaaagaagggtaaaagtaaaaaaaaaagaagaagaagaaatgaaaagaaaagaaaaggaattagttatgagggtgtaatggtaacttctggggtttacaatgacaaattgttataataggacacagacagtaatgcattcttactcgaggtgaattttccatgattattggagatttggaggtaatttttcaagttttgggcaggatatatatgtactacatccctatatgcattgcacaagttcatatattgtatgttttctgaaaatgtatttattttagcaaaatatatacatgggcctaacttaaattactaatgcaacttaggtgaacactcatgtaaaccgtgataaaaaaaggtcatctaaaatcacacaataaaatctaatatgttgatgagatgatgatgtgcaaccttttcttttttctaaaaaaaaatcatgtccaagttcgacttcgtttgtggatcatggaaatggcaaacttcaaaccacaacacaaccatgtcgatttgggatttttttaatgtgattctagatgatctttttttttaccccaatatatatagtattgccttctttccatgccatgatcaattgaccattacattgtgtacaaatcacttctccaattccttaccatcacactgtgcccacggtgcaattgtagtgagcctaacaataatcacagagagagagagagagagagagaaaagagataaatatacaggagtatacagagagaaaccatgcatgtatgcatggcaccaagggaagaggacatagaggctgagttgaaaagggagatgatacagtacaataaagccatatgctgtaaagttgaggcttggaaggtagaagagagcattatgatggatggatggatgcaaatgcagctgatcatgcagaataaggagcagcagagtctcttcttcttgttgttgttgttgttacagcagcaagcagcagatggggtagaagagggcaaaaggaggaagctagagaacaagaaggaaacaaacaacaacagggaggggaggggccttttctctgccattctagttctgcagtttttttttttcagctcaggcctgcacattgatgaagctgtaaacagttgcagtgaggactgagctgaggccgccaccaccaccttccctggtctgctatgccctgacaaatcggtcattttagtttcggtatgactcaaatttctaataagatcgagtctatgggaaaatataccatctgtaatatattaaaatagagtcaacataaaatatgtgtttattgtgttttttaggtggatttagatgttggtgtatttttttctctataaactcatttagagccgaagaaatttaactaacaaaagaattataatatggaatagagagagtagtagccaattaggcattgtattgccagccgaggtggacctctgcataatatttctcgtggaaaaaatggttaatgcactttaatttatttttttagtgatcaacaacagtgaaaagttagctaggtgcaggcttgtcttttttctaacaatgtttttcttcaaactattattgttttttgggtgcgggtgggggaggggggaggcggaattgtggagacgactatgtcagtggggttgatgagttggcgggtatgtatcgtcgaatgaatagaaagatcaatataatcacaacatgactataatagagtcttgctatctatataaatattaatgtgtgttggcgcgaagtgtacttcaaactcatgaaatttacttaatatgtgcgcaggcaattttcgttagttctatcctcgcttatccatccgagaaaagaaaaccaagtaactaataaaattccaccaattttacagcttggacaattaccacaaatttacagctaacaaatctaagatatctcatcatagcaatgaaaatatgaatggcaatggcatgcaagaataggatgcttctcatccgctaaaaatggtggttatgacttcatgagtaagaccagatcaccatgttatactccctccgtcacgtttttgactttttatttataacgtttgaccattcgttttatttgaaaaattagtgtaaatataaaaaaaagataagtcatatgtaaagtacttttgataataaagcaattgacaaacaaaataaataataatttcaaatttttttgaataagacgaatgatcaaatattaacaaacaaaaactcaaaaagacaagtaatatgggacggaggtagtaacatacatgtagggacggtgaaaaggacagtaccctccaattatggtggaatttacggccaaatgtcactggcttgcagtggaagaggaggggaaaggaagaccagatctgggctccagccccaccggatccaagggtggttggcagctacaaaagctggtgatgccacatgggaagtgttgggttggaagggcttaatccttctcctctccctttgctttctctaacttcttgtttattttactcctaatctttgattagttaacctctccctgtacttttggtttgcaacattgcatccatcacttttgtcctctccaaggaaatttaactgtactattgtggacagccatgcctacagcccacatattctcaatttgcactagtgctgccgttcacatttcgatatcaacatcattagaaatgatatttggcgagttggaacaaacataaccaattatgtattttgacagaggtcggagatttagacgaaagtaggccaattaggacttcagccctaaacttaccttcaaaattatggttaaatcctcttaaatcacaatataaattttgggagaaaaaaacgaacaactcattagttaagccctattttagccttacttttggataatttctgaccttaccactggcaggacaatttcgtacatacataaaggaagtggtgtggcattactatactgaattaagtatgtgagatgagatgagcatgttcaagattggaagaagaggatatatactctctccgtcccataatataagggattttgagtttttgcttgcactgtttgaccactcgtcttattaaaaaaattgtgcaaatataaaaaacgaaaagttatgcttaaaatactttggataataaagtaagttacaaaaataaataataatttcaaaactttttgaataagacgagtacaaataaaaactcaaaatctcttatattatgggagggagggagtatatatatgtatgggacttgcaatggaagcatgcagatactaatcatgtggggccatgtgagtacgtgatcgccatgcatgtgagtgcccattgccttttcatgcaaggatccgatgtatatggatacgtaaactaagcatcattcccatcattagatagcgaataaactacttccctaattggagtacggagaacttgcatggtttggtctacttttgtgtatgctccctccggtcaaacatgttcattttggatatgtgatcttgatcgttaattttctacttaatacaaaacacattgacaaattaaatccaaaaaagatcatgcatagaattacctatatgaaattagttcttctcttagaacaatctctacacatggtttttgaagcattatccaacttaaatataaaaaggtattggtgtttaaagtttttaaaagtttgatacgaaacttgtccagaacgacatattattgtgacagagtactatggagtactactactctgtgtagtacttcctccgtcccaaaatgaagtcatttttgaggttggcacgggtattaagaaagtaggtgagaatgattggagaaagtgtgtgattggttgaaaagagaaagtaggtgaagaagaatggttgtgattggttgagaggaggaggtaggtgaagaaatagcttcattttgggacaagacactgtgctagaaatagctatattttgggacggagagagtagcagctactaatggcttgtcagtagaacttgtggtataagttttgttaaacctttttcccacattgagtagaggagtacatgggccagtccagtcctcacttgactaaggttgtactatgataaggggacattaactgaaaaaaaaaacaagagtatttgactttgtatgagcgttaacaaccaaatttggtaatatcgacatcgggaaagaagattagatcgaagtaaagtcgaaggcggagatctatttcggaaacagagcaggaatcggctggagtccagatcggctatgattaggatcagctgggtctgagtcgggctaggtaagccgatgtagccgattccgacaatgcaacttgatgtatgataccgggttgaattgaggcgctttaaggtgattgctgcacatgggtagagtcctgagaaggcaattgtatctagtaattaggatgttttatgtaatttccttagagatatgtttgggcaaaagtctgccgcaaagacttatggtatcttagagtttgttagagatagtagtcatgtccgttatggacatatcttgtaattctcgggtataaatagacccgagccctatgtaacttttaacacacacgttcaatacaatctcggcgcatcgccgcctttttgctttagttttatttcgacgagttcttgctttcgggttgagctgcatcggtttcgatcttcaacaagaggtaaaacttgttatgatgaattatgttctcgggattagtgcttccatctttatgatactctaatcttgtctatgtaattcgtcaagttatcatatatcttacataatcttcgacaatatcgtcatctaacctacaatcggctaacatctgttaacagaaggcagccgatttggttaaataacaacgttgacctagattatataagatatctaccactctataaaacttccagcaacttgattgtatagatattgttcttcttttcatacttaatgctgcatcagttgagtttgatttattaagtcgtgcttagaatatcaatctttagcctgccctctggtcgccgattagagtaccgtcggagtttcagccgatcttacctgatttaatcgtatttgctctatatgcttcaatgatacattaaatatgccctttatgtcaagatcttattgcatttaagtatattaggctcttgtttgatatattttacttgttttagtatcctgatatagagtagtatcggagtattagccgatacatgctagatctatctgatcggctatgctattaagatatataaggctgttatcaataaatattttgatctaagtgattcatactgtctcggcatggcgaccgatctatcccagtcacttgatttaagtatatatcgatataggagctatatattgttaatatttacaaccgatcgaacagatttagttctttattgcctatttacaaccgtcgatcgattcacatatgacatcggctgccagatagataaatgatgtgtcatcggcacctagccgatcggctatcatttatagatttaactgcggtttctttgcttctatttcttgttaattacaggatcaaatcaactggtacgctcatacattcgaaggcgagctttggacctgcactgaagttaaacagatctcccaagcctcgtgttttctgtcaacaatgaggtaaaaaaataatttacaagaggcaacatgtttgaaacaggtaaaatgacggatgatgtattgtttatagggtttaatttaactaaatatattcgttcaaaaaaactaactaaatattatagcactatcatacgaagctacctgatactatatactccctccgttctaaaaaaatccattcctagcatctcaaggtagaattagtggagagtgagaatgactaagactatgttcggtactggaggataggaacctatcttctccgcacggaaaacggagcggtcattagcgcgtgattaattaagtattagctttttttcaaaaatggataagtatgatttttaagcaacttttatatataaactttttgcaaaaaaaaaatcaccgtttagcagtttgaaaaacgtgcacatagaaaacgatatgggggatttggaaactcccggtatcgaacacagcctaaaatgttccggtactcgtaaaggaagtcgtttaggacaatatttaagtcaaaccttgggaatataaatcatgataactctcaagttgttaagtttgaaaacgtaaaaagtatatgaatagatttgtcttgaaaaatactttcataaaagtatacatatatcactttttaataaatatttttatagaaacaagaagttaaatttgtgttttggagaccgtatcgctgttaaaaacgacttccttttaagtatagtgttgaagttagttttctccttccaggcgagttatgaaattaattttttttattcgtgtctgaaaaacccttccaacattcggtcaaacgtccaatgtaacacctaaaaattttcttttcgggaactaaacaaggccacagtgagctacatactcctatatgctcaagtgaaatcagccggaatacatgccaacaaaaaatggccggaataaaggccaattattagcgagctgctttggtaaacccgtaaaatgtgtggatattgtcatcaccaattggaaatttaggtgttttttactcgtgtaattaatcatttgtgacgacggcatttgaattcagaatgaagtgcacatgattaaaaaatcgattggggtttgttggttagcgtcaggcaaaacaagacaaacatgctacatttatctatcttgcttacgacatgtgtacaaatgcatagtgctactattagcttgcactgatcagttaatcaagatcacctcagatcaacaaagtaaaaaaaaatgaaaatctccagccacaagcactgtaaatcacaagctttcatcaaactgttcatcggcagggcatcttcttctttccctttgcctgtttactttgctattcgtcagaaaggttaaaaaaacacacacactaaaaagtgcccaattaggcagcaggacaggtttactgttccccatttaatttttattggagcccattgcataataattcacctctagctacctggtactcctgtactcctagctatagctggagtagcttagtggctgtttagattccaccctaaaactttatatcctatcacatcgaatgtttagttatatacatggtgtattgaatataggctaaaaaaatattgcatagattacgactacttcgcgagacgaatcttttaagcctaattgctccatgatttgataatgtggtgctacagtaaacatttgctaatgatggattaattaggcttaataaatttgtcccgcggtttattgacgaatattgtaattagtttttgtatcagtgcccgaacacactatactacaccatatataatacccgatatgatacgttaaaactttataccctgaatctatacgcacaaccttatcaagagttcccccctcccccgaaatgatatgatatgatatgatatgaagacgatgtgctacgtttgtcgtcgtggtcgtcgtcaaatcacaatgatccattccgacgtgtgcatgcatgcaatgcacgcacgcacaattattgacgacgactcgatcgatcgccggcggggaccggccggccatctctgagaacgcccaccagccggagacgggaaagaagactcatggtcccgttcttttcggattatcattcacacgtttttcaagtttctaaacggtgcgttttatgtaaaaattttgatataaagtttattaaaaacatgtttctgttccctaaaaaaaaacatgtttccaaagtaattttataattttacagtggcatatttatttatttatattttcaaatagctaccataaaaattggataatccatcgaatagctatctgagaccgtgcctgtgaggacgaaggctcgttcgaatctgcttaggatgaagattaagtacgtgtgtacgtaaaacgagaaaaccatcaatacaggatcaattgcattttatttatttcaaacttaaaaaatgaatttgtttgatatcttaaagcaacttctatatacaaaacgtttgcacgaaacgtatcgtctagcagtttagaaatggagttagctaaaatctaggttaaatcgaggtggccgccaaggagagagagccaaagaggaccacctgaagaaaaggcgatgttttgcagctagtcacctccctcccttttttcctgcacgcatgattcacactgcaatcctgcgtgcactgtgcagtggccgccggcagtgcttgcttgtcgtcgccggccggccatggccggggcccctcctcctcctcatcatcggccggccatggccagccagccatcactagctctcatcctctgcatgtgcacagtgtgacgcctgatgcagtagcctgaataatctggcaatgtgctgcatgaagaattcagcacattcagattttcagggtttgaatttttgatggatttctcagcctgtccatggctccatgcgctgcgtgtctcccaaagaagatggcggcagacagggacaccgtaccttctgcaccttctgctgcattttgcctgcaaggctgcatctctctgcaggctgctgctgatgctcttttcctctcccctttcctgcaacactgaattttggttaaccctgatctgtaattcttttcagaaatttaccccccccccctgcctctttgcaggttgatcggcagtagatcgccgagattgattggttggttttgcttttgcaatggatgaatgatctattttgccttttcgttttactgttgaggagtaaattcaccggtgccagccagtgacagtgtgagtgagtggccgccttttggtgatccgatcaagctgagcttaggttcggtagccgcagagtattgcagtaagctgagctaagcctctcgtttgcagtagtgcagtttatcccttgcaggttgcagctgaatttacagtttgggagctcattttgtcgatctctctctccactgtcaattccctgacacgatggttgtgtgcaatgatcgatcgccctaattgtaggagtagtgagttaaatcaccacagtttttttcttgttttttactcttgtcagacaaatagcctcattggttacccatatttcctaataaatcaaaacgacttattgagaaatataaattaatttgtaggcaaaatttttatatatttgttcataacaacttaaaaaccaatgaaaaaagaaatcacgttaaaaatattttaaaatcaacttcatattcaagtttaaaattcaaatttggctttttctttggcttgttagaccaaccgatgggctcatagactaatcaaagcactgttcatatgttctcattgaataaaaaaagaaagaaagacatctgatgagtaaaacagtaactctgtggcccatcgaaaggctgctagctcgggccatgtgggccagcctgattggacatcggcccaataatgacacggtgaggtcttttcatggccggcccatacaaagtgaatttcacccaagtcaccaaacccgagtcttcaaagttcaaactgaacaaattagctgactactagtaattcaaatctgaatatttgactaaacatcatgaccatagaacgagtcaaggcaaggaaaccacctcgttgttccacgactaaccacgagtttaacatctggtttaccaacgttcttggccatgaaatccagtagatattttctgaagaataaatttactagtaccactgatggcccatccattattgtcagctgcgacctagcaatactttttcagtcctaactataattaccaggggttaattcaagtaattactttcgagttaataatctcggcaggtaattctggttaaattgagagaattaaacagctagatagcacaaggagaacaggaaaaacaccaataatctcggtcaagatttccggttgatgctgtactacaaagttcatgcgtctcgacgaagaattaatgctaagggaaatattctaatcctagagagcatctcccaaacatgatagttaatcaccaccaaacctagacttagtaccttgtctaatccaagaaatgccctcttgcttgcacaattatcttctcttgtaggcctaatatgccatgtacggatcgttcaggtttaactcaggcatatatgccttggagggctggctcatggcaactaggcaaagacttgagaggaggaacaagtcttgtgtgagattaattgcacatgccaacctctgctagtcctcgtcaggtagcgcgtaacaaggattagcttaattagccaggtctcatcttacctctaatcttattccatattaatgcagcccatcgctagctatggtgcctggtcagcatgcaacccaattcttcagtagtagtacagtacaacacataggagtacattgatatgtactagtgcatataggctatgacatcaaaattagaagttaggttgaaattggaacgatgtgacggaaaagttaaaagtttatatgtgtatgaaaattttgatgtgatggaaacgctagaagtttcaagaattattttggaataaacacgtccatactagtaatgggtacacatactcctacattgctaggtgtacttgcctatttatttttattttcaaattacaatacatacgtcaccattaagggctggtttggtttgtggcctaaataggccttatcaaattttattagtgccaaattttggcatgactaattttggtaaggtaaagttgtgtttggattgaagccaaaatagtctaagttcactattgaaatggcctattttcttaggcatgccaaaatttgacttcaaaccaaatagacactgaacactattgaaattgccaaatattggtaagcctaatttaggcctcaaaccaaaccagccctaaatacacacgcagatcatattgtgggtgcgttactttaaagagaggaaagaagtggattaagaagatatataccgcccccatcgtttggtttattggggaataagcgaaacgatatatttgcaaatgaaaaataatttatgaataaaacttttatatacgtgtttttagcgatctaaaagcaaatgttgaaaaataaacttcgataaaaaaaccctaaaatcaactcaaaattgaatgttgaaaatttaaatttttgttgataagcctaagcataagcgaaaaattgaggttgcgagtcattagtgtgtgattaataatgtattaattattttaaacttaaaagataaaagatagtttaatatgataatttaaagcaactttcatataaaaactttttacataaaacggtctatttagtaatttgtaaagcgtgagcgtggagaatgagaaattttcttctctgatctgctgcaaacaaacgcaacctaagcatcaacacgtgcgcacttcgctagcacatgctaaagagacgaaaattagcatcatatcagtaaccttcctaaattcatattgaaatttacttgggtatatgtaatatttgtagaaaccatgatttaatctctagtggatatcagtaaccttcctaataacccttttcgccgcatattctcatggagcagctactactactatactagtactagtactccctccatactcataaataaagtcatttacgaccatgtttaagtcaaacattgggaatataaatcatgaataactctcaagttgttgaatttgaaaatataaaaattctatgaatatatttgtcttgaaaaatattttcataaaagtatacatatatcactttttaataaatatttttataaaaataagaaattaaagttgtgttttagagaccgtgtcgctgtccaaaacgactttctctatgagtacggagggattacgtagtttagctcctcctcctcgtcgtatgtctgtacagtataaatacgaaaagtgcatacgtgtagtagtcgacactttgtcaggtagcgcatacgcgtagcgttcggtgatgatgagattgagagagagcaatcgaatcgaattgaatcgtgccaagccagcagcagcagccagcaacctcgtccaaaggtcactgtcgccatgtcaaggaacgtgtcaaaacgcctcacactcaccaccggtcggtcaggttcaccaccacctcatcggccttagccactcccaccccgctgcgtggtggggcccacctgtcagtgggggaggggtgtaaacttcctgtaacggatagggacggcctactgcctgctcatcagctttgatcagcagctcagcccggctgcgactgcgtcttgtacgcccacagaacggagggaagccgtcgtctttgggtggacacggtccacgcaccgggcgtggggggcacatccgttgtgtgtctgccccgggatcctctgcggagggtggtcgtttagcccttcagagctaagggggtaaatattagcatttatatgctttttatggcttgccactaatgtccactgaaaaatgggtaatacataaatgaataatatgctttttttgacttgccactaatatcaaatgaaaaatgtgtaatacataaatcaattaatttatgtacaaaacatttacataaatcaattaatttttgtacaaaacatataaccaccaacctaatttagcattatcttagacaattataagggagtaagtgatcttagacaattataagggagtaagtggggtcataaatttaaattctaaatttgaaaattttgtatggtaactggtcaattactgtatttcagtgggaatcggaaattcttgacaaaccactattctggacctaggtcgagatctcatagctataactcttgatttcattggcacttcttgtttttatccactcaaaccaacataactcactagtgtcaaactagacatttattacactcgatcaaaagacatttcagtagtctcttcctttaacatattaaacaaccatcaatacatgaagcaaccgtgctagccataccagcatatactctccttattagatgtgtcgtattatattactacccaagacaacaatgaaattcaaatttagatttttttttctagtaactgactatggattatcttgaggggccgaaaattctagagaaaccgatattctggtcccctagtcaagatgcttaaaagcctgaattagctgacacgtttttgtttttttttttgctcaaaccaatgtaactctctccggcaccaacctaaacgtttattacactcgatccaaagatattacatcaattatctttcttcaacatattaaataattatcaatacacgaaacaacggtaccaaccacaaatactctcttcatgagatgtgttatattatatttgtgtcctagacatttattacactcgactgaaacagatttcgtcaaatatctctttcttcaacatgttaaacaatcatggatacacaaaacaactataatagccatgctagcacacacgacctttattcaacacgtcatattatattactacccaagacgccaataaaattcaaaatttgaaaatgttctttttttgtctagtaactggtcattggaattcatagccttggtcaagatgtcatagctgtagcgcttgaatttgctagcactttttgtttttgattttttgctcaaaaccatcgtaattcgttagtgccaaactagatattcactacactaaatcaaaagagttttcatccattatctttcttcaacatattaaacaatcttcaaaacacgaaaacaacccgtgaaaaccatgccaacatatactctttattacacacgtcgtattatattacttcacaagtcatcaataaaatacaaatttagaaatgggaaatttttttagtaatcggttattagatttcactgagggactagaaattctagagaaaccaatattctagtcccctcattagctataaggcttaatgcttgaatttgttggcacttctatttttttgttcaaaccaacataactctccagcaccaacctgaacatttattacactcgatcaaaagagatttcgccagttatcttccttcaacacattaaacaatcatcaatacacgaatcaaccatgccaaccataccaacacacaatctctttattagacacattgtattacattagtacccaagacatcaataaaattcaaaattgattttttttcttcttcttgtaacctaccattggatttcactaagggaacggaaattttggagaaaccgatattctagcccaccggccaatatgtcatagctataacgcttggattagctagcacattttgtttttttcactcaagctagcgtagttcttccgctcaagccagcgtagctcttccgcaccaatctagatgttacactcaatgaaaagagatctcgtcaactctcttccttcaacatattaaacaaacatcaatacatgaaacaaccgtgccaaccataccaacacatactatctttattagacacgtcgtattatattactattcaagacatcaacagaatttgaaatttgaaattgatttttcttttctagtaacctgccgttggacatcagaaattccagagaaactgatattctgccttctcggccaagatgtcatagccataacgtttagattagctagcacattttgcccttttcgctcaaactagcgtaactcttccgcaccaacctaaatattcattacactcgatcaaaaagataagatatttcgtcagttctcttccttcaatatattaaataatcattaaacgcacgaaacaactgtgccagccatacagcacacacaccctttacgagacgtgtcgtattatatattactctactcccacgcaaacacacgagtcggagtaggtagcacccgatattctggcccacccggtaatatgtcatagctataacgcttggattagctagcacgctttggttttctcgctcaagctagcgtagttcttccgctcaagccagcgtagttcttccacaccaatctagatgtctattacactcagttaaaagagatttcgtcagctatcttcctcgaacatattaaacaaacatcaatacacgaaacaaccgctagccataccaacccatactctctttattagacacgtcgtattatattactattcaagacatcaataaaatttgaaattgaattttcttttccagtaaccgtccgttggagatcggaaattacggaggagctaatattctgcccccctggccaagtagttgaatatgacttgtgaagtaatttagaaatgtgccaagcgttatagcacgttttggttttttcgttcaagcgagcgtaattcttccgctcaagccaacgtagttcttccacaccaatctagacctttattacactcaattaaaagagatttcgtcagctcttttccttcaacatattaaacaaacatcaatacatgaaacaaccgtgccagccataccaacccatactctttttattagacacgtcgtattatattactacccaagacatcaatagaatttgaaattagaaagtgattttttctctagtaacccgctgttggagatcggaaattccggagaaactgatattctgccctctcggccaagatgacgtagccataacgcttggattagctagagcattttgtcttttttgctcaatctagcgtaactcttccgcaccaacctggatgtttattacgctccatcaaaagagataagatatttcgtcggttctcctcctttaatatattataaataatcattaaatgcacgaaacaaccgcgccagccacaccagcacacacgtcttttaataaaacgtgtcgtattatattactccgctcccacacaaacacgcagagtcggagtaggtagcacacagaaagagtagtctatcgtacagaggttgcagaggatcctggccattgcggccccgtcctgcctacaaagaccccgctcacccaaagctttccctgctgtcgttgctcttatcctatcctacgtttgttgctcggttgcttctcttctttcctctctgtcttctgtcttctcttcttcttcctcaccaaagttgttgagttggtgtcctgttcttggacggacaagggtgtttatccaaaagaaatccatcccgagatttgcttctcttgcgcgcacactggcaccgtccggatcgctgaatcttgctggtggtggtggtggtggtggtggtggtggtgcacggccatgtcgaggcggtggcggacgtgccaccggcggcggcctacgggttccccggatcggccaagagagggaagcctgaggaggtggtggtgctgatggggaagaggaggaacgaagggttcttcatcgaggaggaggaggaggaggaggaggtgctgacggagagctcgtcgatcggcgcgccgtcgccggcgagctcgtcgatcggggagaactccggcgaggaggagggaggggacgacgaggaggaggtggagagcaagctcaaggcggaggatgagcaggtcggcctcggctgcttggacgccttggaggaatccttacccatcaagtgagtcaaagatttcttttctttcatctttcttatcagatctttttttaaaaaaaattatgtaggtagatgtaggctttcacacacacaaaaatggcgaaatttgtgcaaaacacatgatagttttggtgcttttgcttttcttgcatctcttcatgtgtactagtagttgctagttggtcaagagtattttgatgatttgagtccatagctacctaaaatggcgcggcaaacatggattcctttccagtaatcgttaaattgcagagccaaacatgatgtactagttagcaccagattagcattagcagcagacatcctattatctttagtactatcctagccatgtcggatgcaagaacatgtactacatgcttattatcatctcttcctgaacaaacatgacagtgacggttccaatgtcaccactgatcacatcctcaaaactgcagttgacaaaacaagatgctgcagaattagctctaaaattgcttatatttttttcttttttttcgcgacgctcagaaagattgtcatgtcaatacgttagaagtaaaatagtttttgttacccaaaacaatcagccagacgcttattccagggaagggagaaaaagcaaaacaagaactgaagctaggaaaagactactaaaattgcttttatatatatatatatatatatatatatatatatatatatatatatatatatatatatatatatatattctgaataagaagctctaaaattgtttgatttgttcaggagggggctctccaacttctacgccggcaagtccaagtcgttcaccagcctcgccgaggcgacggcgtcgccggcggcggcggccaacgagctggccaagccggagaaccccttcaacaagcgccgccgcatcctcgccacctggtcgcggcgagcctcctgcagctccctcgccaccgccacctacctcccacctctcctcgcgcccgaccacgccgtcgccgagggcgacgagggtgaggaggaagacgacgattcagacgacgatgagcggcagcaccgtggcaagaacggcggccggcgagagtcggcggcgccgccattgccattgccgccgccgaggctcaccttgcacacccagatgggaggaatggtgaggaggaatggaacattcaggtcgccgaggtcgctctcactgtctgatcttcagaacagtggcggttcatgttagtttgctgctattagtacaaaaaaaataataatttttacagttagagcaaaaagccattgatctccttttggctggtagagttgttactgctacaactgcttactattagtaactatataattataattataattgcaatgcataaggtccaagtttgttgtgatctactatgattctagtaactctctggtttttctgagtcctgacctgattaagaagacatgtatcaactatgtatatctatgaactgacctaacttgaggctatcattaactaatgatggtttatgattagtcaattgctttgcttttgatgatctctctttctaatttgtttctgtaaatttgatttgctggatgaggaatcccatgattgtagtagcatcaagttaattgctccatggccagtgctttgcttgctttgtgagttgtggggagaactggtgagattggaatggccaatgagggagaatccaagtccaaaatgcctaatcccaagaaggaggagggaaaaaaaagaggcacttttgcatgtagctttgttttgatttgacacaggcggcaaatacatacatcattttctctctctttttccctgagcaatctgcgtggtgtgtagatctaccacaacagaatactttaaaatggagcaaaaattcgccctctgttttcaccaaaaacaagaagcaaacaagagaagaacagcaacgggttgccacataaacaaacttgaaatgcacagcaagatgatgccatccttttattttagtaattttttttgtgttttttgggtaagtgggtgagaggttagtagtaattagcatctttattgacggcacattgttttcacaacaaagtgtcaatgaccttgatgattgctcattctactctatttatatgattaatgatcttggtgatgatagctgaagatcctgagagaacagacaaagtgtgtgtatctgacagtctgaaacttgggtgaaacaggatcctatatcactattctactaattgatgccctaatcttgatggttttgttcttaaatgtaagcagatgtgcttagaaatttggagttaatcaagtttggtaggaactagagagagaaagaggggggctgactgtacatgtgcaatgtgatcttatcctgttgcacaatgggtactgtaaaatattctatgtggtactatgcattagcttttcttaatgctttgcttgtaatttttaatgcttggtagttgggactgcctgtctttccagccaggggattggaaaggtaggttagcttaaatgagttatctaaaaccaaaagctcaaatgagattagctgtaggagctagattttttgtttcaataataagaaaatactatcagtaacaaaagcaaacatggctagcatgataatatgaaaaaaaaaagggccttccttgtaaggtagagacatgctttatcacctacttgaatcttgtcatttatatgatttttgtgtgcacatgttgaaaaaagaattacttgagtatagctagaacattactttcataagcgaccactctatagcatagataaccaaatgcttggttgagaatggaacaagagaatgcatgtcttctagatgagagtgacctttggtgtgtgcatcatctgcagaggcaacggacgatgaaaatgaaaggcaaacaacatgctactagaaatgtggtgatcttttcttttttttttaaaaaaaatgtgattatcatttccctggaattaagcatgataatattaaaaacagaccatacatgccagccaatcagccacattgtccttgtgattgtgggtcagtacttgcaagcttagtaagcagattaactggatttaaaattagaaaagtatgaaactgaaaagaatggagatagaccactcaatgtttggcacaggcctggtttagttcctaactttttcttcaaacttctaactttttcatcacatcaaaactttcctacatacacaaacttccaacttttccatcacatcgttctaatttcaatcaaattttcaattttagtgtgaactaaacacacccatatttgtacatctctcgtcatgaaagagttcaacaaatgaaagagtccaacaaagggtccacaatttcgggggaaaaaggaaatctgaaattccagggtctgctggtgggtccctatagcatgtttggatgtgcctttggccaaaattattaattttgttagaagttagcaacaatctgttcatattcagcaaaaatctggttggattctaactctcccattcaaaatccccaaatttcagaatttggtcccaaaaattggacacatgaaacatcttcctgcatgcttctcaatgctgtacgtatgggcaaaaatgactccatttcatcatcttataaaatctatttatttatatatataatgcgagatgacaaatatgttatttatgattatgtttgtgcacgccaggtacaaaacgtggatccgctagctctctcgttcacattttgtttgtggattgtggtcaagagttgagaaacgaggacaaaagatattgtacgtatcggatcagatcgacgtcctacgtaatgtacgatatccatcggcatctcagctttaagtttttttttccggcctaatttattgagacagcttttgtcaatatggatcgatgccactactgtaccaaccacgaattactgtgtggatgatctggcaccagctccacgaattactatcagttgtaacctaacaccagctctacgagggtttcgttatctagtaaccaggcttaccgcagggtgttataatgcaaaaaaaaaaatcgaaaacctcactatttttttaaataaacaaaaagtaaatttttagtaagtaaatattcgtctggtttaactagtgtttatcgcggctatcgggcttatcatcagggtaatgggtaatacattccctcttatgttggtaaatcttggttctactgctccaggcatatgtactccataaaaaaagcaagtggcaattttaaaaaacggtgtcaaataagtaaacctgaaaaagtagaatcaaatcggtatttaggtttcaaaatagggtcaactgagcaattagggcataatataacccttacctacccacctatcaagtgatgcatcaatcttcatccaattcattctcccaattctataggggtattctaattctctggtcccgttcttttctctaacaagaattggatgaagattaagattttcgtgacacgtttttcaaaccgttaaccggtacgtttcgtgcgaaaattttctatatgaaagttcctctaaaatatcatattaatattttttttctaagtttgtaataattaaaactcaatcaatcatacgttaataccatctcgttttgcgtaaaaaaaacttaatcttcagaaaagaacaccaccggagagtagtaagctgaaagtactcgaggcccaacacatttatcaggacgcaggtgtagtggaattgagctgttttggcatgcaaaagatgggaggaggggagtgcttgcgtccacgactcggcggcagatgggaagcagaagctgctgcaacttgcaaggcgagatcagctgcaagtactagtagtagtggaggtgtagtggatagagatgcactttgtggtagcagtagtcggcactgcacggcggcgtcatccccagatgaggagacaaaacaccttggtcgttgccgccgagctgtcacactgatctcacctgtagtaagcaagcgacgtcgccgtgtgggccgtgcattgtgtcggccagcctatgttgagattgggccggtcaaaaagcccactagctctgtccttcaatgcatcgcatcttagtgggccaaggccagcccctagttccatcggaatatgttcactttagatccagtttattgatgacaagtttacattagatccttaaaccgctataacagatataaggtgtaccttacaaaagtagagcaccctaaactgttttgtgctctatttcgactgacgtgacgagttgactgaggttaacccgaccgagttggtataggatccacatgggccccacatatgaatgcgccagtcttcttcctactttctctcccttttatttcctcatttctcaccagatcgagaggcgggagggcactaatcttgttttagacccaacatttaaatttataaactaactagaaaattgcccgtgcattgcaacgggctacttttaattttgttattgttatacggtttgattaaggtaaaattcactgtgagaattagcttgaatatatatttttttataaaatcatgagctacaataaggagtccgatcatctcaagttaacatgcaagttttttaaaaagagatttcttatattacttcttttgtatttctgtaagcgaacgaacttaaaacccgactcaaatatgtatctgtattttcaaaagcaaatgaacttaaaaaccgactcatactcggatgacgtaacaaattatcggcaaaaacatcttcagtagtttttctaatagtagagaaatgttaggttctttaccacttttagattcaatgttgtaagtgaatctttagtaaaaaaaaaacgttgtaagtgaatcaggtcctggagttcatcttcgaacctatatccggcgatttgcctcgagttgaagttcaatggaagtgtgtttcctatcaaaagagattaaaaaaaaattgcatatgggcaccgtttcacccacgcgcgcgcacggggcgccggattgggcggtcgggggcgtccgttttttctcctgcccgactccaccgacgcgcggattttgtcggtagagcggtgtactcattgcactgcacacagtttcgcacaccgcctgcttgcttgccaattgtcatcggcaacatctcctctagtcctctttggtttgcccatggccaattgccgtgcacactccctgtcacgtgtcgccattattattgtctaaacaaatgagcatgcagcagcgagcgagatagagagagaaatacccagatctgcatgcaaattgcaaagggcttctgaatttatgagttgactgacgccgtgtttagttacagaataattcttcaaactttcaacttttttatcacatcaaaattttcctacacatataaacttttaactttttcatcacatcgtttcaatttaaatcaaacttctaattttgatgtgaactaaacacagcctgaaaaccgctaaagaaaattaagggggggggggggaagaactgtaggctgggtcgaaagcaagagaaacggggtttaatgcgtcttcttcgtctcttcttcagacaggacaattttgcatgctgcggatggttgagaaggtattctgacaggtgtgaggcatttgttttggagtcattcgtttcaaattttgaagtggcaaagcttttgccatcctttcaaaaaagaaattttttttccaattttgtagtgcatcttgagaagagagtgagcgtttattcgttcactacagtactacacccaactgacccaagtctcagtcttactaactcttaaggatgtgttgttttgagggtttacaaacacttctaccggtcgtacgtataatggaattatcgattaacacataataattaactattagctaaataaacttaaaaaaataaattaatacgatttttaaaagtattttttgtgatttttttattaaaaatatattttttaacagtttggaaaacatgtttgctaagaatgaaagagtagaagttgataaagaagagaaaagaacacactcaccgttcatagaaacgtggaaaacccttctggttgtacgtctgtacatagcaagcttcgactcttgtatggtttgatggacttatattcccgatatcaattcattacttgttgtgcacattatatcagctactccaactaaatatttgaccaagagtgtcccttaaaaagcatatgtacgcatggggtaggggcgaagctaggatttaagattagggggtgtggtgagaggatatgccatgagaccgaataactaatattgatagcaaaggaggtcaaataatcaccatcaataacaatcaatgcgtaaactagtcctttaaaaaacttaaaatttagctctttaataatatcattgaaagtttaaaactagtaattattgctaaattctttcaatgtaaactattgaataatctcacaaataagtatcataaaactattgaataatctcacaagtaagtatcatctattttactttgaaaaaagatgagaaatcacaaactaattttgtagattatggttcttgctaatgttcttagacttgctaactaactaaactgataatattttcaagctatacaaataaactagataaatacttatcttagttaaccttaatatagagtaaaaacagggggtgttggcaccctccgacaccccctagtcggtgccactgtatgtaagatacttctacccctgtcccaaaatattcttatataggatgggttaaatctcatcggaagtggtaatatattgggatggaagaaattcagccaaaaatactcaaacactcaaaatacgagctgaagtttcatctcctcgtatccctacagacaagatgaaaatagtcaaaaatggtagtattttcttggaaacgggcaaatatcttttcggaaactagttacatgggcccactttgtggggcccaaatgtttatcactaaaactaactactcaatatcaatattaatacaatatagaaagaaattagaaaaagtaaaatttatatatagcaaaaaataataacaataaaaagtacccttatacgaaaatttccgatcattttcaccctacactccctactccaccagaacaggacaggccggagaatttaccagcgtacaactaactgaactaccacccaccattcacatttcaccacctgtcggctgtcagtcaagagtgtcagaacaacaacaaacccagcagtaaataaacaaattaaagccccaccaccaccacgccacgcgacgcgaggctccgcgcgcatcgcgccgcgcgggtgacgcagtgtacgcgaagcccatttatcgctagctagctagcggcaaagccggcactgacctcgtgcttgtcctctgggtctctgtccccctcatctctctcctcctcactctcctcggctgctctcctcctctgtcggtggtgcactgcttgctcgatcctctgcaatggcggtcgacccgcgccaggtggtggccgggttcctgaccctgtccatgttcgtcatgctcggcaacatgatcaagcacgaccacttcacccccgtcggcgccggccaggaggaggttcgtgcttcttgattccttccctttcccgtggagatctctctcgtctttagctaattgctcttccaggttcttggtctctgcgtgaggaattctttctttcgctgttgatttagctcactctctttgtccgggtttctttggttcggagagtagttcagatgaagggatttagtagctgttcgtgttgatttggctcgccggtggaatgcaggagtgtgattatgatttgggtttctttgtttttgttttaattcttggataattgcaagcgatctgtggatctagtggtgaaggggatcttgaacgtcttgtgaccttgactttcattaggggttaactggggtttacattaattattacctactagtcgatcagcacgttgtctgcagtcaaaaaagaatccgaagctcgataaccgtgaagaatagcactaaattatatgccttcagccttcctaaagaaaggctagttggtgggggacacatcatcagtaaagagagcatcaattgcaaagatgaaaccaaaggaggaaatacagtacatcgtttttaatctctttggatagtgatagttatcattatgaacttgatatgacagagagagctcagtctctccaggaagcaaatcatgtgcgattgtgtcatgagcttacttgttctgattcttgtatgcaaatcattgatgtgccagatttttggaatcttttactacagtgttcattttgtccaatgctcaactggtatgagtcaattgacactgtcccaagcttccagtgatgaacgattcttttgaactgactaaatttaaactgggcattatatgactgaccccaatttgaaaaccaacagttgggcttggaggcaacaggcatagaatcaaacgaaattaaaattgcagatactactgaaatgactaaggtcaacaaggctggagtggatctcccaaaggagactgctgaggagattagaccctgctggtctaaaccaagatcaagtaagtaaaatatattcttgacaagttctttagatcccaactcttgagtcttgacacattggcacttgtaatttctgcagatgttcaggagtctaagggttttgttacattctcattgactatgggccctgaataccacatctcacaggtgagcttgcaactcagagctcatatgtatagttaattactatatgtaagaaaaacaagttttgtgtctgcatattctgtttgattgaattgctggaaccccgcttgaaattttcaggaccatggtttttcttactgaatatacttctgtctgcagattactgatgctgtggttatcgcaagatatttaggtgcaacacttgtgcttccagaaattagaggaaatgagttaggaaagaggcggtatgtttcattgctagaaccttacacttttcccccctcaaaactgcacaaggctatcggctattgctatcttgtattcatatttactttagatatactgaagaatttcaaaactacaagcttttcttttccaatttataaaatcttccacaatttgtttacaattcctttcatgaattcattaaaaaaaacgtttcttctataaacatgaaaaagatgtcattcatttgcactaatgatataaggaatatacacaggaaattcgaagacatgtatgatgtggataaattcatgacgagcttggatggagttgtcaaagtagtacattcacttcctaatgcagtgtcttctaagaagccagcagtagttagagtaccaaaccgggtgactgaagagttcatcacgggaaccattgagccgatcttccaaagaaataactacttacgacttgcgactattttctcttcagtaagtttgaaacagaaggagtcgggtaacaaggacttggattcgactgcctgccttgcaatgttcagtggccttcagttgaaacctgaattttcagcagtagccaagcatatgttggacaagcttaaagaaataagcgagaaatccgatgggatggttatagctattgatttacagaccgaattgctagaaaagaagatctgtaagacgaatggaggtgcaagaagaagaggctgttattaccctcaggaagttgtgcacttcctgaagaaggttggcttctctgctgatacaaccatctacttgacggagacatggtggcacaaaagcctggatactctgaaggaggcatttccaaacacttataccaaggcaagaaaactctttcaccaattttttagtttgtatgaatcatcatccatcttctccccccaacaaaatttactgaatgctacactgaaaagctattcatagagaaacacacttaaagttcagactgaatttgatcgttggcttgtgattccaacttgtgacatacatcagtttttttttaataagtataaaccgagctggcggaattcttgacacatagttatcattcttgcaggatgatataatgccggccgctaacaaaggcgagttcctgaaatccggggattcataccttgcaagagcactggacctcaaaatctgctcggagagcgacgtgttcgtccctgccatccccggcctgttctacggacatgtcgccggtaagaggatcgctgcaggcctgacaaacatcatagttcctgctccagtgtccagcagttcagctctggcttcagagttcgtctccacatacgtgtccaagaagagccatcttgcctactcatgttactgctagtactgttcttatatcatcagcatcagcatcagcatcaataagttcaactgaagtgagttgcttggccaagctttgggtacatatgtaagtccttttgttgtatactagttcatgatgttgtgaggaacagtatcatttatgtgttacttaattgttgttgataacaaaaggagagaagcacagaattagtgtgctgaaaaaaaaaggacactagattaggcatgtggaaagagtgtgtgcttcatgtactaccaagttatggttcatcagctggaaattactccaaaatactgcttccatagaagatgtgatgtgtgaaattctcttaactttatatgcttatttcagcaatcccattctttgacaacaactcaaattaggctgtgtttagttcagcgcaaagtttggattttggttgaaattgaagatgatgtgactaaaaagttgtatgtgtatgacaggttgatgtgatggaaaaagactgaagtttggatccaaactttggatctaaacacaacgttaatcaagtttggtcctaaattacgcttattaaatctagtctcgtgatctcgagttgcggacggggacgaagacgccgggccgtacagttactcaggctcgatgttttgggattgagatcctcttacttcactcttcatatagtgaagtcagagaagcaaaggtactctaactttagggtattctcagccatccaatctgcagcgaacggatctgcagcgaacggatgagatcgatcgctacagtactttacagtaacacgtgaacagtacatgtacacagtatattcgcactgtagcacaaggtagcactaaagtcagacaagcatgtattgacacccttggtacgcaagaacaaagttttttagtaccataccgaatttttttttgtctaaagcccacataaaagaggacatttatgcatctgacataaaagaggattttttttagaaaattgattaaaatccggcttctacatccacaatggatgtacacagcccaacgtcatataagagtacttagacccgaattccttacaataaggataataaaaagtaccaaagtgacaacacttaaaagagaagactactactccaatcttcttataaggttccacccatattttgcatacaactccatgacccttgcctccaacatcttgcgatattctttcaaattgtggccatcctcttccttaaacaacaaagaccactgttgtgcccaataagtccccttgaagatcacctgcaaaaaggaattagttttggagccattaaaaaccacatcatttctatttaaccaaaccgcccaacacaaagccgtgatgcccacaaaaatttggtattttagtctaggttgaacaccatttaaccaactaccaaacatattagcaacactagtgggtggtcgaatcccaaaggttataaaaacgacattccaaacagatcttaccaaatgacaataaacaaagaggtgttgtattgtttcattagaattacaaaagcaatatttaatgctacccttccacttcctttttgcaagattgtctttggttagagtaatccctctccataagtaccacaggaaaatcttaattttcaaaggaattctaaggttccaaatgaaagtcctccttggaactacatcacaatacataagagcattatacatagaatttactgtgaagattccatttttattagctctccatctaaaaacatcattttgctctgaaaggttaactgacacaactttcgacactaggtcatgccaagccactagattatccccacgatggccctcctaaaagagacattaagaggctctgtgtttaacacatcagcaacaacaacatttttcctcctaactatattataaagtgatggatatagcttatcaaaagatgtggcaccaacccaacagtcctctcaaaacctcaactgagtaccattgtgaacctcaaaggatccacacgagaagaaggactccttaacagccataagccctgactagaaatgagagtcccccggttgcttatcaacttgggtaatacatttcttagccaaatacttcttcctaagtaagttctgccaaactccctcttcattaatgagcttatacacccatttactaaccaaacacttgttttgcagttataagttatgtattccaaggaccctacacaccttaggtctacacacaacactccatttagccagtctgtattttttttatggtcatcacattgccaaaagaatctagatctataataatctagcttcttgaggatacctttaggtacctcgaagaaggataatataaacatggctaaactggtcagctaaaaatctcaaacttatgcttagtacatttgagaaactttcaggcttgaaaatcaattttcataaaagcaaattgttttgttatggcaaggcaaaagaagtagagaacgagtatgtcatattatttggatgtggcaaaggaaattaccctttcaaatatttagggattccaatacatcacaagaaattatcgaataaagattggcagaggatagaggaagattccaaaagaaattgagtagttggaaaggaaaattcctttcggtgggaggaagattggtgttaataaaagaggacatgtatacataaaagaggacacgtatgtcctaagcccacataatgtgcttactaagctctcaccggccaacactatttgctaacatagcatccagattaaatatagtttgttactcatttctattcatattataatatgttttgaccccttcttttaatcatcaatatataagtgaattaaacttctttaactttaaccagatttatataataatacaacaatattttcaacacaaaccaaatataatatcaaaatatatttagtgttagatttaatagaattaattaagtgtttatagatgttgctacgttttcttacaaacacgatgaaacttgagaaagtttgaattaaaaattaaaatgtcttataatataaaatagagagtaattcgttttttaaggtcccacacattgaaggagaggattagtatttttgaaacagggataaattaccgtgtgtctcatgctatcaataactactgctgggcaggcagctcaatacacagcaacaaattaacattttagtagcactccaacaacagatgacagagctgaaaagggctaggattacccagaatatttcatgatacttcttggtccaaatgacaattttattagctacgtacttttacaatcgacgaccattatacaactaataatttacaatcgactagaataaatagaactgattcatcctatggttatttcagcagacgaggagaatccatctataagcttctgctttattagactcttttctccttggtcaacaggaaatctccatttgtttgaggatgtagatcccataccattcatggcattgcccttgtcacatggaacttgatcgagcaagcggattctcttcaagttcacagctcgctccataataagcctggtataatttatcatcttatcatccatcgcaaatcctgtaatctctaatagattcaagtggcgatgtttgaaatcagatgacatctgatcccataacaaattgaccttctcagcgctgtcctcgcatctgttcctttcacatggatgctgacataacttcaagcaacaaaaaccagttagataaatagtgctcaacagccaacataggcatacatcatcaagctcaagaatttggatatatcttgaatgaggtaagcacaagtttctggaaaaagaaaacgttttcgcagtagattggcaccataattttggattttataattgaataatctaatttacagtctcctttctaataaagtaggaaaaggaacaaattactatgattagttaatatggaaaatatatccatataaccatattggttctgcagcgcaacaatgtcattataactttattaaaaaaacaatgtcattatggaagttgcatatttgatagaaatgggcagagataaccagagatataacataccttgagataaaagttgctgagacgagctgcagcttcaaggacaaacacagtccagttcaggtcacattcatagaaaatgttgcaaagatagacatctctgacgttgctgaatacaggatagagaagtttaggaccttgtggctcaatccaaatctgcagcagaagaggaaaacaacataaagcagcggataccggtcagcacaggacgaatattaaaacaagaaagagaagcagtttgggaaagttttgctggtagccatgtacttaccatctgatcttggaaatccaggtataagatagttaagtttgtggcgcttgatataagctcggtcaacctgaacggcatctggtcatacgtcgcagagcaagagaggctcatgttgtgaaggcgagtaacattgccaaaacggattggggggtttggaaggcaccaatcccagcagactacccgcctaagatttggcaaatggatcagatcagctctgtcaaacccacaagtgacaatttcaagcgtgaggagctccgagtgtggggcatcgatcttgaggacaacaaagtccgagacacaagaacacaaggcaaggaacttcaggttatggcatgtgtttaggatatgggagacgtccgattcttgaaacgcgaggttgcgcagggcaagattggtgagccacctgaaagcaaccgggcaagagtgagagaatgacatgaagcgttgtctgagcagctggcaatgctcaagggtgagtttaccaacatccgaccacagtgagaactcgagcaagtcggtttttccggcatcgacaatggccccaacggcatggccaacagagcataggtaggaagggtcttcagagaggaagaaactgagctgcattcacttgataattcttctcgtgttgctgttactgctggagggggatgacaagagcaggttgttgactgcagccgtgtaggcagccatgatctgatctacattgaaattcacagcgcggcgaggaggagcaggcatgaagtgggtgatatctatgatgagatgggagagtaagcgagggagttgcagccatcttctggagagcgtgctggtccgaattgccataggcaggtcaagtctctcaaggatttgcagcagaatatcgtcaggaagcgcgctgatcctgtcatctcctacagtttcgagttcctcctcctaaagaaaacaatttatacttatttatgcagtatatatgatcagcattcagcagcagtgcagcacaacacaagagctagcagtttattcaccatacacatatataaacatggaaagaaaaaggaattcttttttttaacaaaaagataataaatctaaggacatccaaatctaatttaacattcattgtgatcagcattcagcagcacaataggcagcagtttattcagcacacacatattatatactccctccgtttcacaatgtaagtcattttagcatttcccatattgatgttaatgaatctaggtaggtagatatatatatatatatatatatatatacatatatatatatatatatatatatacatatacatatacatatatatatatatatatatacatatatatatatatatatatatagatttattaaaatcaatatgaatgtgggaaataatataatgacttatattgtgatgaaacggaggaagtacatgaaggaaatttattgtttttaaccaaaaagcgaagatggatagatgcaacaaaaacaaattaagggaaaacctaattaaggagattgcaaacgaaatatccaatctaatctaagctgcgacttacgatagcgcgcgaagaagccatagtagtggggagattgattggtgtcgatgcagcaggcaaatcaaatactactccactaggttccttacaacaagatattagtcccctggcctcgatcagatcagatcatcagaatcggctccgcttccgcttccgcttccaattccccttccgattccgagcccaatacctgctcgggtggggtgagggaggattcctttcctcccttcttctgttgactgctcgagctccagctccagctcgtgaatcgtgatcctcccatggccaaggcgagaataggtggcggctgcagcgctctctcaatctctctctctctctcatagaggagaactagcgtaatagaagtcaattgagatcctcgcatacagtact

SEQ ID NO: 70788 - DNA, 11202 bp, Oryza sativa
agtaactgttttttcatttcaaacaaatcaatttttataaatcatttcaaacaaatcattccggagagggaataaaaaacaagagaggagatgttttcgtggcctccgcggctccacgcaccccacccggtcagctcagctcgacttgatccatcactgcccgtttcttagaaatctggtactgataatataagtgccagtttttaaaaaacatactgatgaagatttgatatgtgccgatttttttataagaaccggtaatatcggtttttgttacgaaccgataaaatatgtggttatagttatcggtttttaaattaatcctgtcaaaaggattggtttgcacggaaaacctctcatagatgccagtttaaacttaaccgacacctataagggcgttatggatgtgatgttctataccgtggacaaaagcatatggttatacacatatttatatttaggattttatatcagctctttgcatcgagatgtccttaagagaaatactaccgctacatgcatgatgctatagggtttggaacaatagccaaccagctcgcatggccagggattgaaatttcggtttgaaatttctaaaatcttagagcccccgcaagcaactatctcatccaaatattttgcacttatccaaatttgtgtgagtttggtcaaaatttattcaaattcagttaaaactataaataattttatgaaaaagtaccatgcgtgtaaatccccgctaataatcctaccgattgagggcacaattgttggtattggttacaatcacagataaatctgcaaacgtacgaataccgttgtagcacttcaccttagagtattttaaatatatcaaatcacaaaaaacgtgtatttgaaatctaggaaacaggttcatccaaggagctgaggatatatagaggggatttttatgggttaagattctgaaattagttaaggtaaaattttatctcttgcttcgggtaccggttttcccttggtctgccaagcgaatcaggtatacaactctatgatgtacccaaatgtggaggattacaaaagacagagaaatggttgtcaccacctaccgtctattctataactcgtggtgcacgcaacaaacaaaagtaaaatttaacttagacaccacgtctacattatcgattactactctagcctcgcacaaaaacatcattctttatttgtagccttagtattagtactagagaattaaatataaatattaagggatgaaccccaaatgataaaaatatatcttacttaaacaagaaaattaaatacccaaaaaatcttgaatactaaattttataaaagaaacatctgccgaggtagaagagtggagacactaccaacaactctggcacacctctagaagtccccgtctccccactctctctccttattttctaacactactagagagtagtcttgaatgaaattgagagttttccacttgttgagtgtcttcaaatgaaatgataaactccttttataagcatcctatgatggtagttaagttgttttaacacccctaaccgctattgggaagcaatgatgaagcgccacgtggaagctggtggcttggggacacatgggtggttcgcctgaatcactcccatcttctctggccaccgactttttctgtgaagctaacaggtgggattttatgatggtgcacggtggattggcatccataatgttggtttgctctgatttttggaccctccaattcgtggactcgcatttgattggccggagttgtatttcgttgcatggcgagtgtattttcatccaaaatctcttgcttacaaatatttcattatactcgtggaaaatggttagtaataaaccctaccactacgttcggtgtttcattttgtttagttttatgcagaagttgagggttagattcagcatttaaggatcgtcaacaacagtatttctttgttttttttgtctggattaatccactaattggtgccaaacaggcccaatacatatgcttgtaggagtattattcacgccagattattgaacaaaaacaagcctggcaaattcatcactccagatggatggaaaaacaacttgaatatatattatttagcttagcataacgtaattcaaatttcatcacagtgttttcattatcattgtgtaggaagctgactactgcaaaaaaaaaaagtccattggtgcccgttgggaaccggccttaggtgctagatttcccccgatggtggcatagatgtggagaatcaaaagtgtcgatttaggaaccggcatctttgaggtttcagaattgaaaaaggaggtcgcctcgaacgcatcgagccaatgctctcagaaacaacaattccataggtgaagaaatcaagaacatctacaatctagaacaaatcaagaacatctaccaggaaaaaatcaagagttcggtggtggaggcagggctagctgccagggtgggtggagcaactgttgccattgccactgccgccacgccgaggaaggggagtagccaccgtcgccaggggagcagcaggcgccacgttggggaggagggagcagcttccgatgccatcatgccgggaaggagggagctacccaccactagatgcgcgcgccagagcggccgccgccgccgtatccgcacgcgctagccaccgtcgccatatcgaggtggagagatgaagcgagaaagcgagagagaaacagagagcgagagcgagaaagacagagggggagggagtgcataaggtgggggtatggagcgacggaggtagtcggtaggattgactggctcaacttaatcggctcagtacataggtgccggtttttaattaaccaacctatagtataagggctagttttaatttagaaccaacacctatagactatagttgcttaaatgtattggttttttatttaaaacctatggaggtgagaaaaagactgtaggtgccggttttagcattttcagcacctatagtgccgatctctatgtgcctttttatagtagtggctatcgccagccacatcattatcatatatatctatctataaaataaaaaaaaaatatctctggccaaaatgttcagagttggaaataaactacatgaatggtaaaccaaattgtaactgcttgcagggtattagtttctggtaaaaccggtccttgtcgtttccgcaaacaaacttacggtcgcccttggggtgcaaaatgtcaaacccggccggacaaaatgcgcagcttctcttgtactggtcaagtggttcttctgcatgttaaagattaaaataattaataattttgaacgcacatatcagaatgaatattatgcatggatgaatggatgaagcatcaaataatagtcgagaccagtctagttaagaagaaatcaaagaaataaattaaagcaagttttcttttcaaacgaaaaggtgcagtgttactatcgatatagatggaaaaaatacaagatatattaaagctctataagactttaatcaggaaaaaagaaaagaaaaacacaaccacacactgacaaactaaagcaagttatatatctatgcttaccaatgatggtgcatgtttcaacaatggcaactggagcagggagtggatctggcagcagctgctcccagctgacaaatccgcttatagttatcaatggcttgtagtgcagttcagcgaagaagcgcttgatcttgttgctgctgcggctgcgagcccagaagttgatgtggaaccagtgctgccccttgaacaccacccttgcttgcatcaggggtttcactacatcgaactcaccaccctacaccggccgtgccaatcacgaatcatgcaacggcaaggaatcagtaattgggaaacataaggtgaattccatatttggccattaaggctgtgtttagttcgtgggctaaatttttttttaagtatacggacacacatttaaagtattaaacgtagactaataacaaaacaaattacagattccgcctgtaaactgcgagacgaatttattaagcctaattaatccgtcattagcaaatatttactgtagcaccacattgtcaaatcatggcgtaattatgctcaaaagattcgtctcgcgatttacatgcaaactgtgcaattgattttttttcgtccacatttactgctccatgcatatgtccaaacatttgacgtgacgaaaaagttaaaagtttgaagaaaaaagtttgaatttaaacaaggcctaactctgctcgaagtccgttttcaacgtaaactatatgcaaaaccggtgattttttgtcaactttggaaactggacatgacatcctaaaccaggttttatgatagttttgcttgatattatagtgatttttcagtagcatgacctttgattatgtaagtttcatggttgtgaacctaattgagtgatacatatttgcatcaacaacataggtatatataataattaataagagtatgagcaaggaaagccatcttcattttaggcaaaaccactaacaaatttgccctaaggtgttggttagctagtttaattttcaaagtttacatagaaaaataaccggtttgtagttcaaggtgaaaaatgaactttgagcaaaagtctaagaataaactttactcatttaattactactcaaattaaatgaatcgctcaaatgcacataccgggtgtctggcattgtaatggcggagagcattttggacgtgagggatcatccaagtgtcacgctctctgcatccaatacaattagagtagtttgattttgtaagttagttatatattcaacttgcgagatatacataatagccagaaaaatatacataatatacagatataattgttctgatctatcgaaaataaccattattttcagtaaatcatggtctccaaaatataatttgtaccacatctcattttatattgcaatagattagtaaaaaccttattaattatgatattataaaattattttgagacaaatctataagtgattttcatgtgtccaatattcataaaaatatattaatctctaacttttacactacaatatgttgaaaacattcgccaccaaaccaagaataatatgtccaaaatggcatgttttattttttacgagagcattattttggtgtgagtctcatcctcactaacagtaactacgtgtcgtaggaggcggtggcgtgcgaggcggacgatatggtctgagatagtacttttgaggatggagcgagtactatttatttcatattcaacttattactcttgtattttcaggcgtagagaaactaactgaatcgtaatgatggttaggaagaaacctatacgcgaatctaaccgccaaaataaaataaaataaccataaaaatgcacgaaattaatcctacacgcactgcaatcagcagcaaatctactggctagaatcactctcctttttttcaaaaaaaaaaatcctaatcgatcgggaggggaataggatttatacgtacttctcttggcggcgaatcttggtggaagacggcggaggagtgttgttgtatcgcattcgcctccacctccggtcgcggtcgtgcaggtgggtctccaggcggagctgctcgccgcggggcagctgcggcagaagctcctcgaacgccggcgacgtccatccactctcagatcccatcacccaatcctccatatatcactccaatttggtctcctctttctctctccctctccacgcacttcgattttcgtacgtggctttcccttttttatatagagaggagagcccaactgagccagacggttcggacccgtgtcaaaaacggagacgaataacgaccggcctcatgatccgaattatccgattcggatacatgctccgtatccgatggagcagttgctcatctgcagcggccgaataaaaaagacctatcgcggtccaccagatactcccgtaaacccaaaagctagatattactcaccctagttagggtcggagctataacgaaacagagaatggtgccacttgcttaatttactctactttagatcgagtttaagctgatacggttgcctaagtttgtattgaggggtgcatacatggtgaaaatagaagaggtatagctaaaaaaaatttcttgaccgggttactgggcacccccttaatatatactagctccgcccctgaccctagtaccggacaaattactctcttcaacccaattcaaagcggttttatccaatgtggcatacacgtggcaacccagtcagcattttcctttaaaataattggtgggacccatgtgacatacctcctcttcacctcttcctaatctctctcaggcgcaggtgtgtacggcggtgtgcggggtggggtgggtagtgcgcggcgacgcgagacgaggacggggaatcggtaagtgggctccgcgcagggaagggaaaggaggcggccgccgtagcaacagctagagagcgagctctgcaccggcgtgtccgatttcttcagcgccggcgtgtccaagatccgcgccgccgccaccaccagagctggccgagtgctacccggcatgtaatacaccgcgtcctcatcagacgacccttgcgtcagcgcaaacgcccctcaccgcagcggtgggagcggaccttgcggtacgggcagaccaccgttgagcagcctaccacgtcagtttgcatccctgctattgcgccagctctagcatgcgcgtggcctggcggcggcagggtggcgcgccagccggctcgtgaggaggaacgcgaccacaatggcgagtagcgcgaggaccgcggcgacggcaacggaggcgaccacgatggcagccttgggcatgccaccgcttcctccacacgacgcctgcgggtccggcctgctacgcgacgacaacacgtcagcggcgatcgtgttcggcagcggcgcggggagaagccttgggctgctgttgtccacgagggtggcggtggcgggtgttggggggtcggaggagaagtccgaggacggtgacggtgtccactcgatggggaagagcggctcatgaagcacctggcgcacgtcgtcagcgccgacggtagccactaccgagaggaagaggaggagagtgagtgagggcgacattgatgatgaggagagagagaatgtgtgtgatcttggattgtagagagagaaatataggtgtgtcccaccaatttttttaaaagaaatgctgacaggattgccatgcgtatgccacataggacaaaaccgctctagattaggagaggggggtaattcgtccagtattgaaagttcagggtgagtaatctctggttttcgggttcaagggggtaattcggtcgaccgcgatagttcggggggtaattcgtactttttccttttaaaaaagaaagtattatgcaacccctcctgctactgaggtagtccaaaagggattgcatagttctacaaaagtggagacacaagatatagggggaggcactcttttcattgattaagcacaagtgtacaaagtgagcagcctcctctttatatagccatattgcatatatggaatgtttaggtgtgggcccaattagtgtatatgggttgggccttcatggacccaaccccataggtttcctaacactcccccttggcactcaccgcgtgatgtctatgcctcatcaaaacttcagaaaaatccagtgggaaaaatttagagaaagagtacatagcatacgcttgcaatgtcacacgaatcgcctcgttaaaaaccttgataagaaactgctgggaaaacttatctaagagaaaagagtacaattcacctaattcttcgttcaatctttctagattgattttgggtacttgattttctatatcaagaatctagaatgagtcagcgaaattctcccccttaattttacatttttctaagtctcattatttcgattcctcggacacacctattcaaaagaagatgtcaataatgagttagtaaaaaaatatgcaagatttccacataacttagttggttgcttctatacaattcatgtatatagaaaagcttggagttcatgtgattaatgagctttgcttcgcaagttattcatttgcatatgcgcgacatatgctgctttaatttcatatatgatgggggttgagatagttttcaaaccactattgttgaagcaggacaaccatctctcaaaaccatgtcgaggctctgaatagttcaaccatacttagttcggtttagttcaattagcgaagtattcgtgtgctgctatgacactcttgtgtttgtgtttgggaattccgtcccattttggcgataattgacttcttcaaaaaccatgcaccttgaacattttctaagtgtggttggactgatgtactagacttccatctatcgcatgcctttagctgtaagcataagcatgatctggattcgtctgaatatttcaaatcaaactcaaattcaaaacaaacaagtttgtttcttcaattctttctacattaccctattcatcctatgttagttcaagacttagtacttcttcatgtactgttatgcaagtgttcgattcaagttcctaaaatgtattaattgattatatcttcaatgcttatcaacattcaggttgagttcttcttttcaacttctagttcattaattccattcaactcctggttgactgccaatgagttttgttgtctaaaaagacattgcccataataggtctcattgccaacttctattggttatatgagactctatgcgagtatccatggatatacaaggagatgcatttttcatatgcttcttctttctgcttaatgctttttgatgtgggcatgtactagcgttagtgtgcactccaactactggttttcttccttgatgggaagatgtggcacgcctgttctgaggtttcgtagcatttgccaggtgtcaacttgcctccacgatctacactccactactgcactaccacagcgagagcaatgaacgagtggaaggccactaggacctatagcaaaccgagcagttgcaccaacgaatgggattcaatgtcacgcccagaaattcccgaatagaattccaagcagaatgtgcatcaaaacccccgtccaggaccggccggggtacacaaacgacaaagttgacatacagatccacgtcttacaaacattataaaaggtcttacataaatgcagcggaaaattaaaagataaatggagctaagccttgacttgaactgcagcgggaacaacactccacaggcatcctcgacggctcggacgaagcctactcctcggagaagccaccatctgacacctactcaaactctgggttttggggaaaaatagagcaagactgagtacaaccaccgtactcagcaaatcatatcggaacaagaggtatgatgcaggatattaccaaaggatagctagagaggttcttttgcataaagcgagcatttataaacagtagttgaaagcagtaaaacagatgtaataattaatcaatattaaccatccactgtccaacgctacaccacgttgcaacaggcccaaccatccacctgaactaatcaattccataagactaagctagggtgagactaatcacggtgaatttggttgaccgcccataaccgcgggcacggctattcgaatagttttactctgatcagaggtgtacaactgtacccacaagacacagccccacgacacgttcccgtgtgccaacatgccaccatgacatatcagatagaggccgtgacagaacttttcgcataaccccctctaaccaagcacaccacacctcaggtttcacccccactcctcgcaaggcaacgggcagtcccctctcgtgcctaggtgaatccggaagccgcataggccgtcgcagggcccatccaaactccatcactcccacccttgcctggatgcgtcagctagaggaaagctacactacacgcccagccgttgcccacgctggcttgtggcaagtacgaggaattcttccagggtttcccgcgaaccggtccttaagtgccatgggcgcgaccatcaaaaccatgcacccacatcccatcatatggtatattttaattgactaacaccagaacagtagctttaatccaacaccaacactagaacctgatgtctaagcattaatgtgatttcccccattgtgtgctagttgaactaagcaaggctaagcaatccctagtccaatccctagtcatgttatatcccaagctaacaaaggagcatggtaccaaaaatagcatggctgtaacagtaggtaaacatcccatagtaacattataaaacaatgcagtatttaagggaaaacggtagagcatttgcaatataggatcaatatgttcaagtgacaagtatgacttgccttgctctgctgctggaggaacctcggcgactatttcaaagtacaccggagcgtcgggagagccggaatctaagcgacatacaaagcaaacaatacaaacatgctataagactactgaaacagagaacaaaaccatttttaatggattctatgcatttttcttgatttactgagacttgaatgggcttaaacggagctcggatgaattagatatgaattttagaagattcactgtgtttttactctaaacagaaaaatccttaattgatttattgcgcaataattaaaatcccgagagagagagggcggcgccgacatgcgggccccacatggcagtgactcgagggggcggtccatggtggaccaggtccacggaccggggaaggagcggcgaaccacgtggtgcacacgtggcgccgacgcggcgcacacgtggctgccacgtggcagccacgcgggtggtggggttggacgacggtgaaagtgcgtggcctgcgcgcacgggcggctcaagccggcccggcggccatggcgcacggcggcgtggctcgacgcagcggcagcacaagtcggtgaccggcggcgaccggccggcggcgaagggcggcggcatcgcggcgacgcggacggcgacagcgtcggctaagcggctcggcggacacgcggcaactaagcggctcgggagagagggaggaaggggaggaggggcctcaccgtcgacgattgacgacggcgagcgacggagggcgatggcgaca

SEQ ID NO: 70789 - DNA, 40573 bp, Oryza sativa
  unsure (1)..(40573): unsure at all n locations
cgtggggtggtgcaggagagagggcgtggccggcgggattcaaaattgaatcccggccgtttcagagtgggcgcgggcgggagagagagagggagtgggcgcggggtcgcggggaaagcgggcgcgggtggagacgtgggcaacgtggcccgtaaagcgtgggcgcgagggggcggaagaggttgcgggatgcgcggcgtcgtctggaggttgggggaggactcaacaggtgggccccacctgtcgacaaccccgggagagaggagggggctcgggcggccggctaggccgtggccttcggccggcccagcggggagggggaggaggaagagaatgggccggcggcccattcgaaaaagaaaaaaggggaaaaaggaaaagaaaaaggaggaaatgaattttcttgagattaaatattgcttgtgcttatttttaattggtttaaattatttctagagctctaaaaattccactaaaaatcttgttaggatatttcgacatgtagaactcaagaaaaattccacatgccaattccgattattatttgcattaatttattagggtttctctcttgcttttacaccgatattttctctaggtgatttataaattcaatttaggcttgagaaagaacttcagggtgtgacattcagccatgcgggtgggaggaggaaatgaaagggtgactacgacggcaacgacaacgcctccataactccagccacacgaatctacaatggtgcctaagcaaagcggcagcccttgtcaacgagaactacgacgcggcgaggatgaatggctacaccagctcgactttgttcaaccaaccgtatgggtattttggtcagatcagctatgaaaaaaaaggagaaaatcccattaaatggtaaatatggcatggtagcgggttgacaacgctacggagtctctttttaacaaaacgatttggtggagtagcattctagcgaaacccttttttaggagtggcgcaatatctaatttctcgttactgcatgtaattgtataggttccatgttttgtttattcaaggaattacaagaaatggagtatcagcttatgaatagctaaaaaatgtcaatgtgcatgcagcaccttagcgttttatatttatattggcaaaaatagtgcaccttagcgttttatatttatattggcaaaaatagataatagacaagaaagcttaaatacacaacatgcatggagagccaactgaaagtcaaaactaaaaacggagagccaactgaaagtcagaactaaaaatttaacaaatctaaaggttgttcggttggctgccgaaggtgcaacgctttattttgccacaagacatacacaagtgtggcaacatgtggctagaaactttagggcgaaaccaaaccaagttgaagtgtggcaaactttgtactactatttggtaaggtgaagtgtgacaaatttagtaggctccatagaggttcaaaaatcaactgaaacacaacttttttatcatacaaactacttatgtatccgcctaacaaccactaataggatacactggcaaaggacttttttatcatacaaactacttatttatctgcctaacaaccactaataggatacactggcaaaggattaagttgatccagatccagagggagaggatctaccctcagtacacacactttctccagctcctcaaatccgatccacctacttggcccagtctgcgcatggttatcccatataagaatctgtagctcccctccacgatgtctgtaaccataacagacaataacgtggttaccatttgtctcactgatcaaatcacagatatcattgtccgtggcccttcccgcaacaagagcgtcaatcagccagacgtctgcagcagttctcaactcagggggtacccacctatagactagttcatcattaactgaggcatcaataaagtggtataggagggacacccgaatgattccaatgtaagggccacccgtgcgcaggaggtgcacagcgcgctctcgtgtgagactacctttttggcggtacatccgccacgatttgagcgggaggagaaagggggctggtggtggagcattggttgtgcgaataccacccatgccctttatctttttcagtaaaagaaccattttctttgattcgactccctcctctgggtgcaaaatatcatcccgtatgcaggccctgcggagcttgcgaggagctgcagcccggcacaggaaggtaccaggaccgtgcagccgctcccactccaaacgatgtagcgcttcaatgcatacagcacatgctaaaatggtgcaggtatctgcaggtaaaacacaaacacaaggcatggttaattaatctcttggcctactttacgaagtgagaaatcaattctggttagtactcacttggtattgtttgtttcatgggattacccattatggaccaccaactgaagtccgcggagaagttacgaaccacagagctcactacagtataggtgctttcttgagcatcagcactaagatccttgtgtccctcacatcttgcaccaatctgacaaaaaaagagtgaaattagtgtatgcaactagaatccatagttaaacttactattttatagtatccataaaagagatttagtcgtacaagacctcgtgtatatcatgccttttttttactagggatgtaccagaaaaatgaacatatccactggttgcgttctgaaatacacatccaaatattcacaattttttaaatcatacactttcatttttataatgagtcaatcagtcaaacctggtagtgtacataaggttgcaactgaagaaatactaagaccaagcattccagaaaacaagaaaaaaaaatgtaacagaggctgaatctttcaacctaacagtgatctaagtgatttactagtggccaattaattccacattgccaaattccatgtacacatttatattaacttcatctgtaacaccatttaacaagactaaaagctcaatcatttgaatgtaaaatttcttatgttgtgatataaacaaataatctcccatgcttttacagttcaacgaaaatgcatcacagtaaacggcaaaccggcttagcgcaatcaagagcaactaaatctcaaatgtttcaacaaagcacaagatatagttgttgcatgtatcaaagtttcgtagcacgtgtttaatacagtcaaaacaaaaggccgatttccacccccaaacatttttcttaagtaatttcgactctactctggatacctaatcatttaaaccaagaaaatctctggattacagcaaatccacaggattgatagaaatgaatgacaccaaaggttccagttccaaattacaacaaaccacgttgacacaagaaccgcatgtaagcaacgtaataatcccaacatttcacccaaacgctaggatcccaaatgccacattcccaacaaaaaaattgacacaggaatgcccagcgtaaactagaaaattgagtaaacttcagcttactttttctggaaatattccaggtgtgcacgaaatctcaagaatagatggcttcaggacttcttgatttcttatcacaaaatatgacagcaataatagcatgaccatgagcatgtacatgtgtatccccaaattacacaggcagccgaattacactaaatgagatatggtttcacctcaacaaacagaaatcaagaaatccaatatcctaatttaacattgcagcaaacatgaaacgcacatgaatcaagaattaaacatatcatcattagacccccaccccacccaagaaaagcaagaagtgaaaaattacctctagaaggtgtgaattgctgagaagagcaaatcttggccactcgcggacttctctctcgtcctgatccaccaccgccgcagcagaggcggaggtcgatgcctcggtgccgcgccctcctgctcctggtcctagctcctcaccgctcagcctctcgaagggcggcgaggacgagctggcggcaccctcgcttgccgcgcacaccttcctctttcccttccggtcgaccaccgggaaggcagcagaggccaatccctcggcgccgcggcctccgcctccggggtggtcgcgggccagcttctcgccgaggcgccgcggcgacgaggaggcatggccgccgccctgagttgccgtggaggtcttctttccctcccggtcacccaccgccaccggggaggcagaggccgaaccctcggcaccgcggccgctgccccgacctccgggctgctcacgggcagactcttggcgacgcgcggtggcggcggcggtcgcgagggcgcgttggcggcggcggcggcgctgggcttatggtgggccgcctcgtagtccccgcgcccaagaacccgttcggtggtgtgcccgtcccggtcttttgctgaaccgggcgccattgaggcgggaagattgaaagaaacggaaagcgggggctaggtcaaaattcttgagaagttgagggagtgaaggagaaaatgcgttcagaggcaagggtatcgatgtgaattatgaatttataggatgtagtagtactaaagagactactaatcaggttattgagtaacgagtaaaataataataataataatagaaaaatctgatcatattaaaaaagtgaggaaaaattagttttgcacaagccacgttatgaaatatagtaccattttctaaaaacaattccatccatattaccccgaatatttttcagcgaaaccgttttgaaaccgttttaaggccacggtgcaccataatgatatgcattttcaccttgtcgtgctataccaatgccaaatgagagtatgagaatgttcgtttttgttccttttagaaaatggaattgtgactcaagcaaatctttttggcatataaggaccaaaattgcttgtttgtccatgtttttcatgtatgcaatttatatttgattaatcatcaagttgagtcatatttagactaaattatacttccaactttggtcatataactactgaatattttgcagtggatttcggtgatgacagaaatttcaaaaaagaaagaccgagaccaaattgatcagtctcaccaaatgcccacccctactcctacatatctgaactaaattagcgtgacaattgatcgggtcgagcagcagatatgtggaactgctttgtataacaatttgtactaaacgtgcatttaccagaaatgatatgaccagatattctgcaaccttgtacggagagtggcacgtatgtctcactacaggaatatatgctgttacacgacgaatcaagaaataaagaaacctatggaacccagtaataatggtcgaaagaattgcatgccctgccctttactcctataataactgaactgaaatggctacccagtagtctcctgatggacaacttctggaaaccgtaacatcagctccaccaatcttattgtgctacagcaaagttacttttttttaccagtgtaagtcacaactgaacacagaagtccgaataccagcaattgcaattttaacgtaaaggaggcacgaggataggtcacaagaaaggcaaaggataaaagttacaagcgttgtatgatactatgatcactattttatcttccatccgacaacataacactcacgatccacagcatgcagatttctgcaaagttgtggcctcagcatcaccctctggtttgttgatcttgatcgtgcgatcctgaaaatcgagcatgttaaataaccttcaagtatcatgttgctaattttgaagggaagagaagatggagatttatacctcagtcttggaatcagtctccgcaagtctttgcttaatatcccttgctattgaaaagaaaacctgctcgacattcaggtttgtctttgcactctgtagccaacaaacaaattatgcacgtgtaattatatgagaaaccgtgcattgcacaactggttacatattattaagacagaagcgcagatattaaaacagattaacaactaaccgtttcaaagaacttgatgccatattcatcagcaagtgcttgcccctttgaagttggtacggcctgtgttaatataatacaaccaattaaaaattaagccaaaaggtgtccaaaataataatttgaagactggagtaatccccaagataacgctatataccatagcaccagaaagatagctttcatacattgagaatggaacaacaaaataccaaacatttaattgcttttattttttgcattgagctttttcacgtcttgattttaattgctattctgcattttagttctataaattattgctactcatcatatatatcattgtgttaaaacagcattatatgcttgtatggaacacatactttgatagtctgtactttcttgcaaaggttatatgagaaatagttactgagcagaacatacccttttgctttcatccatgtcagctttgttgcctaccaaaatcttgttcacattatcggaagcatgttgctctatgttcctaatccagtttcttatatctgtcaataacaccaccaagatcagaagtggaaggtgaagtgccataacagaagattagcagaagtgaaagagtcggtactattaaatgatgactcgtcggtgacatcataaacaagcaaaatacccattgctcccctgtagtaggctgcattgcacaaagtattcagatgaacagcagtatatccatgtaattgttcaaaacaaacttgacttcaactgaaaataaacaaccataccagttgtaatagttcggaaacgttcttgaccagctgtatcccagatttgaagtttaatccgtttaccatccagttcgattgttcttattttgaaatcaatcctttttcaagaattaaaaataaaaaagtttttagatgcactgcaataacttgtacaacaataatccagtcaaaagcttcttttctaacttgtacagcacttacccgatggtggtaataaaactggtggtgaaggaaccatcagagaaccgtaggaggagacaacttttcccaacacctatacaaggatttttttttaaaaaaaaaagaaagtcaggtgcattatcagacatatgattagtcctacaggttatagtatgtttacaacaagcacgatagcgagtccatgaaaaacaacttgatgaagataaagtggaaatgtaaaacggataccaatatacgatcaagtcatacattcaacaaacatatatcatttcacattttccactagaacatctacacaacacttaagctagccagcttggcttcttctcaataattaaaatttagtaaccgtctaaatacaaagatagatctggttttaatgataatatggatatcatatcatatcataccctgtggtaagcaaactgttattttaggcaaagaagatcaaaagaagtgcaaatcaaaaaaaaaatattgcacttcttttttgttacaaacgaccatagaattgttactgactgaaaaagcagcacccaaaaagtacaaaataaattatcaaggacaatggaactagagagaagaagtaagcacttctgtgtttctttttattggcttcccagttcccagaaaactcaattaagtaacattcattgagaaaccagtatatgtatttttcccataattttaatgatggtgtagccacaacgtatggcatatgctactgaatgagatcagcattttacttcatacactaaatgcgcttgtagtttgactaattgttggtcaaaacctacaaattttgactttctggaattaaaatgtccccgataaaaatcacagaaggagtagctagatgatatatcagtgtgacattaactagctaagtcaagacagaagacatactactaagtagtttgagatccgtgttgcagaactgtattaaggaagagagttgaaaaatgcttatcagctcacaagtcgacatacaagggatcatgagtttctttactcactttgattcaactgagtagacgtgacagagctattaatgcattcagagtttgcttaatcaaggataaggaacgaaaggaagcttaaacattcacaatgttttcacatcgcaagttcgcaacaaacaataacagtcatagaaaggtttatacataaattttgagtagtcttactgcagtgatgtctattggtaagataaccgcatgtatattgtgcattttcatgagcaattgaacattgataataaaaaatttcaaagtaacaaacagaaaaggaaaaaaaaaaagctcttgtacagtcaacattcacaattcctgtgcttgaagcaactttgggtcttcagcatagctcctgagtggaacatatgcaacttgtcggtgcatgcacgaaatcactccaggctcatcttgcaccaaaacgtcgaaaatgtacggtaatccgattcaccgaatcgggtagctgttccacgcgagcttgagcgcaaagcaccatgtcggctgatcaaaccggcctcagcgatccaccccgacccagatccccccacccccaaactcacctcacaccaacaatcccaccgaatcggaactcaaattcgcaggtgaaacccaaccagatctcgcgcgcgctgcgcgggatcgatcgccgagcgcgcggcgaggggagagcgagcgggatggcgcagattcagctacgtaccgctgtcgccgatgaggagcagcttgatgaggtaatcgtagtcggcccgagccctcgccggcggcgccgccatcgattcccccaatccccacactagagcgtcccctccccctcaacggatcgaactgggctggcggactggcgcgcgggaggcgaaccggatcgagcgatctcgctacaggcgaaggcggcggcggcggcggcgggttccggcctctcctcctccggtcgccgagccctcgacgctggctgcggcggcgaggggacacggacgcggcgagatcggagggagggggagagagagagagagaaggggaaggaaggaaggaaggagggtggtggtggtggaaccggtccaccgtggacttttaaatcggatggattttcacttatacacgcggacgcgggtgagaaatgaaatctctctccagtttgttggtttgatggagcatggatttatttatacgaggtttgaaatttttgaatttttttagaaataatactatttaatagaaaattgtaaaaatatagatcgaccgactaaaaccatattgttcgataagtacctgtcaaactacggttgttcgtaggtgttacgtgctaaaaaataaaatttaaaagctcatggtgcagtgcacagtctgccattgcagttgggtgttgggtgggaggacctattgaacaaccttgcctcctgcatggatgttctcttttcatatatttttattttttaaaaaatacactaacaaccatatcgaacaaactgatgtggtacattcagtactaatcgtattaaaattgttcgatatgtactctgctgaactttggttgttcaacagggtaataaactcgtgattttagttgagagacctctattttcacgattctttattaaaataatattatttctaaaaaaatccaaaagttttgaactgctgaatcggggatttgcacacggtttgaaattccggactataccctatgaaatcatcaatatgattatatgaatatgaaaaatatatggagtggaaagatgttttcttcaagtgaaatttatatgaaaattcttataataccatatccgcgagtagttcaaatgcccaaacatgaagaagcactagaggtttaattcgtagtgctcgtaaatattatgcacggctcccattacccgtaaatattatgcacggatgaaatcaataggaattagttaggtcaaagattttcatctcttctagaatgcgctagaaggtgcgaaacccagtgggttagatgggttagatcccttgtgtaggtgatgtatccgtcaatagcaagacatccgtaactgttgtaggttcgttaatattaagatatactccctccattccttaatatagggcgcaactgcttcaaaccctaataccaaggaggcttaactgttttctcgaggtgacgacgtatgcaacgcttcgatctgcccgtgtgcagcatgcatgcagctcttcgcatctgcaagagataagcaacccaagaaacgaagcgctaactccacgcattgaaagcgcaccaagtttcatgcttttgttttaatgctgcttgctgcatgtgcatgcacgccctatattctggtgcacttcaaaaaccagttacgtcctatattatggaacggagggagtattgtttagtatgtgctcatgtatcgtgtatgtgcaggtaccgtgtttcaaaaagaaagaatgggctaggaggtatttttataaggtgcttccatggagcaaagtttctatttatttttataaggtatcttgtgatttttttttaaaaaaagggttttactattttagttatgacgaatatttgggctcctattttttttatttttctttgttaggatctttcatcgagattcgtgttcatgtagatctaacttgtagttacactcaatcatagcgcacttagggtatccacaatgtagtgtaaaagtagtccataagcaatagaatattccattcagccacctattaccattgtgcaactagtccatatagaaaaaatagcaaaagatacccatatggaataaattatattatctatctctactcctctctcttctcctaatgataccttgtatctagatattgccatagggataaactatttatgtggtcccatctatatggatcactgtcatatatattggtgatgcccttatacttggttatggagcacttatacttcataacagagcacctaaaaattagattttataactttgtttatctagatttacaatttttgacatgattattctttttttatttcattcaaaacgggatatatgtattggttgaaatttctacaatatctaaggcagtgtttggcaaatgggaaagggaaatgatttcccacccatctttaaatcctaaccatttattctccatgatccatttaatcctaactcttcattaatttcccaatcccaatcccaccccccatttcccattatccaaacacaccctaaaactccaaatctattgaaagataaatagattgtcctcaaactttgtgaattacgaccaacaaggcaacaattagatttcaaagtgttttcatatatttatacaaccatcacaaatatgttttaagagaaataatcggtcaaagcttacgaagaagacagttttaagttaaaataagtttgataaaaaatcagcagatagtgatttacacaaggaacagaaatgatatgcaggagtaatagggagaagtcatctggcacaacaatttagagaaaagaagggtcgttttggctaatggctgctgcaatacaaagaggcaaagcgagaagattaaaaaaacaatcgggcaggccacaaaaatttgaaaaaaattagcataaactttccatttgcctacaattggcaatcaaacaaaaaagaagtgctcaactagacatccggtaaattatccgcaaaactgttacatcggtagaatctcacagctaaccaagatcatagttcaacagttgtcgagaaatagaaacttcctatgaaacttctgaagagattacattttctgtatcatgtcagagatatacttcacaatccaagggtgatgcaagaaaaaactttgcaatctatcagtcgtctctctttggcttacgatatgtttcctcaatatgcttggctaggaacatgtacgtgttgaatagcttcttgacatttgggacgtcataattctgagctacatagacaccacatcccattccaaacattaatgtgaagctggtcctgaagaaacccattgcaacaaaacctggcaagtagcaacaagcatgaattggtactatcatccaagatacagatttaatgcacccaacaagcatgaattgattgtgagatcagaataaaaactgatagcattattatatttgttgccagaatatttttctccaaatcatattaatgcaagttgtgtaagctaaacaaactcatggcataataacatatttaagcataataaaattaagtaacaccagtttagcatcaagaagacctgaaacaattccaacaggcgataagtttcttagcatctacagaaacatatttatacaatctgtgaaagctaaaaacacaccacagtataccccatccaagcataagagtagcactgatttagcttttcaactagacttgaaacattccctacaggcactaaattcactagtattgtggactgtggagtaatgctgatattgtatcaattatgcttcatgggcaagccaagatcaggcatgcttcatgggcatcccagctgggcagatgcaatgggcacaatctgtcaggcacactgttaatcatacccagaaaaaattgagctcagtttctctaaataattcataacgacctgaatcccaacagggtttaggaaaccatttacaacatatagtacatacataccgaatggttatagtgtaattcaagtaaatcgtgacaagattctgggcgctggaatacaaataataaatcatgtttttggcatttgaacttgcaaatatgaaatggttctggaagttcttgtcaattaacataagattctgggctcagtcctacagaattttttatgaaggaaaaataaaatccttttcctagttaaggcttacagcacagggaagcacatttggattgttgggcctatagtagtatggaacacaaggaattcattatggtttcttttatcaggaaattcatacatatttcataggaaataacttattttatgcagaaataggtaaaaagaaaattaagtctccagggttcaccgaaataaccatatcagtcagtcccaggacataataaaaaaaatggaagcataggcctcaatgctataagaaaccagcacaccgccactccaccagcattgagaggcaaagttgggaatcccacagccaaatcgggcaacaacaacaaaaaaaggtgaagtgcagatcgataggttttgttaaagcatagaagaacgacagatcctttgccaagtattttcttgcctattggatttagaggcccttctgctcaggtattgtgatggacacttgggcatgaacttcatatgaaatagtgaatactttctctgtgcatggcattgaccagaaaaagcagagcatcacacacaaccaaaatatatagaaccaatctagaacatattgctgagaaccaattttagatcccctaaatatcatagccatccatgggtcaagaaaaagcaatcacccagagctgcggtgaaaacgcagccaaatcaatccactgataaggatggcaaaatctactcaatgatctacaatccggtgcttgaatcgtgcaaatcggattgcaatgcagtctgcgtggctcacagcacacacagcgattcacacccnccccccnnnnnnnnnnnnnnnttnnnccaatcccttnncttttaacccaacttttttttctttttagaaacttcacgacttgctactagtccactacaaggtgaaggttaaaccttcataaaaacagctcgataaactttgccttgattcaaccgctcgcaactatcctagggttttggttcaatcaaacaacgtggggagagagatcgttactcacttggaatccgccgccgccgacgccgccgctcctgctcaggctgctggttcacctcccctccctccgccgccgccgttgatatttcctctcgccgcgattccccaaccctagaatctggagacttctctctgctggtttttttctgggttctctcgttgaagcagatttttttttaatttatttttatttcgggtctcgcacacactcgcctcgctttcgccccgatccgttccgttcgaaccgaactcgtaaaacggaggtcagagggatcgggtgagaagtggaaaccggatcgtaaaacagtattcctccaacacgaataggtgtgcagaatcttttttacttttaaaactttatattagaaaaaaaaaatagtagagaacctctttttgatggtcaaatatttccgttgcaccgcggcactgcattgtcttgccatgctaccatggttgacgttgtaaacttatagaaacaaacttaaataaaataaaccgatatataacctttagtacaaacgcgagataagtattgggctaaaattccctttatatgaaggtttgcacttaaccgttaaggaacttaaaatatgaaataggaaaaacactagagggtgaggagagtggagaagaagagaagtatgtctagcctgatggctcttacctaatcctcttcaaattatcaattggaaactcaagcatgattggagtaaaggtttatcaaacttcgtgagttcattgagaagagtattatatttgagtaaaggtttatcgacttaggtctacatattttagtacctatcctattttatacaatgtgagtttatgaggtcaaacaatatctaactgggttaactttttgatagcttgaaaagaaattcatagacgatcatttttgccaagtttcgtgaagaacaaccaagaacccataagacctctttggcacatctccgaattcaaaatttgttggacctgcctatttaaaccacataatttaatatataaaatttaaatctatcgtggatttaagataagaagctgtattaaataggacctaagatagagtacatgaaattaatgttacaggtatattcttgaaaacaaacggttaatctctcgggatgattttttgaaactaatctctagagaggattactggcatgactaccttcctctgtcagatttctgaaatgaatgcctatttgtctgctctatattccgtaagcaccagaataacaatggttgcttttatgcctttatccaccttagcaaaatcttcaaaacaggctaaaattcctccctttctcctgtacacaggcctgatataaaacagacaaattttcgcacacaattccatcgagcagatagtacactgatctagacgttacatgaggaagaaagcagagttagatcagatatgccaacattctcagacggtaactgtagtctggagaggatcatcagatatgcctacattttcccaacaattgcctgtacctgtatgacccaatttagtatcttggcccagagatctaagcattctgcaccaagcaaaaaagaaaactcattgaacaaataatgcataccaaccatcatctttgcccataatctcattccaactgacgatatttctgatcatgcaactgccatctgaaaattactatttgggtggactactagatcatgagtagcagcaacacaggtatgtgcagatacagggtgcaaagccatatatatcggcgtagctggcattactacgattgttcttttcatgtctgaaataacagtccccatctcagcactaaatagagaaaaatcttcaaaaccttttctttcacttcatcagaaagattggtgcaactgtttacttcatcagaaagattggtgcaacagttgaaacagtttagttcatttccatcaatttgtgaagcagttgaatctgtaagtaacggatctaagcaagattatggatgaatgtattctcctagttgggttttgtattgtctgtcttcaacattcatccaaagacttatttattcgattcgctgtatctcgaacagaggtatgtcccgtttcctcctcttgcttttggttagtggctttctctttttagaagtatcatattcaaagtttgtttagaagaagcatgccaaggggtcaaacatttaggagagataaaaacgtgagaaagaatcacttaatgtggcaaaatttgtgcttgtcctgtatcagggcatctaacatgacatatagctgcttacctgcttgtaggaatggaaagagaacctaatgcacagaatttactaatttcaagtgaataatttttgtaaaaaaaatcctttcaatgtcagcattttggtaaaatcatatacatagacacatagtagaaaaacacaaagtagtcagaacagcatgtatggtttgtatttacatatatagatgcaagagttgtatgtcaaatacaattctactttcacataatcatttagtttagttgcacgggaaattcagctaattatctttaaaggcataaatctctactcaataatttttacacgcagaacctatgtttgaacaaataaaccttctgccatttagcaaacaaaaatggactatgccctatgttgaacaaaactagactatgccctatgttgaacaaaaatggactataccctagtggccatccttgcatcattgacaaatagcaatcccacaacattaataatgttatttactcttccatggtgccagggaagcttcttcatggccatgatggtgcaagtatgtgacaaaatccaaccacatgacaatatctgcacgagggttcataaaatgtaattggcatacactcccatcgatcccgactatcgttttgcagaaactaattataacatcatgctcttaccatgtaaggaacagcatagagctttaacatcttaagaggccccatcacaaaggtaaccagcgagaatcccaaccattgctagccagttgatgttaccacatccttcttctcatttggttggaacagcccactgcttgggttcaagtgtgaaccttccctggactccttgcaaactgcagacatgaccccaaacaaggaatttactatgacattacaaaataagaaccttcaatacacttgtcaatgaatgtcaagaagctcttgtcctaaccaagaaaaatgagaatgccagcatgggaaatggaatggtgaacctcaagcatagtctgtacagacgcccaggcagttgcagattgttacaactatagaaccatcaagcataattcgcctgtcccctatgcagaattcctcacaaaccacccaaatacaaaggtgggtgatcttctggcaaagctgagtcattacctgcttggacttcgattcagcttgcaggatcgctagtacctccttatcagggttgacccaacacctccctgcacgttaaccacagaacatgaatcaaagcttctgtgttcagagaaacagaaagtcagaaagcaatggtagatcagctacaaaacctgttaagctttctgcgtcagaatttgttgaacaagagaagcagcagtcagaatttgctgaacaagagaagcagcagaaaaattgcaatgcctctgcatgtgtgagccggtgctcttccagagctccttgtggctggcatctgctcctctgggaaggacatggatcaggatgatccagttgctggccttcaccaggttatccaccgcctgcctcaccacagccttgctaaatggcgagtagtccatgccgactgccgatgataatggttcgtaggtggaggtgaggatgtctggctcatcaaggtgaggtagcctgttaatgcgcttctccgcagatgaggaatatacttggcatcagatggctaataaggaattctccttaaatcaatatacatttgagccacaatctctagtacagccatgcacgtgcacgacgcagtacataacaatcttcagttactcagttagtcatcatgaatggtcaacaaaatttcaccagaaatcctcacaagaacaactagcatccttgaaatgatgaaaccgatacaagtcacgaacaactatttccctacctgtggccagacttatgtacttgatcgcttcatggcaatcctcacaaacacgcagattcttgaagatcctaagtggagtcccacttggagtgctgatgatcccaaatgcaatggccagcttctcactgtggaacttaagagctgtttccctttgttcatcctctacatcatgaacaacaagatcagttctacttgtgtacccaatctccttcagtctctccaccagcttctccaagtaagcataaatttcagctgattgtgggtgtgacgcatcccctgcaacaaatgtatgcacagtattcttcaggtggatccaagatcgaccaggctgcttcctgaccttcctttcctgcattgaaactctaagctcaaaagtgtcgtgccatttgttgttggttgcatatatgtttgacagcataacatatgatccagcatcgcattgctccagttgaaccaatttttcagaagccaattttgcatattcgttgtgctggtgaagtcgacaagctgacagtagcgtcttccaaacaatagcctcatggttgatgttgttttcctcaatgaagttctttgctttgtcaagcagtccagatcgcccgtaaagatcaacaatgcaattgtagtgctcaatgcttggaacaattccatactcctcttgcatctgcttaaagtaaagctctccttcactgaccaatccaacgtggctacaggcagatagaacaccgacaagggtaatctcgttaggagtcattttttctgctgtcattctttcgaagagctcaatagctatcctgccttggccatgagatgcataggagcacagcattgaagtccagacagcaatgtttttggtgcaagctctgtcgaatatgctacgagcatcttcaagggtgccacacttagcatacatgtccacaatggcagatgccaatggtgcatccaatttgtaccatagcttctccacgcagccatgcacttgccttccttgctcaaccatcccaacatttgcacaagctgcggctacactagtgagggtaaaccgatcagcagcaaccccttcgcgcagcatccttcgaaagagatcaagagcttcttcctccctgccattctggacatacccagcaaccattgtgctccaggcaaagttcatgtctctagtgagtggtgaccaatgatcaaagactgacgcagctgcctccaataagccgcatttgcagtacatgtccatgagagagctccgaacaaatgcatcaccctccagtgcagcaatcaaaacacggccatggagctgccggcctaggtctggcaagagaagcatgccggccaagacaaacgctgtggagtaagtgtagtgattgaacaccactccagcttgcgccattcgacgcaggtggctcagggcgtccgcagcatgcccactccgcatcaggccgctgatgattgtgttccagcttgtagtgtcacgcagcggcgattcatcaaaaagctgcatcgacccaaggatatcaccggactgtatgcatgcaccgatggcaatgttccaggagacggcgtctctctcggccattgctccgaacacccgcctggcacgctcgaactggccacacttggcgtacatgtcaagaacagcattgcacagcaccacgtccagatgcaccccgttcctcagcatccacccgtggacgcgcttgccggactccacatcgcccataccggcgcagcacctgacgacggcagcaaggacgaacgcgttcggcgtggcttcaccttcggccagcatctccgcgaacgcgcgcattccgtccgcataccggccgcgccgtgcgcagcccgagatcgtcaacgtccacacgggcgcggtcctcgtgggcctttcgtcgaacaccccgcgggcgtcgtggaatctgcggcgtctgacccagaaccgcaaaaccgaggcacgctcgtggggcaccgtagccaagcgtgcctcgagggatcccccgcgggcggctcgtccccgcaggaggagggccgcagagaagggatgcgtggaagcccgcggcgagagcagccgagccgcagctttcctcgccgcgcacatcacgagctcgctggccgccggtggagccgtggaggcgagggaacgatgcgatcaaggccgcgcgcatggaggcgatgatggcggcgctggagcgcgcgcgacgaggcggatgcgagcggccgccgccgcggcggctatcgcgaggaggaagaggagcgaagcgaagaagctggcgagaggggcgcgacgtgggccgggaaaaaaaagcaattcctaggatgaaaatgatttcgattcaaatctgattttgtttatatttgaataagatttcaaagttttataacaaggataggggctcatttggtcctaagaaatttcatataaatattagggctaatttgaaaagcaggattctcaaaacataagaacaagaaaaaaaaatgcaagattaaaatttcatcacaccttaaattctaagaaatggaaaacacataaaaagtatataagaaaccgtttagatgctacacagaaaaaaacaaaggatttgaaagagagatagacagtaccaagaggttagatcggacgcgttttgatgttgtgctaaatagtcggtcctacgtttccatcgtgcgggacgtatatattttcgcaattcttctaaaaacatctatataatcgcaaaaacttcaaaaacaagttatattttcaatttcttttttctaaaatgatggcagaaacaagttatattttcaatttcttttttctaaaaggaaaaagtaccttttaccctctgaactatttgggtcgttcgaattacccccttagactctaaaaccagttattttacatcctaaatttttcaaaccggccaaattacccccctaagtcaatccggggtggtttggtttgacgtggcgcacacgtggcactagtttgattgatgtggcagtccaacatagaaataacaataataaaaatggtgggccttacctgtcagtcacctattctgattatacgagagagtgagagagggcagaatgggtgtgggcagcggagctcaaggctaaaggccatggagagcggccactggcgtggatctcgtcgcaccggccgccgaatctctctcacctcctctctctcctcttcctctctctctaactcttcctctctctcttgcgcgcggcagcaggcgggcggcacggaggcaacggtctctccgcgccatcgncaccggcacccgcaccgggttacggtcggacaccacccgcgtgatggcgtactccagctcggcgcagaggaggtcgccacccatgatgaggcccatgccgagcgcacggagggcggctcgtcggtcgtcgtgcagctgctcccatgccatctccctcgctgcctccggctgtcgtccttgactcatcgcccgcggccgcagctgccttcaccccctccggccgcagctgcctctgcctccgcgccacagttgcctcatctgctcaccgagagagagagagaggcagagaagcgcttgctcttcgcgacgccgtagcccgctgcccgcagagccgtcgtcggctccagctccccctccgccgccgccaaccgcccggccccgcgcgctgccatcacccgcacgccacacacgcctgctcccgcatcggcgccaccgccgcgctctctaccacggcatcgtcggtcacccactctacctccgcctcagccacccgccgcccggggagctccacctccgccgcctgctgctcggggagctccgtctccgtcgccggtcgcccgctctgcctcagacaccggccgcccggggagctccacctccgccgccggtcgcccgctgccttgcccgagtgtgtgcgtgagagagattgaatggttgagagattgtcagattggtttgaggataggtatgacaggtgggccatgttttttttttgctggttagattgccactttggcgccacgtgtgcaaggtcaagtcaaaaccactcaaaacagtgttcaggggccttatttgtccggtttcaatagttgagggtatagaatgtctggtttttgagtttaagggtgtaattcggtcaactgcgatagttcacgggggtaaaacgtactttttcctttctaaaatgatggcagatagtgaagccagaggaggggccgcctaattatttttcacatgaaattaccccttcatatgggacaataattttttttctccaactaatgtaatttggaccaataaagtctcccttgatgaccgaggcagctagaagatttttccatgccatgtcgacgctaaattatgatcatacaacaaatatagacggtttccccctaccgtttgctatattgccatccgatggatagaaattaatccctcgcactcgtagttacagtgaataaggaagtctaatttgtaaacagatgctacactatgaaaaaagaacaatatcttccatattaaacaagagttgtttatgttggtgatattttaggaatcaccatggtaaagaggaattgaagacgaatctgacgagaaagagtcgtagatctagggataggttttagtgccacggtgtacatggtggggctacagtgtaataatcatgaaaactgccaaactattttcacatgaaattcccgctccaattagtagattttttgctccatctgatcaagaggtaatgatccacattcgacctcccaatccaacataatcaacctagtgcctctccacctcccaccgagacgctgccaccatctcacatgcagggtgtggcacacgtgccttctgtcttgacgctggaggctgccggcaacggctccccaccttgccgttagattgccatccgatgaacggatattctgtatatatgtttgcagtgtattgcaaacatatgctacgctcttacccaaaacaatccaatctatattcaatacattttctccatttgtatttaaatcaagagctgtttatgttggcaagattttagtagtcaccatggaaaaaagtgaatacaaatctagcgagaaaacgtgtacatctagggttagggttggtcctacgatgtagacggtgaggttatagatattaggcttgatgggatatgaagtggccgaagagggtataagggtcatgctacatgaatttcatctaaaagtgacagaatagcatctcagctatctaattttctatcttgatgagattttaggattcaaagtggaagatacattttttaaatttctaatagcattattttatgcatgaattggattacaaggagatttctaattcccaagaagtaaggatttcgagccactttcatcttgtcctttagtatgttgacttatattctgatgagattttagttaggactaaaagagggaaatacactttttttcaaataaaattcaagtaggaatttcgaggcactttcatgttgtccttttgttatgctgatgaacatctatgaataattaatgcgcttggtgttatgaaatatgaaaacggtatgaaactatccagctaatttgatatgggccacaaacagcattcatgaattgtcatgatcactactaagcgcctacgaagctgttgacaaccaaatttggtaggtcatgaaccgggttcgacattgggatcgaggcagattcgataaagagattgatttgaaaaatagagtatgtatcggctgcgaaggcatcggctggagtctgcatcgactgagatggatcggacagaggataactgatacaaccgataaaggtgatgcagccgattctgataatggtggtttcaaagatgtttctagaatcaatcaaggtgcttcacgaagattgccgcgatggagatagggctctcggataggcaattgcatctattaattaggatatttcatgtaacttccttacagatatgtttgggcaaaagtcagccgcaaagacttatggtattttagagtttgttagagataagtgtcgtgtccggcaaggacatattttgtatctcgagtataaatatgacccgaacccatgtaatcaattaacaatcgttcaatacaatctcggcgcatcgccactcttttactttcatttacttcgacgagttcttgctttcgggttgagctgcatcgattcgatcttcaactaaaggtaaagcttgttatggcggcttgcgttctcagggttaatgcttccatctttatgatactttaaccctgtttatgtaatccgtcgagttatcatatacatgttgcaatctacgttaatagcgctatatgacttgttatcgagtagttcttatcattaggaaacaaccggtagagttatgttttgttattaatctagattgtatcgtgtatctaccatctcttgtagattttcatcatcctgcttagatctcatacttatatttatgcttaatgctgcatcgattgagttcgatctattaagtagtatttataattgtgatatctggcttgttttatgattatcgatagagatagtatcgaggtttcagccgatcttacctgatttagctttatgttttatatgcttaattgatatgctaagtctgccctttatgttaagatcttgtcacaataaattatattaggcttctatttgatatattctatctgttttaatatcttaacgtagagtggtatcaaagtattagccgatacatgctagatctatctgatcggcaatgctataggcatttataatcttcatgttgatgtacatttcgacctaagtggtttatactgtctcggcatggcgaccgatctatcccaatcacttggtttaaatatacatcgacagaaggattatatagcgttaatatctacagccgatcgaatagatttagtcttattttgcttatttataactgccgatcgatttacatatgacatcggctcaagaataaatgatatgtcatcggcggctggccgatcggctatcgtttatggatttaaccacggtttcttttgtctttgtttcttgttgattataggatcaaatcaactggcatgctcacgaacctaaaggcaagattttggacctgcactgaagttaagcagatcttccaggccagtgtatgttttttgcatcaacatatccactaaattgaaacgtctgctttctatagttccgattggtgaacaattgcgtgtagaagtacaaattgacatgtacttctttaatactagcaatatataaaaaccagcaataaatacttagtccattctgtgatgcacacgttaaaataaatcaaactacaaacagagtcatacgcaagactttcagaatttgcacctccaccatgctagaatccacaagcacatatgcgcaacagtacgaaccacctcaaatcggaattaaatcaatatattttagtactaactcatgctagaaagctccagatctgaaagagttggacaaggggaggcgaggtggtggcgtcggctgtggacagtgccacttggcaccactgtgctcgccctccaccttcgaccgcctccatcagctgttgtgtgccgcctttggacctgccctcaaccaccgtgcatggagatgggaaggagacatggaggagggacacacaaggaggtgaatcctgcgtgttgccgcctgtttctcggcggtgcaccaccaccgctgcttgctttctcctcctccacctgctcttctacctcccccgcttgcgttgctctgttatgtgagagatgatgttggaggaggcatgacgaaacggtacgaaagggagggatggagggatatggcagtgttattttgcaggtaattttggctaaaagctatgtaatgcggtcggacctggagccatggagtgcccaaaatgctactctacctcgcttgctctgatctatttttttggtagatctggaccccgtttggttggactactccagctccactcaagctgaatctaggagctagagcaccgccaaacaagccctcgacctccgattccaacataatcaacccttgcttcttccaactcctacacaaccaccaccgccatcttagacacgtacggtacgtggcacacgtcctcctccctagcttgatgacggaggctgctagaagatttttccatgccatgttgatgccaaattatgatcatacaacaaatatagacggtttccccactactgttagctacattgccatccgatggacagaaattaatccctcgcgctcatagttgccgtaaatgaggaagcctaatttgtaaacagatgctacacactaagaaaaaaaaaacaatatcttctatatcaagcaagagttgtttatgttggtgatattttaggaatcaccgtggtaaagaggaattgaagacgaatctggcaagaatgggtatcccatctatatgtatgcagtgtatttcaaacatatgctacactcttacccaaaacaatcatgtctatattaaatacattttcgccatttgtatttaaatcaagagttgtttatgttggcaagattttaggattcaccatggaaaaaaagttgaatacaaatctagcgagaaaacgtgtacatcaaaggctagggttggtcctacgatgtagagggtgaggttataggtattaggcttgatgggataaagtggcagaagagggtataagggtcacactacatgaatttcatctagaagtgacagaatagtatctcagctttctaagtttttttcttgatgagattttaggattcaaagtggaaaatacatttttttaatttctgacaacattattttatgcatgaattggattacaagggcatttctaattcccaagaagtaaggatttcgagccactgtcatcttgtcctttactatgttgatttctattctgatgagattttaggattcaaagtgggaaatacacttttttcaaaaaaaaaaatcaagtagggatttcgaggcactttcatgttgtcccttgttatgctgatgaacatctatatatgaagaattaacatgcttagtgttatgaaatacgaaaacggtatgaaaccctgccgctaatgtgctatgggccacaaacatcattcatgaataatcattatcactactaagcgcctgcgaagtgatgcaccattgaaactaagcagctgctttctatagtgcgactggtgaacaattgcgtgtagatcagtacaaattgacatggtgcttctttaatttaatactagcaatatataaaaaccaccaataaatacttagtccagtctgtgatgcacacatctctactattataaaaattgaagatgtttttgccggtactttggtacgtcatccgtgtatgagtcggtttttaagtttgtttacttttagaaatacatatccatatttgagtgggttttaagttcgtttgcttttagaaatctctttaaaaaaatcacattctaacttacacggtcgggctccttactgcaactcatgattttttttaaaaaaatatatccaagcgaatttctacagtgaaattcacattaactaaaccatataacaataataaaattaaaatagcattcacccgttgcaacgcacaggcattttctctggttagaaaaaaatcaaactacaaacagagtctttctgatcattcgcaaggctttgcagaatttgcacctccaccatgcacataaaaagatgattttgtcctctaacacaccctccccccaaaaaaatattactgataacagcagaaacactaaaattcatctttaaaaagaaacactaaaattgtggaattgttttgtttagcccaaaataactttgctgcatcagcctgtcaaaaaagttcacttaatccccaaaggtattcatctattagactcttaagtattgaattccttgtaaacaaactcttaagaatatagatatactctctccattaacaaataactagcaataatcacgcgctacgctgcgtgctcgataacaaaagcaagacaaaacatatatagttgtcaatattccgtgaaaacaaactggcatacacatcaggttttccataaagattcaaatatgaattgttcctattgatctgtctatgcactatttgtacaatcatatgcatttcagcaaaattagcaaccatacaatgaacaaaatgctgtaaccatacaatggagtggatgggagaactgaaacggtgctataaccacaatcataaaaaggtggttctttatttgcaacatcatcgcatacttctcttcatcaaccgttgcaatcttttaacatagcagttgctttgcaatcaataatatgtaagttctacatggcatatatatatctccctcttccaaaaagggttccataaaacatttcatggtcagaagatgatatcttaatgaaattatactggcaagtgaatctataatgaatacttaataattatcactttataaacatgtccatgaaagcaaaatctcaattcaaaaggatagatcagtagcaaattctaaaagcaggaaaacattagagcaggaaaaccacatcacatcagcaatgttgcctgtaagaaaaaaaaaagccatgtgcaccctattggaatatataatagaatgccctattgtaactcaattgaaatgaggcagatattttagaaagttgcccaacacgttcgaaagtaatactcaagtagaatcacattaattatactgaatcaaatgccagcatataatcaaggcattgatcttttgtgtggtacatatactctttccatgacgagaagttcaacaatactttctagggctgcaataattgtgggttaatctatgcattgatcctttgtggttagctggatgtgaaacacctagagatgaatgtaaactacagagtcaatcacactataataggatcacatagtagatcagaaaatgttatattgttgcatataacttgaactgatttagtgaaagaagacattaaacaatattaatgtagttatgttgacctagtaaaattttgaccaatttccaaatctttgatcgatccaaacaaccagagatggaaaatttgccgagagaaatatttaatttggttgttcatttgcattccctgactataaggtgaattgtacaatctatatgtttggtttgacaaagatattagccataatacagagcatgtgaattattttgagctaatgatcttgtctgtttttttttcagatcatacagccattttagagtttatttttaaaataattaaagaaaacttgggagaaaaaaggtacagagacctctccttgctcaaagaagaaaactccccgttgtagatcacctagcttgcacggaatataagtaactttctcacttatggaaacaagttcaaattgatctatgcaaacaaaaaatgaagaaaaagggtgtattactccacattggaattcagaccactacctcatgtaggaagttattacaccatatttgcatcagaagagcagcaagagtactgcgtttgtttcttgcattgcactgagctgtacatgtcaactattagcaatgcataaagtaatcatacgatgagataaagaaatagaaaaatgaaacgttggagaaaattttaatatcagtatgtgtactattatagtcagcatcatctaaaatgcatgaatcatataaaagtatatgactatatggtaagggagatcacattaatattgtagcttttgtcataaagaaatagctgaacatatcaagttaatatcttcaaaaatcaatcttaagccaaggctagagcgaatcccatcttctatgaacctagaataactaaggttgctatctctgaatgcgtatagaaatcaagaatttaagtaaacaaaaaggagatgcaaactaacagtacctatactcctatagggtggtcagattcaaaggtatgatgttataatatattgagattgccacattttcagagtcctctatgccatatgtatcaacatcaccaatgtaagattgtccataatgaacatcatcgatgcaaatgctttctgtcaatctgccaacgacaatagcggcaagggattaagaaaatggaaggcagcagaggacattcaatagatccaacactaaacaaaagctaattaatctgatgaacagcagatgctagcatggaactgaacttaaataatcttgatgagcaatcacacaaccatacagtacatcagctggtagaaaacaacaaaagcgcatcgacaactccaaatagatccctatatatttaggcactgaagccagtacatgctgaaaaataaatcaatataagccgaagctaattaagaaaaaactattaatgtataatacatagacctggaataagcttgctactacatagagattaaggaattaagttaataaaaacggtaaatacttgctattatatacagatcaagaaattaagtcaaaaaatggagaataaaaaaatggtacctccagagtggccaaattgaaaggttggatgtgatagtatgccaagattgtcaggtatacatagaatctttcgtgagaaccattgccattgtaagatcatccgcaaagaataccatcgatgcatatgtattatcatcctgtgtacaaaaatagcgggcaacaaattaacaaataaaaactgctcatagcaaaaacaactaaacctaaataggaccacataaatcattcatgttgaactaataatgagcagcaaacaaagaacatggatcagtggcttagatcaaataggtacatgtgcatataatagatggaaatcgtagtacaacacaaagggaaaaaatgttcattgctttaagtagaactgcataccaaattgggtttagccaagtcatcgccatacgttggtacagtcgtggccgagccaccgctcccaatctcccttctcgtccccggcgtcctaaccatcgctcggacctggcactgaacgaagcagagagcgattggaatagggcgagggagagggaggcgatggtggagtggagattgaagatgagaagatggtggcgacgactcgtgtccctcgcttccctgtggacagatccatcggtgactgatgcgacagcctctctcagagagagtggcggtagcggtagcggcagcggaggcgtggtgaagatggctaggggggagtgaggaggcacgcgggtgaggatgggtggtggtggcaaaggcgcgcataggggaggaggaggtcgaggcggtgcgtgagaggtagggtggcgttgctacttgtgacgacgcgggtgagaagaggaggaggagggcagctagggttttggtgcggcgtggcgacatctgcgccgttcattcccgagccaacgatcgcatgagtgcacgactaaggaagggcagccacaattggacatgtggacggtcagatcgacattaggcgagatccaccgaacgaaggcaatggagcttgacatgtaattaacaaaattgcaggggctttttttttggcaaaattgacatatgacgtggcaccccttactctccagcgatcccatggtgtttaaagaaacaaatatatatgtttttgtttttccccaaaattaccattatacacttctcgtggggaattcacaaacaatggacaattaaaatagatataagtggctcaacaattatgtgcagaaacaagtactaccattgtcccattgtctagatattgccagaaatgtgttctttttagacggatagtaataattttctatttgctaatatattttcataaacatttggtgcataatattatttgctaagaaaaaaataccacacattgcgtctttgtgatttcagttacatactcattctttgcaatctcagctaatgttagggttttcttttttaacgtagaaaagcctacccttctcatacacaactctttgcagaatttgaacgtccactttgcaaacaaatgatgaatccgcacattactccaaacacaccagaattagacattatatatattttagccaaaaataactttacttaatttgttctttccaatatggttattcacttagtccaataatgtattctgctatacactcttttgaataactattggattccttctgagtatagtctacaatgaatgtctgttacatatgttctcttctctatcttttgtttttttttattttcaaatgctaactccattcgctaccaaagacattgtcttataaattacctatgagcaggaaccattttgaacatgttgatgtaaatatgtaatgttacgagggtctacttgtaaaatgttttaagaatagaaggaggatgaaggggtgtgcagtgaggaaccccctgagaaattccccaaaaccaaacaacaatatggtatcagagccaaaccctagctcaccggcgatctgcggtgcagggtgaggcagctgggttgcgtcgggcctagagcaggaggttgcgagtatgcgaggaagatggctgggcccggagcggtggtgtcgctctcaggcgcgcgcgcagaggggcgcacgtgaggcggcgatggggcgcgtgtgcgtgggccgcgctgggcccggagcggcagtgtccacagcgcgcgtgaggcggcggtgtccacagcgtgcgtgcgtgcaggaagaagaggagaggaagaaggcaagggaagaagagggagaagggtgagaagaagaaggaagagaagaagaagaagaggagaaggagaaaggagtattatcactggtagatttgggattttgctgttgtgtgtggtttattttgctgttgtgtgtggttgctgcttgctgctggtagatttgggatcttgctgtagtgtgtggttgctacttgctgctggtaaatttgatgttacttgctgaagagaggagagaaggagaagaaagaaatgttttcagcggttggaaaggaggttgtagatgcttcctcacttatctgatgtgaccatggctactacggatacaaccattgcttacatcatggatgaacaagaagacatcaaggtcaaggcctccaagtgctagaatccaattcggccacctgctgcactgctgatttcaaacagccgccaaatctccatacgagctccgtttttggcccgtaagtacttgatggaaagctctcggagtcctctttccaacggatctagcctcatcaccaaattccatcccagtcaaccgcagatgaagaaacaaggtgcagcgtcacctgtcatgggcctttgggcttataacttcgtttgggaccccggcccaagtggggcccatgtggggtgcgccccaaccaggtggagcacgaccctaggaccctcttggtcgttctcccacccttataagtagctaggtaccccttcagggtttctcgggttttgatagattaaagtttagatattgctccttgcttgcagcgcacgtgtcggctagaccgtccgtctacttgttctttggaaccccaacttatcatttgtattcaattcctatttgcaatatcagattgcttttatcctgttcttgcttgtttcttcgatttgcttgcaggaatagggttgatttgcaccggcaagatcaacaactcacggagaggtgtatcgatcgctaaggcgcaacacaacatctcgtacggttgtagtcggattgtcaacgtttctcccaaatcgtagttatcatcaactcaccgaaagatcaggccaaacaactgccttgagtgtcgagaggaacttagggttcatcaggtggtatcagagctttcgttgctcggtgaatttttatctacctataaccataaaaaattgccatacaaaaaaaattgtatcctgtaccaagccatatattgtgccattgcattgttcttttcagtttttgctttgctgagtttgcgtttcatcgtcgagtcgtgttgctggtctagtgtttagttcgtttagagtttcgagttctggtcacattttgtaccactgtcatcgtcatcgtcgtgtgcttgttgtcgtcgggatcttcgaaaacggaaccgcctcgctgccagtgttctatttttttagttttcagaagtttttgtcggtcagttttggagttgcattttgggtttcttttgtgtggtcgccgtgcgcatgtggtgattcggtcgttttgttgcgcgtgaggaagctgcgcgtggagattagattagattgactagtttggtttctatttagtgccgagtctgtttctatttatcacctggtacctttccaaaccgaggccgagtgagattccttcccttgcgtcatctcgtggccgagagttgtgagtccgacgcacactccctcatgattgtttctgtccgggttggtcaaacactttggtgaaattttattatggtgtcggattcaagatccatttgcaaaaaaggaaccgacataacttgagcattccatttttgtatagttctgatttttgtttggaattttacagttgagtccctgtaatttttatatctgcaattgagtccttgtgatcttacattgaggtctttgagcctgtttttggtaaaagaaaatcaaaaaaaagaaagaaaaaaaggcagaaaggtgcataaaaaaagaaaagaaaagccgcaccaaaaaaagaaaagaaaaagaaaagaaaatagaaaagaaagaaagaaagaaagaaagaagcgaaaaagaaaaattagttgtatctttgagtttgccatacatcagagtgtgcttgagttgtttctggtgctattttgtggtaccgtttgtgtctaggctcgcgtctctagtactatctagcctaggaccagcacggtacttgagtttgaacaattattcaactttgcattatctgagttgagcatttgctattcctttgctacatatttaagcctacccagagctccacagatttaattggagccatacagcaagtgtttgccaaggcatcgatacatccaaactccgttggggtgcttggttgagtcggtgtatatcaccattccgcttgcattggtaagatcttgtaagagcttggttaaaagcttgagtgtgtgtgtaatatttgaggtaccactacctagtagttgataggagcgtgcatatatttgtgtatgcttcttgttttctactaacaatggcagggatatgcaagaccattggagatgacctagctcaacatcgacatcttcgtcgagacatgcaagaaaaatcctaataacatgccacaaacttgggatgcgttgaaacgggtcatgcggactagatttgttccttcttactatgcacgtgacttgctaaataggttgtaacaattgagacagggtgcaaaaagtgtagaggaatattatcaggagttaaaaatgggcttgcttcgttgtaatttagaggaaactgaggatgctgtcatggctagatttttgggtggtttaaatcgcgagatttatgacatcgtagactataaagattacattaatatgacccgattgtttcgtcttgcttgcaatgctgaaaataaaatagaggaggacatgaaaaagaaacatgctatgtctttgcctccaattactaaccatttgcaggaagtgcgtaatcacaaaaaggaggagagagacatgaaagagccgccaattccattgttcacactcaagttcgaggcacctccatcatctgaagaggacatcaaaggtaaagtaaatggtgctgaaattaatctaggtgagtgtgttgttaatgaagtaaatttgtccacttttcatgctaaagtagagcaaccgttagtggaatcaaatgctgaaattcctttgtcacaagtggatttacttgctgttccttgtgataaagaagagttgtgtgataatgctttacttatatcaatgccacaacaagttaatgaatttgctattcctaatgttaattctgctaattttaagcatgttgttcacattgctcatgaagttcaggaacgtcaattgatatcttctttaaatactttaggctatgttcagtttgatgatttttggggagctcgataatttgaaggagaaattatttgttatgtctgatttgccatgtccaaccgatgttacttttcatatctttggcgaaaataatgatgttggagtatatttggtgcatagagtttacatatattcggatttagaacctcctgtacatgtggataaaacatgcaagctagagagaaatgttattgctaaccaaattatctcgagtttggcttgttttgattggaagaaacaggttgttgtaaatggactacataaagagcaccatatggaaaaactgaggacggttttccgtgaagaaggggaggatgatgtgaccatggctactatggatacaaccattgctcacatcatggatgaacaagaagacatcaaggtcaaggcctccaagtgctggaatccgattcggccacctgctgcactgttgatttcaaacggctgccaaatctccatacgagctccatttttggcccgtgagtacttgatggaaagctctcggagtcctctttccaacggatccagcctcatcgccaaattccatcccagtcaaccgcagatgaagaaacaaggtgcagcatcacctgtgatgggcctttgggcttgtaacttcgtttgggaccccggcccaagtggggccatgtggggtgcgccccaaccaggtggagcatgaccctaggaccctcttagtcattcttccacccctataagtagctaggtaccccttcagggtttctcgggttttgatagattgaagtttagccattgctacttgcttgcagcgcacgtgtcggctagaccgtccgtctgcttgttcttcggaaccccaacttatcatttgtattcagttcctatttgcaatatcagattgcttttatcttgtttttgcttgtttcttcgatttgcttgcaggaatagggttgatttgcaccggcaagatcaacaactcacagagaggtgtatcgatcactaaggcacaacgcaacgtctcatacggttttagtcggatcgtcaacgtttctcccaaattgtagttatcatcaacacactgaaagatcgggccaaacaactgccttgagtgtcgagaggaactcagggttcatcattatcactaaggatgatatgaaagatttgctagaggatttgttgaagatggacatgataggtcagaggaatgtagcatgagggtttgaactaaaactagaagtgatgccaagtaagttgaggttggaagggagcaaaaattatttgagttggtgtaggagatctcaactaatgttgagagcaaaaggggtggatcattttttgcaagagggttgtgaagagccctctgataaggagagccaagcatggagaacatggaatacaacaaattcaacagtggtatcttggttgatgaccttggtggctccttctattggtaggatgatagaaactattcagaatgtagcaattgtatggaagacattgagcaacatgtattctggagagggaaatgtaatgatgatggttgaggcttagaacaaagtagagaatttgaagcaagaagggagaccagtctaagggtatgctagtgagttgcaatagttatgggtagatcttgatcagtatgatcctctacaattgaagcatgaggaggacactttgattggaaataaatggatgcagaggcgaagactcattcatttcttgaaggggctgaacaaggaatttgaggatagaagagcggctatgttccaccgggctacattggcccactatggaagaggctatttttgctatggtgcaggaggagatgagattgaaactgatgagaggcacaaatcctataagatcaacatacactgttgctgataatagggaatgctacaactgtggacaagtgggtcatgtgagctacaattgtcccactccttggaacattggcggcaaggggttaattcgaggatggcatggtggatttggtggaacctgtggtggatttgaaggagaccgtggtagctttgggtgacaccgcagtggtagaagaggtgaccgagggggtcgtggtggaggtcgtggtgggggcaaaggtgctccttaggccaatgcaaccattgaggagggtaaagctattaccctaacaggtgaataggtgacacagtgggaagaatggcagaataacaagaccaataagagctccaacaccaccactcactttggtaactttgccaactacgcccaagtgggcgaaggtactcaggcataggcacttcatctacatatagacatcctatagattggatcatagactcaggagtattaaagcatgtcacaggattgcataatactttcacatcatacaccccttatatccactctgaaactatccaaatcgctatggtacatccaaacctattcatggtatagggttggtagagtgcacatcatcaatgaacttatcttctgttctgcatgtttcttcctttccagttaaccttctctcagttagttcggctattgatcaactcaagtgcattgttgtatttgatgataactcttgtctgttccaagagaagggaactgagaggaggattgggactgcagtcaggcatgatgagttgtggtacatcaatcatgaggaactgggactagctgcggtggttggagatgttgagaaggagatcagtttgcttcattgtcagttaggacatccatcttttggggttttgagtaagttgtatccagacctctttagtagagtggatatgcatagactggtgtgtgatgattgtgagcttggtaagcatactcgctttacatatgttgggcttggccttcgtagctatgaaccattcatattaatacattctgatgtttggggaccatgccccgttacttctgtgagtggtttcaagtggtttgtcacctttattgattgtcatactcgtatgacttggatttatatgcttaagcacaaggatgaggtccttcgatgcttctaggactttcataaattagtgacaacccaatttgatgcaaaagttaagattattcggactaataatggcatatagtatatcaataatgaatttgtgtcatatgtctcagatgaagggatcattcaccagactacttgtcctggtacccctcctcaaagtggtgtagctgagaggaaaaatcgacatttgctagaagtggcaagatttctaatgttccagatgaacgtgccaaaatatttatggagtgaggctgtgatgacaactgcatatcttatcaatcagatgctgtctaggatacttggtatgaagtcacctgttgaactttttttgggtaagcgagagtacaaggttcctctaaaagtgtttggttatgtatgttttgtgcgagatcatcgaccctttgttggcaagctggatcctcatgcagtaaaatgtgtgtttgttggctatgcttcgagtcagaaagggtataaatgttgggattccattgggaggagactgtttgtgagtatggatgtgacattccgtgagtttgagccctattataagagttaaggagatctcgaccaatttcttgaggaattctcgactgtcatggaggatgacagccgagagggggagacagagggaggtgatacacatgaaaaaaatgttggttacaagaatggagaggcagtggtagttggatcaataccatgctcgattgatggtgtgagtaaagaggtggaaaaatttgttgaagctacacaagacaaagatggagaattggttcttcatgagagggatggagaagtggtgcttcatgagggagatggagaagtggttgtagggacaattccatgtcctatggagcaaaccgaaaaggtgaaacaaaaggatatgctagtttaccaaaggaggaggtttgataatcatggggagaaaagaaagaaatcagtgcaagatcaagttgaaagttgccacacccagaatacccagtcccagagtcctctcagagcctctctcctccagcctccttggctcctcttgagacaattggtaacacttctccatctcttgaacaagtagaattccctcttgcacatcgtagagagactagatcaaatgctggtaaccctcctatacgtcttggttttgagcattttagttgtatgcatgacatgccaacttatatctcatattctcatgtttcaacgccatacaaacatttcattgcatcattacagacagtgtccataccaaacgaacggaagtgggcaaaacaagatccaagatggaaagatgcaaagaaagatgagctgaatgctcttgtgaagaacaaaacttgggaacttgtgagacttccaccaggtaaaagagcagtgggatgtaagtgggtctttacagtgaaacaaattcctgaaggaaaggtggataggtataaatcaagattagttgcaaaaggctataatcaaacatatggaatccactatgatgagacatttgcaccagtggcaaaaatgggcatagtgaagactttggtatcttgtgcagtaaactttgggtggcctcttcatcaacttgatgtgaaaaatgcatttcttcatggtgatttacatgagaggtctatatggagatccctctaggatttgggaatagccaggc

SEQ ID NO: 70790 - DNA, 22681 bp, Oryza sativa
ggctcacatgtcagcctgcactgtagacgacctgtgtccaatataagtatatatatataagtactccctccatcccttatatttagggacatatatataacttccacagttccacccctctactgccgctgaatttctgaatttcttttagaaataatactgattcctccgtcccaaaatataaggcataactactcataacacaaaaaccaaaaaaacatttaatcatcttcttggttgaatcaccttgaaacatgcaagcaatatgatttggaggtttgatgatataagatttaaacaaatcaattttataggaccaagagatgttaattaatatatgtatgcatgcctgccctatattatgggatatgagaaaaaaatggttatgccttatattttgggatggatggagtattttaataagaaattgtaaaagtatagatcgatcggctggcaaatttagcactgtgtcaaacacccatagttcaataggatgcatctcaaatggtcttaatatgattagctatgagtatggcaatttttttttttgaccagggagtatggcagattcggataccgttgttcgataggttgtttgacagatgagtcgaataacggttgctcgactggtttgctagcctctttttttttaaaaaaaaaatagaagtattatgcatgcactgtcacaaaagtagcatatcaaacaccctttaggcctgtttggatcccaccacaaaattttacaccctatcacatcaaacgtttgaacacctatatgaagtattaaatataggcttaaaaataactaattacacagattacgactactttgaataaaattagatgttctcttatcttacatgaataaaattaaatgtgacaattaccccttctgtaaaacttgctcttatctggctaaaagccatagcaggtgaccagccaacacctatgctttgacagcaagagatgcttcagatcaaagaaagctcgtgtgacttgttcattgttcaaagcaagggaagcaatacattacaacccaaaaagcatagcaacaggatgccacaaatgtcaggcttgcaattgcctacaagttcattgggaactgggaagaccttcatgccaaagtctagcgtcgcctctgccaattggtagatatgattttgagtgcatccgtgagatgtcctgcatattccaatttcctgtgctctccttatgtttccaagaaactatgctgtgtcatgcgaagtttctagctcagcaaggaattcgagttcgtaaaactgaccagccaacttgcatttcattgcttgtggtagtaaagcttgccaaatgattttgcctaggtgtttgtgaagaaaaaaatgacggacataattaagatgtaaaaaggattcaacacaactaagttagaactagaaaacactcatacaaatagtaggctaacaaaaaaaagtgaaaactcaccaaattgaattgaactgggaatggctgtgacaaaaatttggattccaagcaaagacgagctagctgattgacactgccagcgtcgttgcttgtacatcggaggaggtcgtctatgatccagcaagtcaagacttaccagatagcacaaaagaacagttgcatctgtgaccagtgaccactgatgagtttcctggaaaaaaatccctcgtacgaccatacggaaaatccagctgaagatccagagcaacatcgacatgcaaaacacatagacactcatgcttcatggccatttcttgtaccagaacaaaaataatacaagatttacattgatgcagtaatgcgcatgcgcacggctcacatgaaatgagaaaaaaataattcacattgaaagaatgttccacattctcatccacattcatgccagttacaattgtacatgtgcaatcagtcaggggggaaaccaacctgaaagctcagggctaagtttggtagagaccacaaaagatgaacgcgtgaagtaggctttgtgccttcttagtttggtcaggatccccacatataataaccaatgcatttgcatccccaggttttggatgatggacagtaattgtggcacctgacatttgaaaggtaacaataactcccagcgttagaacatcaaaataacaaagatgatgcgagggatcttgttatggcaagacatttagtacaatcattggttgaggtacaatcagcttttgtatatagcaccaattaatatggaaaattccaagaacaaatgaagatatattctttatggattgtcctagcccccatcaatatttcaacttcaaggacaaaatttttaagatacaaaaagacaagtttgctatgaataattattttttcacttttccttttaatttatcatttgattgccttttctcttcttttcagccttaaaacagagtgaatttgaaataggtatagtgaagaagaatgttttacatgttcttttaattttcatttcattttctggtaccagtaaatatggcatgatagtgactgttgcacaggctgtatgcatggactttgttctagagaaaaggacaaggcaacaagttgacaagggcttccactccatgataacaagtaaaaaaactggcatgtcctttgcatcactggtgagggcaagacaacaagggaagttagatgaatgctgaaaactaataaagcagagagtaagtaccttctttatctcagcaaggtcactgccattggctccacaaataaaacctatgtacttgcggggaataatgacttcagttgcattagatggtgtagccacttgatttgttctgttgagaagaacaagtcaaaacactgttctaagtaaccttctttagaaaggagaatttgccatttagttttgtttttcaaaatgggttgcattgctagaagagaactatatatgcttcgattcaatcttttgctttccacacaagttctcatgcatatacttttcaaagtcttttagcccctaaaagattaacagaatgagaaattgagaatatttccttttagtgaaaggtcaaagagaaagaaacaccaccaaatggaaattaacttaccctgccactgctccctttctgaaatctgcaggtggtactgtctcaggcatatttcttggagcttcactgtttggtgcctgcacaagatcagggactttattctaagcctacaacacctaaatcaacaagagaagtggtgtgcaaacttttacagttttctaataaaactctggtggcaaggcaaacccaagtcctggactttgatgtatttttttacgacaaatgggctttgatctttttatgatgctaagttaacatgagccaaaataggctgagttgtcccagactgcccagtcctggatccacccctgctggcaagcatcctatcgcttgtcagcaggacccgaatgttggtggaaattcatgaaagagaccattgtgcactgcacacccaggaaaaatgctgaagaacttctgcctaattccaaactgcatttcccatatatgtgtttcctacattctagaataaacgcatagtaagttacctcaggagcccaggcacttggtgatggctggtccagaaaaggtcgaggaccacctccttgttcacaaccatatgagtagggcatcctatcagcacccatgtgctccattgaatgagggggaggtggtcgatgatcgaccatatcaaaaggacccataggacgatcagctctgaaagaaggcataggatatggaggcatgcctccagtgggatgcggtggtgctggttcttgtcttgggtggtaggtggagcgtttccaccaggtggatatgggggcatacctccacctggatgtggcttcatgggaatgatgacatctctaatccttccagtgatatgaagcaatgcatcctgaatggattgaaaactacctgtgacctgtaagaagaaactccatagttacatttaacacctggtcagcaattgtcaagggaataagaataacacagctatgaataacctaagtaaactttcttaaaaggaagattcaatgaaagccacttgaaagagttgattagttgtgataaactgtggatcatttttcaaatggataacttgtgatgtgaaacaggttggccaaaattaccacaaaagagttacagcatatgccacaaagtaaacaattctgctttcttaaatttaacaggacaaagatattctgtagtttgcttctttgaatacgtataaagtagttcacttggaaatctttttcaagagcatgctttgcatacttgacatttcccaacatacttgaattgatcacatattcacagtatcacactgaagtctgaagaccttatgctcttagctattactggtaaacaaagttcacctcaacactgaacctttaatgtgattcagtaaggtgggaccctttatagtagtgttgatactttacattaaccaacacttgtatcaaacttaaaatttttgctacaagaccacaattaaagcaaagaacacactataactaggtgttattagtagattatatgcataacgatgaaaatttcgaatggacatgtaaacttaagagaccactgcggcgcacataaaacatggaacttattactgaaaattcatagcatgcacaagaacataaaatggagtggttgattactataacattaaatacctgaactagctcatcatttcgttgtgcacatcttggaatttgttcattcccgaaaattcggataccagctcctgttatttttctcatttctgcgatgatagaaccacctttgcctagtaagcaaccaatatgctgtgatggtacaagaagtcttgcagttacagcagaacttttatccatcgatgactccgagattctagaatgcacccgaagtactgcatcctgagctggagaatgcatcatctcagaattctgcaacaaataagattaaacccatcaaaaataactccagacaactgaaaacctaaggacaaaattaatcgcatatctcccatcattgttggcaggacaccgatgcacatggcatgccaatgtttacagatgcacagatctatattgtacgttgagaaaataaaattcactctccctgcataaggattttaatcacttgaaattaaacagatacttttatttataggttcagagacacacctcatgtgcagatatcacaattacacgttcttctgaatcagaattaggctctataatcttaatcgaagcaccagtttcactttgtaatgcgcgaatagttgaaccaccttttccgattatgctccccaccatttcattgagacatatcatcctgaagactatctcttgttcaacaaagaatctaggaccgggggcagccatattacttgaataattccttgcatgataatcaggcatggatggtggtaaatagcctctttgagaatgaggatctatgccaactgggccaggaggcccaaatcttccaggtggaaagttgcttgcatctggcctagggttatcttgaaggcaggttgtaactaacaataatgctttccttactgcagaaaagttcccacttatctaacaggaaaaggttaccgtgtcagaatgacctgaatttttaataggtacccaagttaaagaagaaaaatgtccatcttgagcatttcaaactataaagccgttagcaatgcaacacttaagtatacgggaaaggtaaaaagaactattacaattttagtatatttagaactgggacattatgatttcctagaactacataatcagaggtgcggaacttgctcataatgaatttgacttctatgactctatgcaacaaaaataaccaacctttaattatattttctctacaaactccttatcgataaaacactattgtaataaattatatgaaagacatcacccttatgttttcaattgctgaatcgcaataagagccaattataaagtacaaatcaggcaagatagctcatttcgaacttatttgttcatttgaacaagatgcatatgagctgaaagaaatacaggacccgtaacataaccatgaatgaactgaaacttatcctaccacctatattaaattatcatcctatcaaaaaattgccttttcattagtttgcatagtgcaatacaccgctcaaactcccataaacaattttagcagttttgcaagcaactaaggcacacgatccacctcattataagtttgaaccacctcatttcatcataaatttctagctaacggatgaacacgccgggcgcaccgaaaaattgtgatgaataatccacccacgcaatgtcaggggggatgattagatgaatatagcacaaaaaagaagaaatatctgtgagctgagttgagatgcgtacatggataagctcgtccaccggcgcagcccagggagggagctgatccctgttccggaacaccctgatctgcgcgccgctctcctgccgcatcctctccaccgtcttccctcccttccccagcacgcacccgacctgcccgctcgccgccagcatccggcagcccaccacgccgggcacctccctctcctcctccccggcggcctcgtcgcccccgaccctgtgccccacgacccgctcccacgccctcacggccacggcgggggcgtccggcccggagatggagagcacggcctcgtcgccgacggggggctggtccacgtggaggtcccgcgacgccccgcggagcgcggacgcgcggctggaggggcagaggatgcggagcgtggtggtgaggcgcttgggggcggatggggaggaggtcgaggaagaggccggagccgccgccgtggcggcggcggtggcggcggcggagttgggggagatttccatgggggtggacggttgagctaaaaccctacagcttagctaacagagaagaaatgctgacctctgcagttttaccgcaagtggtggcaacgggccgggtcggggccgggttgggctagaacgccaacccggatgggcccccaaaccccgggtcaagccccttaggagggactatgggcctgttcgaatgactggactgcggctacgccacagccagcacgaacagtgtcgtaggcacaaggcagctgctgccagccagccagcagtagggtgtgttgcctgattttacgcaaatctatatactatcaaacaaatgagagaatagtattgttggtggttattctgctactactttactactttagtatgtttaaaaattagtccttaataactttttcgatactatacaatagtataatatttgtttgaatttaatatatattgacataagcacgaaaaaaacaagaaaattagtattttacccataacaaagtatggttactttaaaggatacagtacaaatagagaagaagttcatgatatgatagcctcatccataattctacggaagcaatgaatcgtcatcctttgcatctcatgataaagtttcatcgctatctttacttcctatacttctgtatctctatttcctatactctctacatatattaaggaaatgataatttaaactttttcccaataaaaaatgataggcccatacaatgctaggtgcaaaatgtgcagcttggaactacaagggaaaacaagcatggcaccgttgtcaaacccatgttacagagggcgctccaatagttgtcgtaacaaatgaaaaacttctaactattatcaaatctctctgctccacttctttgattcgggagaagactccatcggtgttgagagcttcagttcgaaatgtttgtcagttgcattcttttgtgatgcatccttttccattgtagatatgcacatgtgttgtaaaaccctcaaaccctcaagaaaaatatatccttgatcctacaaatgcaattgaccacgcactttctttcttcaatttcctcattttttttcttctcgtttgcaatgtacatgcacttcaatagtggtctctcaataccaggtataaaaacataacgtcataattagcgggaacaagctttaatttgttttgattccctggttattggagtaatgttgtggttagaccgtattaggaactagagatctatgtctcaagctatcttgacctatcattctcgatgtaaaattcccgtgatagtcaatgtggacgtaaaatgcaccttcaatttgtgtgatgcacaaccataggatcaccttcgatgtcacctaggacatcaaggtcgtcctccgccgtagcaccaactattggaactcgttggtaacgaaaatctttcttactatcatgtcttaggcagggcaaggcaatcagggcacacacttgcgcctgtgaagtgacctccattgatatcgtgcatagtaggctttggtttaattgtgtaatatccacagagcctagcccatttctccacagccctctacttgtgaatttactctcgttcctcgcgatgaggaccccatgccaatttgctcccctctagctattacactcttcaattgtccaacttgcaagttgcgagtctttctactctaaactctgaactctgaagtctggaatccccttcacactttcacactttcacagccattgcgtctagcatcctgataataagttttctagtttttttttcttttgggattcactgttacattctattttttttttctgttttaaggatctggtttagggtaagaaagggctgaaagaaaaaggaaaaaatatattgctaatttatttgattattcaaagaaacatctatatatataaaaatctttacggtgtcattaagacaagtaactgaatcaaacagggctcttagctcaatcatacttggcttagtgacatttgcagattcatctctgtttcttgagcaattgggctgtgaaatgctcgccccagaaatggaacttttaaccacagacatatgcttattcctcttcgtctttttttggcgataactattttattttagggagcagaaagcgagcaaatcatctacgagattcccttcgggcacctaggagattccctgcgagcgattgtacgaaagtgacgaaggaaggaccacgagattccgtgggcgctacgaacgcgacgaacggccgagaaaagaaagagtagccgttacgaaatttggtgacaataactgtttttttttttgcgcaataagaggattaggcttgtgctgggttaattagcatgtgggctgatcagtaagagccagtactccctccgtccaaaaaaaaaagacaaaccctggtttccgtgctcaatgtttgaccgttcgtcttatttgaaaaaattataaaaaaaattaaaaagacaagtcatgcataaaatattaatcatgttttatcatctaacaacaataaaaatacgaattatagacggagggagtaccacactgccacagtagggctctgctgctgtctactgtgtattgttgctgcagagtggccgtagctacagccagccagttgaaacttgcagatatcatttcgaggttttctaaagcttatggtaataatggtatatgtggggctggtttgctttatgacctaaaattgaccttactaatttttgtcaatgtcaaatttttgtaagttttggcatggctaatcttggcaaggtaaagttgtgtttggactgaagccaaagcagtttcatttcattattgaaatggcctatttttttaggcatgccaaaatttggtttcaaaccaaatagacactaaacactattgaaattgtcaaatattggcaatgccaatttaggccacaaatcaaaccagcccatggttttttttactccctccgtcatataaaaaaccaacctagtaccagatgtgacacatactaatactatgaatctagacatacatatgtccagattcgtagttctagaatatgtcacatccaattctagattcgttttttataggacggagggagtacttacctactagattattgaaatgtgttctttgttatacgtttctaaaaatacatttttaccaaacaaagtttcactgtatttttcaatcagttggtttaagttatttgttaattttatctctaaaacatatctttataaccaaatcgataatccgatgcaataatccatttaataatcaaacttttcgttaccaataatttggtaaggccaggaacgcagctcattctaaatgccacctaaactaccggggctttcacacacctcacgcactcgacactttggaacagaagacaatagtgcatcgcaggtaaagaaaacgtgaacacacctcacacacacaaaatggatatcctagtctggccaaatttttggatgatctcatcgagcatttttatagatatttattttcgaatatcttatccacatctactcatcagcctaatacactcaaaagttaaatggacattatctatctagaaatatcttttccaccaaacacaccataagatgaacagatccacgtcagaaccagttgcatccaacagaagcctactcagcatccacgtcccagtgaagacagttaaaggcgtagctcccccgaaaaaacaattaaaggcatatctttatatactcatgatagacatacagcgttcaagacacttttataatattatactacctcagtcgctttgtcttatttcttagttaatttttttaagtttaattaagtttaaagaaaaatatagtaatattttcaagttaaattaacatactagtgaaactaagttggtgttatagatgttacttttttttataaacttaaataaaattaaagaagtttgaatagaaaaaaaaatcaaaacatcatataatatgaaaaaagagtaagattttaaatatttatatatttttaaaaggaaaaaaagatagcaatcaacgaaacgacgacactaccggtttaccacgccgcccacgcttcgccagggccatttcgtctttaaatacggacactagaccagaggcctacctgtaacctgttcgtccagctccaaagtctcaggcgcacgcgcactgacagcagcagacagggcgagcatggcggcggcggcgaacaacggcggcgagggcggcgacggcttcgacgtgatcgtggtgggggccgggatcatgggcagctgcgcggcgtacgcggcgtcgacccgcggcggcgcgcgcgtgctgctcctggagcggttcgacctgctccaccaccggggctcgtcgcacggcgagtcccgcaccatccgcgccacgtacccgcaggcgcactacccgcccatggtccgcctcgccgcgcgcctctgggacgacgcccagcgcgacgccggctaccgcgtgctcaccccgacgccgcacctcgacatgggcccccgcgccgaccccgcgctccgcgcctccatcgtgaacggcgccgccaccgaggtcgcctccgacgcggcggcgccgtggccgtggtccggggtgttcaggctgcccgaggggtggacggcggcgacgagcgagatcggcggcgtgatgaaggcgaccaaggcggtggccatgttccagtcgctcgccgccaagaacggcgccgtcgtgcgggacaggacggaggttgtcggcatcgccaagcaaggtaagacaccgatcgatcaagctagagcttagcttagcttagctatgtcgtcgtcgtcgtcgtcttcctctcgcccaaccaaccaaccaaccaatctcgttggaagtatccgggtagctcttgcatgattgcaactttgcttgcatcacgtgatcagtcgctgccaaccaaaatgccagcggcaaccaccatgcgagagctgagtgagctcctgctccttgcgggaccattgttcttgttgaatagtaccgcaggagagaagataaatattgaacacattgtactgagtcttagagaaccggtatacataagagatacatatataaatatggggaaaatatgtagtgcaaaccacatatgtagtggaagcttggaaactactgttggatcgagcaatagacgtccgagattcgtccacgtcatcgtgagttaaaatttaactcgcagatcattcatgagttaaaattttactcatggtaacgtagacgaatctcgaatgtccattgctcgatccagcggtagtttccaagtttttactacatatgtggtttgcactacatattttcccataaacatgggaggagtccacataaatcaatcctattataatatgactttaactactggtcgttgttcagtctggacaatattggaacaggtagccaaaaattagagggagggggttcctaatggatcgctattattggtagttaattaatatttgaacaaattaagcaatagttaatgccgtttactccatcaaaattcctcccattctaattttgtcactcggaaaatcaattcctcccattccaattttcctcctatcaactaactaattttcctccatccaaattaatgcgtgattttccatcttgtgttcttatctcatctcaatggtttacacatgtgcatatagtttccccccaatcttctactctcatatcaatactgtactatgagaatcaaaatattcgtgctagtattgagagtgtgtcaccatgacggtaacactactgatctcttttaacatgaataaatattcaatgtaatttttattgccgtaggaaaaacgtctatcttaaagtttacaatttactataccttcatagctactactatagaaacggagtcgtcctcctttcgttctctcctcccactgctcgtgcccagcacaacataagagcataaaaggaacaaccattagatcacattcttaacctattctcagccatataaacccgttgcaatgttcagtcatgttactagtatatagtacaaaaagaaaaaaaaattaaatttagggcctaaacctaacattaagcgtgcatcacccaacttccaggcacggccttggctctatattcccaagtcagacaagggtgaaaacaagaaatgtattgtctcattatttaataaataaataaatctggttagcatctttgttattgcattattacaaagcatgtgtcagcttattgtacttttaattagaactgaacgtctgttttaattttatagcccccctattgcccacatgacataaactcagataggtcagtacaagattctagtcaagtagctatttttttctcttaaaaaacttatttttagtttttttattcaaactgcaaaacctatatatgtgtcaattaacaaagttcttgatttggttggacatgcatcaggaaaactatattttaaaaaagaaactcgtcttttataaagattgggtaccagcaatccgttattgcactaaaaaaacatttttcatgggtttaatttccattccatttttatttatgcccttcagaatcatatatactagcttgcacataatgttagtgaaatccattagctgatttagaagtgaaaaatcttttactccattagcatatcaaacacttaatttgatcaggagacggatcgatcgtggtgaagacatcgagcggcgaggagttccatggcgccaagtgcatcatcacggtgggcgcctgggccagcaagctggtgaggtcggtcgccggcgtcgacctgccggtgcagccgctgcacacgctcatctgctactggcgggcgaggcccggccgcgagcacgagctcacgccggagtccggcttcccgacgttcgccagctacggcgacccgtacatctacagcacgccgtcgatggagttcccggggctgatcaaggtggccgcccacggcggcccgccgtgcgacccggaccgccgggactggctcgccggcgccggcgccggcctggtcgagccggtggcgcggtggatcgacgaggtcatgccgggccacgtcgacaccgccggcgggccggtcatccggcagccgtgcatgtactccatgacccccgacgaggacttcatcatcgacttcgtcggcggggagctcgggaaggacgtcgtggtcggcgccgggttctccggccatggcttcaagatggggcccgccgtcgggaggatcctcgccgagatggccttggacggcgaggccaggacggcggcggaggccggagtagagctccggcatttcaggattgggcgtttcgaggacaatccagagggaaatctcgcggaaaataaggtcaaaaattaggtcctcacaggtatggtcgcctgcgaaattggtgcaacgtgtgaaatgtggttatcagtagggggtttgtttaccgtaaatctattgaacattgtatttcataacttctatgtgtgctttatactcttggatattggtagattgtaataatttgcatcttctctgtccttgtgtataagattcaaaataaagttgttctgttgcatttcttcatctttttgcaaaacacaaaatgttcctcattttgatcttcactttttttttcctcgggagagaatcacactagtgctgttttttttttccctcgggagagaatcacactagtgctgttcctattcccagtcctattcatggtagatatgccgttggtgaattgaaagagacttgggtgttcgccattgtcggattcaggcagtacacgccgcaaacctcacaaagttaatcctttggaaacaaagggttattttggaggaattttgaagggattcaattctatagaaaattttctcatgtgatcctttggataaaagaaatagctatctaaaaatcctatgaaattcctttgggttcactctaaacatacataggggatttgtaggaatttcaacataaggtccaacccgtctctatctttctctcttctaattcctgtatttcctatgctccgttcaaacagttacatttttatatttcaaatgctcttttaatccataggattagagatgatagctccaatactatattttttttattgttcctacattttaagaattctgcattccaaatgggccctctgagcatgaggaatatgctaggatttgaatagctccaaaacgttgagtctttctaaatacgtcacgtcttgctgcaactatttcttagttttaatcatgcatgttgcatggtgaagaattatcacttacatctagctataacaacatgtgttacatgctagctgatgggtctcattcccatgactcatgagtgatgagtgcgtcaagtcatgtgctgagaaagtgacaattcacttgttgtttttgttaaacaatcaaagagatgggcacaatatctttgtatcttttcagtctgatgtaatggtgcaagtcctaaaaaatcagtagtgacaatcgaattgagccacacttcggttgcttgtcctcattaggtggcatcgatatcgcacaagtgaattaatgcctatcgatctgatctgaagacttggctgttttcaatttgcacaggtcatgttcttgatcttatcatttgatagattgtcgcatagtgcgttgtcatcttgatactatccaacactccatctgtatggagtatctggtgagacagtgatgctttagctttcgcagtacaaagctgtctctgttattgatgactggtacagtaggttcaagactgaagaacaacaggctagtggagatgatgaaatttggagtgatggattgttggtgtaattttcagaaggaaaaatcaggccggtcctgtgcacagtgggcacttggcaccattgacttgacctggacttggacttgttttttttttttttgcagggactggacttggacttgttaaagttcagcgtaatcaaatcagtttgggctgtgtttagttcacaccaaaattgaaagttttgttgaaattgaaacgatgtaacggaaaagttggaagtttgtgtgtataggaaagttttaatgtgatggaaaagttggaagtttgaagaattattttggaacaacacacggcgcaaatgtctagctgaaattcagtaaattcagttgacgaagtacatgcatgtgtctcgtcaatgtgaatatttctgaaattctgtccatgactactaatgtttctactatctagcaatatatttagatcttctgaacttgagtacaaagaatagaaaattaatgaatttaatcactgctaatatacacgaagaataggactaatctctgaacttctcgatcaactgatctctgacaagccttcttgatcgtgaactcgtaatctcttctttggtgcagttaattactactaggagatgacttccattaatggtgtgctcaaatttcccaattcttcatgcttcactgtcagatcagaaaaggaagacgagcagtagtagtagcagtagcagtagcagaagccatggctgggtgcatcgtgtgctcgccgacgacgccgtcatcgtctcaggctcatgtgctcctccaccgccgttgtagtatatcggcggtctactgccgccgccgccgccgccgccgccgcggtaagccggcggcgcatttccgccatcgccgtcgatgatctgtgctccgaggaacacggcgtccgacttattgatcctgcagcaagaatcacacagctattaaaatttcaggaatttcgatcccctcgaccagaaattatttcggctaaatttttgtttgggtaagacaattttcattcagatttaaccaaaatttgccctaatgtaacctttttggtccgaaattttcagaaaaccctgcaatttccgaaatttcgcttcaatgggtaaatctcagcaattccacttctatcggtaggttttccacagttcccaaaattcatgcaatttccgatatttcacttccattggtaaatgtccgcaatttccgaaatttcacttctatcggtaagtttccagtccctgaaccaaaacctgtccaagtgctaacttttttcaatccaaacatttcccgaaatttcgcttctatcggtgtatttccgcaagtttgaaaaattctcctggatctatcggtaacctgtccaagtgttaacttttttcagtcctagaatttcccgaaatttcgcttctatccgattttttttcgcaatctccgaaatttcacttctatcggaattttctatcggtgaatttccgcaatttcgaaaaattctcttagatctatcggtaaatttcagaaatttctcttctgtcgtaaatttcggaaatttggcttccgtagctgcatgcgtacccggaggtagggaggcagaaggcgatggtgtagtcgtaggcggccttgcaggtgaaggtggaggtggagtcgtcgtacgcgtagctgtaggcgcgcgggcacgccgtcttgaagatggccgagtacgccgtcggccggcacgccgccggcgtcccgtactccccggcgcagcagtacctgtcctgcccgaacgcctcacacgcgctcctgcacgcgatcgccccgccgccgccgcactccacctgcaactccctcggacacgctgcacacatcgtcgtcgtcagctccggcaatggcgaagtggcggcggcgtggcgcgcgttcgtgcgtgcacttacagcggttgaggtcggccatgcagccggtggcgttgcaggcggcggcggcgcgagggatggcgacgacggggaggttgtagccgtcgacgaggctcacgtcgtagaagtcctcgccgccgcccctcccgagggtgacctcgaacagcgtcgccggcggcgcggcgccggcgccgcggcactccacgcgcccgccgcagtcgcccgtctggcacacgccggcgccgtcggcgtcgaacacgcaccccgtccgcgcccatatcctccccgaccaccccgccggcgccgccagctgcgccgtctgccccgggtcaagccggaaccccgtcgtcgacagctgtggcgtgccggcgccggcgagcgtccccggccatatcgggtgcgaacaatagttcgctatagtgaacgtcatcgccatggaactgcacgaccaagaagccgccattgccaccacaagaagccatagcttgcaagctcttggctctcccatggctcctatggctcaaaatttgggaattgatgttgataggaagaagattgagcagggaaggggaagaagacattgagagaattcttgcaagatttaaaggtgcaagtgccatgatgcattgcatttttgcatgtttgcatgcaaagaaagctttttcttggtgtgcttggtttagcatgttgcacggatggggtggcctaggaaagaagaaataccttttgggatgatgcaagcttatgatggtgacatgatcttagcatcaagagaggtgaatcttctgatgcttgtgctaatgcagataccttaattactagtcaaacatgctatgttttgaatactctgtagtctgtacacagtctgaacatttggacagagtacatgtttgtgagtttgagcaaccgggaaaatggaaatgtacagaatacttttcttatttggatacagaaaaaagacttgagctgaactctattacagtattagaatcagtagtcaggataacagcatgaagattctgaatttgctatcatatccatgcgctgcaagcctgcaattctcattatccttcttttttcttagtctttatttgggtttgatttactgctcgagtagctgctatctcagaacattagttcgctacatgtagttctgaacacttcaacctatcggtaagcttgtaaaatttatgatccatttttgcgtcagacatgctcttcaattccaatttataaaatcaaggtgcaagactgcaaattcattttgtctacaaaaatgtcatgtgttttgtaaaaagcgtacgatccatttcatacaagattctttcaggaggcaatcatgcctttggaggaaaactgcaaggaaggaatcatacaagaaaactatcaacatgaacaaccggcacaaagatcaatgaagatgacaaaagatgcacctttttgcagttccataaaatcaaataaccttgcaaccagaccagataaagaatctattctgatttgattgcacaaaaaggaataatcaagctggaattgtgacgcttatggtagctctctgtatattgcctacctttcaagatacccttgactgaacaaaacatgtgtgaactgtaagctagtccatgagaactcagaaaaaaatccatttcagaaagggttgagaacagctaactcatagtgcagcactacgaccttgtaaattattagaaaacaatggaagattacatgattaggaagtttccatattgtacagtactcatgatcttatcagaggcacaacaaacaagtggagacctactgcagcatcactcctctgacacaggttcctcagcaccaccttcgggaacattggagtcatcaacaaccgtgacaccctcaagatccaaggggcgcccagtcatcggatgaattgggcgcctatcacgaggtccaccctttcgagccatagctagcattggaggtggaggcagaagcccagctcgaaaaaggatgcgctgcacaggatctgatggctgagcaccaacagacagccagtacctgcaacagaagtataattgtatgctgttacatggccttgcaagggagggaaggacatcatagcattcttctagcaattaactcaaagaaagaaatattgggaagatcagactcttgactctcgacaaggtgggcaatgaacactggcaactagacaatacaggatcaaagatactagttctgctattgatgaaactaagcaccatgcttgaaatgtctgaaactttatatctgtaattttcttccctgttacggatactgttaagcaaatctcatatgcttaaaatctctaaatccttttctgctatggatggatgccagtaagcacatctacaagctacaaaattcagaacccttgaatccatcattttctacccagagaatggaaggcacggatggttggaaggtacatggtaattggcaatacaattaaatagtacacagaagcaataacagcaccccaactcctggaacgaagatcgcattacaatgataactgaatcagtccattttgcctatcaaacaatcagtttccatcaaagaatcaggctgctatagcaatgtcagtcctagactagcatcagcaaaagctccagcacgccaatttttctccagaggaaatactagaacacatcaaacactccaaattacgagcataagcaaatgaaactcacttgaccctgtcgaatttcagccccatcctcttgccaccatccttccctgcaatcagcaacagaaagcacatactcctccatcatccatcaggcattcaatcacaagcttacagccaaattctcacgcacgtacagaaatgtttcacactctactaatccctctccaatctgatccgattcaccatttcaccaagacgttgaggccaacgccaaccaacggggcaaagacaacactcgagaacaagccgatccaggaggagcacgagggggggatatggaggaggagggctcaccggggagcgggttgtagtagccgaggacctcgaggtgcttgccgtcgcgcggggagcggctgtcggcggccatcacccggtagaacggccggttccggcagccgaaccgcgccagccggatccgcaccaccatgctcgcctcccctcgcgcctcctcctcctccgccgccgccgccgccgccttcccttccccttctccggctcgggtcgcgtcgtgttcactcctgtgggagcaagggttttggatttggattctggagaaacccaacaaaaaaagaagaaaaaaaactcagcgggctttacctctgtgatgggcctgatgtcccatagagtatgggccttccagctagagcttgttcacacgagacttctttctgggctttagcccatgggccaaactccggcccacttatggttatacttggttaggctcctgaatggttattagccatttaagctgacttatgcattggccaatcaataattcaatagtagctccatccattcagtgatgaacaaaattaacacgataaaagctcacataaactgtctgtaaaattaatgaaaaaaatcaatagtctgtttggacaatgtgcaggaatactgaaattgcacaagaatcggcccaaaagaagggaactgacaaggccagaattcatttgtagttctctgctcttaacacatttgataacctaactaatggaaatcaggaagccctggtctgtgttttgctgaagtctggaggcctggagaatatagcttgttgctcactcagtcacacccaattgatcattgtcatggttggtagacgaatgctttttcctgcacaaaagatggaagcacacatgctgaactttgcccaagaatgagtgcagtaagaatggaattggaagagaaggatgaggcacaaaaaactgaacaagcaaaaggcttacttgtttgtattggcatcgctctctaacaaaaccgaattggcaatggtattttgttgtctaacagacacaaaaagatccgtactggcatatggcatgctttttctcacctaagagcacctaaaagtgaaacaacctgcatgtaaagtcattttcttgctatgacaaacagctaaggaatctgtgtcaaaacaaaaaaactgattactcctttagggattagcatcactgaaatcatgagagaataaaatgatgtcttacattcaatgaactgatgcatcaaggaccttgtacctgtagaagtaggacccttcagattaggctgctccatgtttgaagaataaaactgtgatttagtcatccaaatgcattcatacatgttaaagaaggcaaaatcttttccatcacatacttttcctagcattagcatgaacaaacaattactgcgaacgtcaagaaagtaacagaggttcaaaaatgatataaataaattagtagatgatgcctaaaaataaaaacgataaagaaacaaaattttatatgcatgtcaggttgagagaaactctaaatgaggaagatgtattggtatgtctaggtagtttatttacccttctccctttcttttctccaactcccaatgtttaactaagatagtctatctcgcattattccacaggcatctattgccacccataattttatgtcccatttggtaagaaaaatgattgattgctgaacccagaagtactgaattgaattattgctagacaggttacttgtgctgccaacaatgtccatattgagtactctctactatgctactgctagatgtgaaaaaatatatatactcacacgttttccttgaatgtcttaaaaagcaaagagaaagtacacaaataatacaccaggaatacgaatagaaagagatgccataaaaaatatatgttctctggaacttcagtaatgatcctgtaaaatcaataatcatgaaagctacccctgtgatgcattcatccagaagaaaactagatactccacattgaaacttccaaatggctagccaatgtgaatttcataattttatatctctgttagtttctgtgtgcatatatgaatacttagctaacaaatcttggcagtggagtaaggatgtcgacaacaagcgattgcgcgcct

SEQ ID NO: 70791 - DNA, 1995 bp, Oryza sativa
cgtcccgatccgatggaaagacctccacacatcaaacggagcgatagattaacacataattaattaaattttagcaatagaaaatttagaatttggattaatatgatttttaaagcaacttttctacataaactttttgtaaaacacgcaccgtttaacagtttgaaaattgtgcgcgtggaaaatgaagaagatgagttaggaacttagataaaagaacataacctagggaagtcaagtgaagggaactcaaccaaatcactgatctcctctcccgaccaattcccttcttctgttgtactcccctcgtggccctgtatacgcgactggtaagcctggatcgttgcggcgcgcctcctcggttgttggctctgggcatagccgcaaggacgcattgtagcggataggaggcgatcactggtactcaccgatccagcagtagttggagtactgactttcgagtcaccgcgatcggcaaacagaatgcgcactcccgaacagcgacagagagctaagctctcgcggggcaaggggaccgttctatcgttgtcggagcagatcaacgaatcgtggcagtgcggtctcatcggctctgtgacttgtgcacgccgatcgcgctatgcatgtgggtcctagcttttgggggggtaaaaaacgactctacaacgatgcaccaccgcggggcgctgtgtcggtggcacgcacgcatcggtcggacgacgggagtggtttcgcgaacgaggccacggagctctccacgacccaactgcgccggtgtaccgtatcggtgcacgtctgacggtgaaacccgggcggaggagtggaagtctgaagcctgcacgtactgaaagcgatatcatacgcagtggaaagatgggatatgtcggtcagtccagccatttaatcgcgtagtacaaaccttaatccggagaacttttataatgtgcacgatcccaaactgacagtacaactggtgtggttaccctttccagtagtaccatttaaaatttccgctaatttcaactgctttctcaattcaattttctttatagaaaaaagggttaccaaaagttcattggtcatattaacatcaaaatttggtatgattcagttaagaaaaaaaaaaccgtttgatagataaaagtttattagataaggttgagttcaaggaggaattgtgagaccacggcaaaaaacagttttgtaatttcttagtatatacttcttccgtttcacaatgtaaatcattctagcatttcccacattcatatcgatgttaatgaatctagacatatatagaatgacttacattgtgaaacggagggtgtatctcttaaatttgtaggattagttatttttcttttttttaaggaaactagtatggtggcccgcgcagattgcgcggctagcatcattatattttctctcatatgatagcatttatgttttctcattatattattcaaatatattaaaatgacaacataattttaaattttgcaataactttacaaaactattaatgtgtaatattcatattatattttatatacgtgttagttattaattatttttaatatcaaattttagttatttgtaaattatatatatttctatatagactctagactcgtcttttaatatttcttttttttaattccgaattttctataaattgtatttctatatagactctatgctcttcttctaatattatttatttttatttctgaattttcatattatattttatatacgtgttagttattaattatttttaatatcaaatgtttagttatttgtaaattatatatattcctatatgaactctagactcatcttttaatatttttttaatttcgaatgttctgtaaattgtatttctatataaactctatgctcttcttctaatattatttatttttatttctgaaattttattatttctaaacggatttctatgtggactctaaactcatctttcaatattcttta

SEQ ID NO: 70792 - DNA, 10838 bp, Oryza sativa
agtaagtgttatgagtagatatatgtatgatcccagaactggtcacttagatgttgttcataggattcttagatatctgaaagggaccccagaaaaggggttatggttcagaaagaatggacacctaaacgtggaaggatattgtgatgctgattgggcaagtagtatggatgatagaaggtctgcatcggggtattgtgtgtttgttggtggtaatcttatttcttggcggagcaagaagcaagcagtggtggctcggtctactgcaaaagtagaatacagagctatggctctgggcttgagtgagatggtatggatgaggggtttgttgtctgagcttcgagtgttaagaagtgatactgtgatgcttcattgtgacaataaatcagccatcaacattgcaaacaacctagttcaacatgatcgcactaaacatgtggagattgataggttcttcatcaaggagaagattgatagtggggtgcttgggctagaatatattaagtcatgtgaacaactagttgattgtctaactaaggggctaggtcctagtgaagttcaatcaatatgtaacaagatgggtatgattgatatcttttgcccatcttgagagggagtgttggtgtaaatatgtaatgttacgatggtctacttgtaaaatattttaagaatagaaggaagatgaaggggtgtgcagtgaggaacaccctgagaaattccccaaaaccaaacaacaatagaacacatctaatttcatgaaatttcgctataattaaggtcagttcctatgaaaatcctgtaaaattcctccaagatgcatctttctattttgtcggttgatatatcgagggtattttaggaattactggctcattctaaatgcgggattttgcagttcaattgctctgaaattcccacgaaaaatatgagtgctaaggacctaaggtataccctttatttccttcaaaatattcaattctaaatgaaacggacgggttatataaagctaaaataccaatacgcacacatgtagaactagggcatttaatgttgctggggcctgggtttttttttttactaatggaatgaaacactggggggttaacgacgatgaacaagaacgctgccgtctcttcccttctcgtactgtcgccgttgtacgccactgcacatggcagtgtcgtgaacgtcacgtagctcctcttggacgcgggccacttcggcatgttcgcattgccgtggcagcgctctagcaggagctcaaggtgcgccatcgccaccgtgaccatcgcagcgcgcttgcgtgtacgggagcgggatcagcaccttcacgccgtccgacatctccttcgcccaagcgagcccgcgcgcggtggcgcgactgctggcattcgagctagcgcatgttgctgccagagctgatggctgtggagcggccagtgcagcccacgctcgtgacggagcacgacaccatgaggttcacgcaggtggacgtcacacttaaggctggcagtggcgtgtgtgggtaggggtgtaagtgggtcagctgcgaactcacttataggtcaaaataagtgggtttgcggcttattttagcctataagtgggtttcgcgggttagccacttacatccctatgcgtgggctgatgcagccgctgggcaagcccgcaccacttacccacttacccacttaggccaaatggttgatgcggcaagcccaccgcgtccggcggcgccaccacagcccacatcgagggagcatcagaaagaggaggaacgaggagtcaaagaggatgaggggaacaagttcgtcactgttgtggcttgaaacctagtcgctgtcgccatggattcgatgccgcctcctcctccgccccctttgccaccgccaccgccgctgttcctggtgatcttgtagacctccgccagcactgccgcctccaatgcgccctccaagggaccttcgtactgaagttcctgagaagttcctgaagaaagtctgaacattgaggttttgtgctgaatgcagcccccaaattgtctgaatgttgatttattttatattctttgccatgaattgcccacattttttttaccaagttttggttataccattctaaacttcctatgcagaactcaattctcaaaaattgcaggttgttttctctctttggtacctacaaaaaggaactctttggtacctgcagattcttctgattctttatggttagcaggctgcttgctaatatcctgggatcctgttttttttgctggcagtaccatatttttgtctgaactagtgcaagcaacatacatcctttgttctttcaaatattcacgaagtggtgctttctgatgaaaaactcatatataatcattatttgtcaatatgcagaatctgaggatttgcaagcttcaacaccattaggcattgaagtagagcagctgcaatgtacagtcttgtgttattgatacaatcgttactttgatcttcattaggatattcataatgtcctattattccactcacattaatattgtaaattcagtgagcaatgcaacggttctgtgacttctttcattctgtttgccatcttcaaaatcttggatgaaatttcgttgtttgggattgagtgcttattctgaattcttcttagcaagctgattatctgatcacgcatgttcttttaatctgggcaaagtagaaccagcgggcaggcgggcaggtaaacggatcctgcagcaaggccgccagaagtttgtgggcttgcgtgcggactactcggcgccactaacttgttgcggacatagcggtcgcggggcgggcacgccgcagccgtgacactgctcgaccacgaccgcagcggctgcagtggcggctctccgtcgtggccgtgctgttccctaaggagttcttctcgccggccgtgatcaaaagtgctacggctaagagggtgtttgggaaagagggagtaaactttagtacttattttttgagagagggatctctcccaaacaccccctaattcgtgcctgggtttgagtggagaagctcattaagcgtcattaattaattctctgatattatactccctccgttcacatttgatggccatattacaagcgtgcagcgagaccaatgctaagaaaaactcttccattaatcagttaatgttgtcttgtcccttcagtttcatatcagatattaatactagtcgtttttcatatcaaattcccctccaatcagtagattttttttcctctatccgatcaagatctaacgatccacattcaacctcccattccaacataatcaaccctttgagctgccatgtcttttgatgcaagaagtatggtttccccctaccgttagattgtcatacgatgaatggagattcatccctcgcagttacaatggattgcaaacatgtcctacactcttaccaaaaaaacaattttgtctatattaatgacattttggccatttttatttcaatcaaaagttttaagttggcaagattttaggagtcgccatggaaaaaagaagtgaagatgaatataggaagaagacgtgtacatctaggggtaaggttggtcttacgatgtagaggggaggttgtagatgttaggcctgatggaatgaagtggcaaaagagggtataagggtcacgctacccacgaatttcatctgaaagtgacatatgagcatcccagctatctaagtttctatcttgatgagattttaggattcaaagtggaaaatacactttttaattttctaatataggggcatttctaattcccaagaagtacagatttcgagccactttaatgttgtcctttattatgttattagattttaggattcaaagtgggaaatatacttttttaaaattttcaagaagcagggatttctatgcacttccctgttgtcctttgttatgcttatgaacatatatgaataatgtgcttagtgtcatgaaatacggaaacggtacgaaaccgtcctgtacgttaatgtaacttaaaaaaaaggtgcctgtgcatcgttcaacatgacaaactaaaattaggatgaatattagatttgtaccttgaacttctccaaaaatttgctcaaactcaattcagaaatttgagagcgaatccaatttttccgttcgaattactttctttttttattagtatttccttgttcaaaatttgttcaaattctcatatatcaaaatccacccaaacatgcaaaaatccttatcacgcgatgccaccgatgatggatgataaaagaaacacttcaatatttttctataataagtaggtagtgaagatattcctcaattaccctagaaaaggatattcctcaatctgtttttataatttggataactctaaccattattaatatttatttttttcatttaaaattttgattatacaatcaatcctactttatccccttactcaaacgcaaacatatatataacgttcttcttctagcttcctggcttctgggtatgagtcacgggatggacacagggtgggccgggtagcagttcttactccttctgaccatgaatgatctttctagttttgaaatcagttaattgttcaacacacaaatttatttccattacatgaagttcaaaacatttattaaattaatctatgagaaaaatcatttacaaaattaaatacaaaaataaaaacctaccaaacattatggaacccacgacatgaaaaataaaaagcgtaaccttaagcaatatatgcaacactttaaatgttgtagaaacatacctaagcaataaatacaacactttaaatgttgtagaggaataccttaggccctgtttggctaatgggatagggaaatcatttcccacccactaaaagacatctttaaatcttaaccattcattatccctcttccatttaatcctaacccccacatttctcattatccaaacacacccttaatgtttacactttaaacttcaagcttcaaagattgaccttaacattaaggtgtgccataagagaataacataggatccttttattgattcacagttcacaccagttcattgggtgatgaacccgaggggtacctaaattcgatttcacaacctttaactgttgtagagttggtactaacttatgtcacttgcattaggccccacccttacggtcatcgttgcacatacattgagcttgcccttatagaataaactatgtggccatccaccaaaatggtttggcaagttactactacccgttctaaaataagcttatttttcatctaacccacacattctagtataaaagtggaaaaataatactcttcgctttatcaattcccctcactttaaccaattccaatgcatttgtcccatacttttcacaaaccccaatgtaatgatttctaaaaaatgaacttattttgagataaataagagggagcaaagataatcttattttaagacggaggaagtacatcatgaagtgtggcgacaaacacacaacaatgttttacatacttgggtgcgggagtgttgtcctgccacaccaataaaaatagcatatcttgaagattcatagagagtggattctaatccctcgagggaatgtcatttgtgtactttttttcctttaaatttgatacaaatagttgtagaaaaattctaaacttttttccactgtagaacatagtgatatctatggtaccccaaaaatcaagttcaaattcgagctacacatcgagaaaaaaaacaaatttagatgtggacaatacactactattcatacgttaaatttatctcttttatatcttgatttgtgagttgagtttagacctaagattctatggagatatgttgtacgagtgctgcaaaaaaaattcatatccgtttggatggtttttaagtaaacaagtagacatcccctcaagggatgaaaatagtttcccagattcatatatgtacataaattttttggaaggcttatttagaaattgagatgaaaagggtttaaaaaaatccaatgcaacatctcctagcaacaaaatttcaattgcaatgagttttttttcaaacaaattgattttaggcacactgattctttacttcaaaggacattttttgttaacgactcgcacaagacggtgcgaagttctactgatagagcagaaaaaaaaacaagattacaaccctagaaggtcttaatcaggaaaaaggaaaaaatataccaccacatacacatcgacagcgccaacacacaggtccgagagaagactagcactggaccggccgcggctaagcgtgaccgaccgccgctaggccaacaaaggaacatagacgagaatgctcaaaagcccttacaacctacacaaagccaactctatctagagtgtgcttgcaccaatcgttcgagtggttttgacaaggggatgcctaaacgacgtctccaaggagataagcgacggaaaaccgccgtcgctgtccgtcggggactcaaaagagccaagattgggcttttgcccgacaaacacccttgagggatgagacggcacgacaacgcccttaggagggggaaaccattgttgtcggtccgggcaaggccgggctaggttttcactcgccgctcacctccaagtccacggctgatgcaccgatgctccaccactgctcaacctctgccgacatgtgggaccactgcaccggcgcctcccgctggccaaccttcgtgcgccgaagaccgcgtcacaccccccgcagctcctcctcacatcgtggtcgcctcctttaccgccggccgtgcctcatcgcgccgcgccgtcctcctccaccaccggatgagcctctcgcgccagtccggtttcctgccatcggctgtgcctctcacgccatgccggcctccttgccaccggccatgcctctcgcgccttgccgacctccactgccaacagccgtgcctctctacgccaagccggcctccgacccctccaatcactgccgcaccggccaggtgcggccgtctgccacgcccccggctagccttccgagaccgccatgcctcaccaccattgcagccactactgccgatggccacctcgccgctaccgcgaccgtcgccacgagctccgcgccgttgtcgccgccgtgagtgcgccccgttgccacagcagccggcagtgccgtctaccaaccactgtgctgtcgccatcgtccagccgctaccaccaccttcgccacgagctccacgccgttgccactgtcgttgtcgcgacgtgctcgacgccatcgccgccgacgccgtcgccgcgagtcccgtagccccaccaccgccgtgagcttgccccgcactggatcggccctcgggggggggggtgtccgccttcggagcgaccgagccctgcccgccgttaccatcctcgccgccgccttccatccccgccgccaccaccgccaatcgccaccgcctcaccacgctgacccatcgccggcggtctccctgccagatccggtcatgatggcctcgaactgggcggccttcgccgtcccgtgcggcccccacccctggcgggagggagagacgagacgaagcccctccatcaccatccttgcggccgtgcggctttgccggcggccgctcgggcggcggcgaggcggagaagaaaggagggggggagcgggcgacggtggtggtttccacctcctgtgtcttccgtgagggaggacgacgcgggggcgaagaactgataatggacatttcttaattcgaacaataatgatatcaacggcatttcggtgccttgtgtttaataccctgatagataaacttctattaaaagcaatcccttccttccagcaatcaatgccagggtgaatacgtgttgtttattggctagctaataatctagtgctataattagcgcaccaataaaagccagaagctctcgtcaccacctgttcgaccggagtcagattgcgcgcgccgtcctcccccaccgccatggcgccgccgtcacggcatgtggacgcggtcgccgccgttctccctgtcctcctcacgatccttctgccttccgccgccgcaatcggcgtcaactacggcaccaagggagacaacctgccgccgccggccaccgtggcgaagttcctcgcgaaccgcacccgcatcgaccgggtgaagctgttcgacaccaacccggacatcgtcaaggccttcgccggcacgggcatcacggtcatggtcaccgccggaaacggcgacatcccgacgctgggcaccaaggacggcgccgccgcctgggtggcggcgaacatcgcgccgtactacccggcgacggacatctccctcgtggccgtcggcaacgagatcatcaacacggcggacaacgccctcatcggcggcctcgtcccggccatgcgcaccctcagggcggcgctcgtcgccgccggcttccggcgcatccgggtcgcgtcgacgccgcactccctcggcatcctgtccgtctcctcgccaccgtcggcgagccggttcctcgacgtcctcgaccgcaccttcttcgcgccgatgctggagttcctccgcaagaccaagtctccgttcgtcgtcaacccgtacccctacttcggctacaacggcgacacgatcccgtacgcgctggcgcggcgccccaaccccggcgtgctcgacccgggcacgggcatcacctacaccagcatgctcgaggcgcagctggactcggtgttctcggcgatgaagaagctggggttcgaggacgtggacatcacggtgggggagaccgggtggccgaccaaggcggagcccggacaagccggcgtgagcgtcgccgaggcggcggagtacaaccgctacctcatcggagaggccagctcggggtcggggacgccgctcatgccgaagcggacgttcgagacctacatcttcgcgctcttcaacgagaacctcaagccgggtcccatcgccgagcgcaacttcggcctcttcaagcccgacctcacgcccatgtacgacgtcggcctcatgaaagacacggtacgtacgtccgtccgtccgtccgtacgccgcgccgccggcgagtgcaatgaacgttgttgcgtaatgcaggggaagtcatcagcgtcggcgccggcgccggcgaagggcggcaatgccagcggcgccgccgtgacgaagcgtgactcggagtcggaggccgccgcgccggctgatgaggcgagtgcgcccgcgccgtcgtcggtggggaagaaggtctccacgaaggccaccgcgccggcaccgtcggacgacggctcggcctcgccggagccatcggagggcgaatcggccgacgagaagaatccggtgcgtgccgcgcgtccgtgctcgacacgatcgacgctcattgtcgccatcaccatgcatggtttttgtggctgccgacactgactgacatatcgttgtgaaactcctttgtggcgcatcttgcaggaggaggaggaggaggaagagggggatgatgccgccgcgacgacgacgccggggggcgacggcgactcgccggagacggaagccgcggtacgtacacgcattattcattcatgatccatgtgtccatgctcgtggactgcatcgaaacgagaccattgagaaaatgagagagatgcacgcttgataatttctctttgccacctatttcgacatccttttgaattttcatagacatatatattcaatttctatagtaatggaaatttttcatggatatcttcaagaaacccttagttcattaactatttttcttttgttgatcttgggcagggtgatgatgctaaagagagcgagggaaaaaacaacccccatggccatggagattcttcagaagctatcagtgttatgttctctgtaccttccatgcttacaattgctctgtctgcaatacttcttcatctctaacttctcctcaactcatggtgtaacaatagtgcaaatactaacattggtttttgccaaacactgaaaaactgcttctgttattctcctctgtgacttctcctctgttctaaattatagggtgtccttatttttagaaaactcaaacttaaaaaaaattcactaataattacattagcttatttatactaagtattatgcatgttatataactagatttatattttaaaataattttatgtgatactaatttcgtaggtgtttgataacataacatgaaataaatttaggtcaaagcatgtcattgaagccagtgtaaacttataatttgggacgagaggagtagtatagtgtcctttatatatactcctatgaaagacacaaatgatggtggtggttctactgccatcaccctctgcccagtgtgacagtgaggcccatatacggtaaatgttagttagacattttacatgccattttatcaattatataaaaaagaaccaggctataaaagtaaaaagaaatctgtaagaaaatttaatatcaactttaaattatgatgatgattagcaatcattttatagctaaccaataaaatttgattgatgaaagtatagtttcatgaatagacaatgagaaatgattttataaagatgaatatctcttttacaactctattgtaacgcatgtgcatttagctagtgatataaaataattgtagcacttattgttaatctattatattttgcaaaaacgataaggtcaatacaaacacacatggtactaagtttgtacatatataatttaattattatcgaagctttcatggagcaattttaaatgcaagccttcctaattaactaaaccatcacaagtttag

SEQ ID NO: 70793 - DNA, 699 bp, Oryza sativa
aattgagataaaagccttcaatttgttgaagttgggtgctaagcttttatggtgtgattaggacatgtgacttttctttttcctggttaattacgataattacgacccttcagggttgtaatcttataatttttttctgctctatcaatagaacttcgcaccttctcgtacgagtcgttccaaaaaaaaaaggacgtgtgacttgacaacgacggtagcataggggttgacgaagacagctctgatggatctgccggtggtggaaggagggatcagttggccatcttagccgacatggacgatgcaatcgcgaaggactggggtggactcgatcaacatggcgtgatgctacggcacggcgagaatgcggcgctgaagaatgagcgtggcgaaggtgcggcgttagggcagcggtcctcgaaataggacgtcacggataggatgggcgtggcacgatggagtttgcatgacaaggaagagagtgaaaactctatttggtgcagacatgcgtgggtaggctacctcacacgacacggttttctaccgagccatcgcataaagcccaagatggcataggatgaagccgatgatcatgatggcacagggatgaaacccatgatggcttggatcaaccatatatagtaagtgtttagtgattttatgcttttgaataattttttaatttattttcaaagtatg

SEQ ID NO: 70794 - DNA, 21374 bp, Oryza sativa
  unsure (1)..(21374): unsure at all n locations
cgacgtgtttgaacccncattgagaatgacatacgacttacacnaggcgaattcnacccttgtactcccctatgcctattaccaggagggtgatgaggacgatggcgctcagtaggtcttagttacggtcgttgcctgtggcaatggcgtgccgctgccttaactccgctgccttacctacttctgtttttggaatgtattccggaccgctcggtccgatgatttaagactgtgcctgtgggcttatgatgtaataattcgtactagactctcgtgtatgtgcacttgatatttcagctatgagttcgtgtataccagactacttgatccagggaaatggtacggtttacacgattgattcctgttataaaaacgggggtctacagagctggtatcagagccatacgactgtaggaaaagaccaaaaggcaccccacccctttttaagttggccaagggagaaattcccatttagtaatactttcaaaaataaaaatgctatgtttacaaaactcggtacgattttcatcttactcttaactattttctttacaaaaacaagttttactctcaactgactttgggtttttcttaaaattagatggcaagatccggattcacccgccacctgggagatgggcgtaccccgctcagagggatacgtcattgagctacaccggctgataaggcgtctgcgataccccagattttccgatctaccgagtgagacatggtggatctgtttgggaggctcgggtcgaggtccacaccagagttccttcagagttagactacagcttcccgacacgccaccgtcgcgacttgccggagatcgcgatgcaggatgctgcccgggaggccttcctccgacttagctctatccaccgagctgagttggcgagtactgagtttgctcaccacccgtttcgagaggagggcaacttcgtctgcacagttcaagacacaccttgctgctacaggccgataatgacccgactgtcacgatgggctgaggctgtggacgacttctacgaggaggccctgttggagattgacgatcagcagagacgtgtgggtatggctctagtagctcttctcttctctttcgtaagctttgtacttttattagaatactcttctttatacatttatggtattgaaatactttctaagtatataaatgccaactttacattatgttcgtgttatactgattatactgctagcttatttgggagatgcattggtacggatatagtgtttgcttatgcaattactctatgtcatgacaatgatattagagtagtatctagtagtttaggcgtagtgtctagattacgggcaaatagcgaaagaatgtttcagttcactgcaacatttgatccatacatagtgaaacattgcgggtatactaaacgaaacatttttcgatggaacaaaaaataaaactaattctgagggtttccaaaatatgtgggttttttgttgcaatagagtatctcaaatcactgcaacattagatatataaatagtgaaacattgtgagtacattaggtgaaactttttggtggaacaaaaaaataaaacaaattcccttaataggggtttccaaaatacgtgggttttttttgtaacagcgtgttctataatatcaaaattcactgcaacatttgatccgtacatagtgaaacattatgagtacactagctgaaacattgtaaaactactggttgaaacatcaaaagagaccatatgcaacatttaaaaaaatcaataaaaaattaaaatatttttttattaaaatataatcatgtgtggtcttgttgtaaagatttaattgtaacaatttagtgatgcaatcagatcgtacattagataaatagtttatgagaaaaaatcttttgaagaaatgagagatggaagcatgtagggaaagattctttgcatacaaatggcagaccatgcagcgtctgatttttctcccctctcatcggaggcctgacaactagcattctccgttgaaaattacaagtgtacaggttaaaatttaagagtgtacgtacagtggttgcatgctgcaattgtacagtcactttaatgcacgtggctgccgaatatgatgggaactattatggagaggacatcttctctttatttacatgtatttaaatgattatgaaaaaaaaatcaaattactatgtgataggtcattccaccaatacgtatggtcaaatttaacttctaaaatgttacaacgaaaaaaacaaatttaattgtaaatatacgtcgactagctatagtttagttttatttttttttaacttattcttgacggtcgttagcgatcagtttcgaccgtcaatattaccaaaatagagaactaattatgcttgcaatgcatatccatgttagaataataatatttcactagtatttggttcactaactttttgcagagaataatcataaagtggaggagcatcgacatcaaatcagacgatagatcaatcggacgatgtcgagaatcaaaattatacatgaatgggccaagaactcataattgacatgatgaactgggccaaaattcataagtctacgtataagagcaaaggaggaggccacatgccaagtttaggccaggttgggccggcccctggtttggccgaacccccgtggcgccaatggatgcagggtcttgatggacggctgggattgatccccaatgacgattggaggatattactgacatttccaaccatcataaccgtcattacctgcatataaaaggagctctcatcctcacttcactcacacacctcaagcaagagctctctcatattctctcaagttagtttagtagtcttaagctagtggagtaggaatagagtagaaatcggagtccggaagccttcggaagagttcgggtatggctctagtagctcttctcttctctttcgtaagctttgtacttttattagaatactcttctttatacatttatggtattgaaatactttctaaatatataaatgccaactttacattatgttcgtgttatactgattatactgctagcttatctgggagatgcattggtacgggtatagtgtttgcttatgcaattactctatgtcatgacaatgatattagagtagtatctggtagtttaggcgtagtgtctagattacggtgtatcattatttggggttatatgctgcggatgagaggtcggccgctgatggtgacagctcagtacgggtattcctccgtgagtgtatatagttctaagttaatttcctagggaggctactcctccgtatttagccccggttgtatggtcatgacgggctgtcgtaaggaactcggcagtcagggatggcttcttgaagtaccaggagagcatcggatagagggtattagctagtatgtcagataactagaatgtatgtatactatatatactagaagtataggaatagattatctttctattttctttcaacttagcttaggtaatttagtatgagaatgagtagttccatgcttgtgtgtcattctacccttgaattatgttaactcctgcttaaactatgattattacaagtaacatctaaattactagtcaggttctctctactatgatcttcccacgggattaaataaatacgatacccttggaatactctcgggtgaaatgctaaaatggtatatccgtgcgctcgcggatgaactctgtagccataatataccatgagtatttctgcgccattgctgtgaattatatttctagtaatgtcgttaagaaataccaacacttatagaagttgaatttcaacttgtatggttgtgggaatgatatatcacatattaataatcttctcaattttttttcataactatttagatgacatgcaaataacgaggggatgtgatccggtgaccctaacctccagacgaccagatccagtggcctgcccactagagaggggctaccactgcaacccctaatctccaggtgattgtgaagcggtggggaggagcattggcaccatcgaggagagagggagaggagacagggagagcgacggagggagactgagaggggagagagtgatggacgggcggaaatgttgttcggcgatcgatcgccctggggatggggcagcgatcgatccccttccccctccctccctccacccctccacccggtttccttttttggcaccgcattactttcctattttagtaaatttataaacctaaagtttatacacctcaagtttacacatctaaagtttagagaccaaaagtttataagtcaaaagtttatatatccgattcaaatttgaatttgaattcaaataattttttatatatagtatttctatacatctaaagtttatacacctaaagtttatagacctaaagtttatatacccgtttcaaatttgaatttgaattatatctgaatcaaatttgaatttgaattcaaatattttctatatatagtatttctatacatctaaagtttatacacctaaagtttatacacctaaagtttatagatccaaagtttataagacaaaagtttacgtacccgattcaaatttgaatttgaattcaaatattttctatatatagtacttctatacatctaaagtttatacacctaaaaactatagacccaaagtttataagtcaaaagtttacatacccgattcaaatttgaatttaaattcaaattttttatatatagtatctctcccttatccaagaaacaaaaggggacctctctctctcccttatccacactcacagaaacaaaaggggaccgggcggccctcgggagaggcggcggcggaggacccgacggccctcgggagaggcggcagtggtggttcggcggtaccccatcctcctcccccttctttcttccctcctcccccttctcttattttctcgatctggtgcgtggctcagtgcgcggtgcatggcggcggtgaggagggcttgacggcgtgcagatgcggtcgcctcctagaggtcggggttgaccggatccggcggcggcctccaactccacgcgcgagcaccggccgtcgtcctcaccgtttcaagcaccgaccgccaccgccaccactgaggtcgggggacgctggatccagcctcctagaggtcgggggacgccagatccggcactggacagccttctcctcttccgtccccaagcgccctcctccgagagctagtcacctcctcctgcatcctcgcgcggccaccgccatagcttcctccaccattcccaagtactgattaatgtgtttatgtgcttacgatttggtttcagatcttgcaagtcatcgattccaagtttttgattcgggtgtggtcttgttgaagccccatgatgtgttgccgctggagattaattgatgttagaagaagacctgtgaacttttgtcttgtttttcttgaagatactagagattttttcgttgtgatgtagctagaaaattagaatcttaacaatttccctgaaatgcagtttcccagtagtttttagttttgtagtttgtttttcggttcctattgtaaaacttgtaagttctccggcttcttgccatcttttgaaaggaattagtttgaaatgtttggggttaattattagttcttcggcttctattaccaattttctatggttgcaactgggcaccatttttttaagatgactttccattccagtgatgggttctgtcgaggagcaaccctctctagcgggtggtcgtgagacccccccccccctttgtgagttcgaccgggggatacagcgcgatgatcaagggcctacttcggcttggcgtttaactactaaatcgctctcggggctgtgtggaagacaaaggattatacaggttcgggccgctatcgagcgtaataccctactcctgtgcatgggattatgatcaacttttacaggatgtcttgagctctggaggggaccctagccgttcttcctctcgaactcaaaactatctgagagtcgtcacttttttcggtgggcgaggtcctccttttatagttcaaggggataccacatgcaccgtccatacctactcctccaggggagaggaacccaccctgcctcgattagaccgccattcgtgccttcaaccggaagcaaggtggctgtgcgtccttgggtggggcccagcgccgtcccccgcctgacacgggggacatccctgtcattccccctttaaatgcatggagactttggtggctcaccacgtccggagggcacccctggcagcatactgacgggacggggcgtacctgcccccattccgcctgacacagggcgggacgtgggggcgctgccgcccgcccaatcacctgtgaccggtcacagaccagtcactcccgattgacatgggtcaatcgggcggcgccgtacatccacccacaccgcgttaaaatgcggtgagggacggttggggcgccacgcattaaagatcctaagaggcgtccttcgcaccgcccgctctcctcgccacgtggtggccgtgcgagggcctcggggtagcacgccccgaaagcccgaggggtatgacgtggcaccccgaggcccccatggccaccttagcgctatccaaggggcaggaggacgcgaggccgcgtggccgcgcgactagacgggaaggacacttccctctactgtgcgtacccccaggcccatttcaccgacaggttcatatcttgaactcgttggaggtgagtctcaggtgtctacctttgatgggttgcaactacacattggcttgtggagatcctcacctttgacaggccggaaaatacggacccgtcagaggtgagtgtgcctctgacgggccggtcacccatcaaaggtgattggacttgccagtgaccactgatcactgaccaagcccaaacccgtcaaaggtgagggtttgggcccgtcacaggtgacattatccagtgtagtggatgaaagagttaaagggagtaaaattgacttttcttttttaaatataagtgtaatctttaattaacgggtatgattgatatctgctttttaaaatataatgataaattgtacctgtggcgagttagagtacagcccatgaagatttggttgttacaatacacacatctagtcatatttgtgcataaccaacctaactcacattaaaaaaatgattcaactcctacagtttggtggattaggatatatacaacagcaattagtgggacactataagtaagttaatacttttttttgacgtcgatgagagtggagagcgagagagaaaaatgagttatcgtttctttagacagcttgggataacttagttacgagaaaaaggagagatagatgatattggatatcatataattatctttcatatgtatacatgtcatattgttttctaaattatctctatttaatgtagatactaattaacacagacaattaatagcagtaccaaagttgtagtgtattacaaaagcaaaatagcaataatagttttatcacaaagtacgtattcataacgtagacactcatgtaagtacacacccatataaactcgcccctcctgatatattggatcaatatctactctttctatatagttacaaagcatattaagcatttaaaactcaacatgcatgcaaacatagttatcgatagtacatcctaaagcataacattcaagcatgacatatcaacccaccaagtatctataaaactcaatatgtaagcatagccattacatatacaatttattatattctaaagctaaacatataagcatgtgttgtaatatattccttacatcattttttttacaatatttcagcccaaattggtcaattatttctacaacatttaacttatattcactcttgtattccaccgcgaagcgcggtgcatcatctactatctttagattaacatagtcaccaaagtccacaagtccctagttggtacgccacataccactaaaaaaataattagcgttaaatacgaacaccaataccaagagtaggaccggaatccaagcaggtaggatctaccacaagaaactaaatcaattgaggtatgctcagtttgcatgaaataaataattatttttttgagaaaatatgaataacccctacaaattagtgatctttctaatctcccacctgcaagttagtttcatgcaaaacattgctcacaagtccattttctcttccaacttctcacctatatctatcttttattgatttctcatcgcgcttagcgattcctcgcatactgtggatctctagcatggtgtgcatggaattaatttgtagggaggacattgaaaaaactagtgacttgtagggggtatttggatttttttttcctctttaatttttatgtgatacttaaaccaagttgtggagggtttagacccttttttgtccaacttatgtactagctagtagattgctgaaacaaattatttgctccacacttcaaaaaatatacttttctaaaacaaattcttctattgcattacttagatcattgttttaacatattcgttaagtttatttctgaaaatatttaatttatgcatgtgatcacctagattgtccaatgcaataatccgctgaatagtctaaaatcaaacaggatattaatgttgctacagaacatttttacaaggcttcaaaatgcattaccccggttattactcgatctgcatttagaaaacactagccactccattgtttcgcttatgcgtatatttataagccaaaatttaaatttcaacacttaatttagatttgattttatggtttttcttatcatagtttatttcacaccatttgcttttgaatctctaaggacacgtatatggaagttttacccaaaaattattttggagaaaatttactatgtaccactaaatttgtcctagttcaataatttactattgacattaattgtcccttctataataaaccagcgagtttactaattattctataatatgccactatgcttgtttcttttttaaaaatacctagaacacccttataaacatacaagttaacaattgatttattctatcaaaaactttcagaaaaatatgaaatttttagcctctttacacaatatataagtttcagtatttttgcttttctatttttttcataatacaatttatctgctatatgctgtatgtgttgttgttttcaatgcaaatctttaaaaacctagacaacacattttttctattatataccaaacaaaaaataactttcttaaaaaaataaaataccaaaaattatcttgaaagttatatacaaactactttccatgttgtataaggaggctatataaaaatcatatttttttttgaaatttttattgtaataaatagattgttaaccttatatgtctttgagatattttgggtaattttgaaagaaaaagttagaacaatcgataaactcgctggtatattatattaagagacaatattaatgtcaaattgttaaaatgagatgacattggatagattatctcattttggttgtttataagtcgaacgataagtataagtgaaacgatggggctgcagataaactagctgagtttcaaaattttggtaagcacaagatgaactgaattcaaatttttggtaaattttatatgaatttcactggttttattaatgactgctcggttatttgtcgacaaaaccgttggcagcggttggtggacaaatggtccaggaaattaaagtcattctctgctatcatatcttcagatcgtcggtctctttgctattaattgcgttgtggaaaactcagctttgcttcctcgactggtcacttgatccccctcatttttactgacagtactgtttcaataagttttctagtatttacatgttaaaatataagggattttattcatataattatatagataaaatcctgatatttttggaacgaatgaggtagtacgtacctgtactatctgcatagtttccttctcttttagtggcaggttataacatactagggcgtgaagcttgtgagtattgtaggtaggatttattcggatactctaggagtctaggtgactaggtgcatgtttcttttttccctactagatatatgcctatatattaatgagaatatatgtacctttcaaatatattagagcatggatgatataaaatatgctgatgttaccatcacgacggagatctgccatgttgaaattaattaaatgacaaggacatcaggaggaggaaaatagtggagaaggatgatgccgtttgttaatgttaattagcaaatatataccactatggattctcaattgaaatttaagccaccttttgtttcaaaagttttattttagatcaccttaattaactaatattttcactcgagaccagttaaatttacatttttttactttaaccaccataattctcttctattgccatatttaaccacatccctccaacaaaagatatggcttgcgcacaagagaggggtcatggtgtgttggagataatgtactcaaggtcgttcatgtggttaagaaatggtttgggatggtccaaattactatataatgataaaattaactagtccaaagtaaaaaaggatggaacaaagggtgggctaaagttaaacttggtaataaagtgatccaaactgcaatttaacaatagttaattatataaatccactaagtgaaaaaaaaacttatggtacgagttatgtctatattattcaaatgtctctatactattttaaaagtgacagaacttactcccctaagtttaagtcccaaaattgacacgtgctcatttttacggctaattattttgttggtgctaggcaacgtacctatcgatatcgatatcgagatgtgcatggatacttcatcaatatttgccaatcttaaaatatgacacatcctaattctactctttcaaagatactcatagagatatgtgtgtgtatttacgtttatagagataattgtgtgcgtgttgtgtacatttatatttatactgtgtttctaaaaatattaaatatttagtcatgtggctgttactgtataaccgccgctgtagcttgatcgaggtctggttccatcttccagctctttcatctttcatctttgcacccaacccaaccaaacaagtcgctgctaacatgacagaaaagcccacctaaccgcgaacgtgcaggcaggtcgagggctgagctggccgctaacacacactcattagagcaggtacaatagcatactattagccagctataaacatattttaatgagataaacgataagagaaaaacagcgggctacagatctgtagccagcttcaacacgaactataagacgcaatgtgtatgataggtgggaccatatattaatagtatagtaagcggctattaaattggctataaataaattaaagccggtagtaggctatactattaaacttgctcagcagtaggtaatacgtctctttttcagtacagtccacatctttaagggacaagtcatgtgtgcctcgaacaataactggttggtccggagcacaagtcgcacaatctttttcagtgctgaataatatgcactgttcattccagtgggcctcaatttactgactcgttcgttatcactttcttgctgcccctccatattcggtaacctttgatattgtctattttctcgcacctccgtctcaccgatttcttgcagtaggcagctggcttgttcctaggctgagtcgtcttggcgtgcgggggcggtgatggcaatgtaggccctgtttggatctaagggatattttttagccctccctcaaatagcctaaataactcaaaaagatctaaaagggtgagctatttggaaatagcccacccaaaaaactatcccacccaaggggtgctaattggggctattttaggtggggcccactgaaaaagtggcttttctctctatctctctccatgagaaggtacattaaaagccagatagctctcaaaatagcccttcgatccaaacaacttagagctattttattggagagttattttcttgtgctaaaaaatagctctcaaaataactcttggctagttctccaaacagggccgtagttgaggagaggccaaacttgccgcacattaattgagataaaagccttccatttgttgaagtttgggtgcttaagctttatggtgtgattaggacatgtgacttttctttttcctggttaattacgataattacgacccttcagggttgtaatcttataatttttttctgctctatcaatagaacttcgcaccttctcgtacgagtcgttccaaaaaaaaaaggacgtgtgacttgacaacgacggtagcataggggttgacgaagacagctctgatggatctgccggtggtggaaggagggatcagttggccatcttagccgacatggacgatgcaatcgcgaaggactggggtggactcgatcaacatggcgtgatgctacggcacggcgagaatgcggcgctggaggatgagcgtggcggaggtgcggcgttagggcagcggtcctcgaaataggacgtcacggataggatgggcgtggcacgatggagtttgcatgacaaggaagagagtgaaaactctatttggtgcagacatgcgtgggtaggctacctcacacgacacggttttctaccgagccatcgcataaagcccaagatggcataggatgaagccgatgatcatgatggcacagggatgaaacccatgatggcttggatcaaccatatatagtaagtgtttagtgattttatgcttttgaattattttttaatttattttcaaagtatgtcaaaattgtgtaaacttttgatagagatttaaaacttttaacctgaactttaaactttctgcccaaaatttaaaaccttcatctagattttgaaactattaacttaaattttaaatattctactgaattttttaaaaaaaaataaattttaactcaaaatttaaaactttcaaatcaaattttaaaactttcatatcaaatttcaaaactttaaactcaatgttcaaaactttaaaccccaatttcaaaaactttcgactagatttttaaaatctttctaccacaaatttaaaaacttcaaactattccttaaaaacttttaactaaattatttatgtagtggttttttaaaaataataatactaactattgtcattagtgttaatatgctcatcggcgtaaggcgcgcgtggctgtgcaacttgcgtagctaggatatgcgcgcaaactagccaagcctgaaagagagggtgcatgaccagtatggcgctgctagggcatggaaagacatgagaaatgcagactccgatatcatgtgctccctccgttaaaagaaaaccacttctggatttaaatctagatagagaattacgagatgtcacgtactcaatgtgagagagggggaactgatatatatatagccaatatacaccagttataacatatgcccaaatagaggagatatatatggcaagaagagaaaaggtggctatataaatgtgcaaatatctataatttctttatagtagcggccatcaatccacctcccgctcgatccttgttggttcttcaccgtggtgagggctccattcctcttccttgtctgtatttcaaattttttccatgagatttgtctaccatggaagcaggataaagatgttaggatcggttagggttttcactataccttgcaccgccaccatccatcttcctcgaaaccgtctagtaggccactgtcgcctccctcggccatagacgctgaagcgtcccgaggaaatgtgttagaactcaaggtcgaagttgtcctgctagcttaggtccccaactccccatcgttaaaggcccaaggtggaaagggagaaagggcatggcatgggctttaggggcggtctgtcttcttgggcttgccaactggaggtaggaaggtcaggccagcctggtttggttggcctggtgggagagaaaatgaaaggaattgagaagaataagaagccaaattagactttaaataggtctcgaaggatttcaattctacaggaaaattttcctatgaaagtgtttgaaacaaaagattgaatcatatgctattctttgaaatttctattaaatggacaatcctatcgagattttaaaggaaatttaacaagtgctctaacctcttggaaatttttctttgagtctatctctctcatataattcttttgtttttcctgcggtctaatcaaaagattatttctgtgttttttttgtgtgttttgcaatcctctattttgaacttgcattcctatcaaaattctgcatttttcctattcctttttttttttcaatcctgctattcaaaatagcccttatgaattttagggtttggattaggtgagttgggttaggctaatagacttttaattctaagtttgaaaattagtttcttaaatattttagttcatgttaaggttttagaaaataaataatatttatttcctttttttaatataatttattgatttaaattaattcgtaatcatgtttttaataaatgttgtatgaatttcatattttaatttagaatttaaatatgttttttaattatcctctggatttatttattttatttttttgcactggcacagaaagggaaaatccaataaataccagcgtgatgcaatttgaaaaaggttttattattctaaatgtttgtctccaaattttcagatttaactattcaaacttgacaaataacgatccccccacttaatctgaagtggttttggttctacgtggcattcgcgtcacaatctggtcattatttttttattaaaaaaatcaatgagccacacctattagattctctcccttttcttatatattttcccttcttcagtgattaaattgaattaaactccaacatgctcgaccagtttcagactttcagtaccagttcactttaaaaaccaaaagtgataccaatattatttttagtgatggttttaaataactaggaatgctgtggtggtcgggattgatggttgtgtggtaatgtaaatttcataataatataatactccctccgtcccaaaatataacaacttttagcccttaggatttatcccaaaatataacaacttcttcaccaatattctcttcccaaccaatcacaattctccactattcacttctacctactttcttaataaccgtgttcaactctaaaacttcttatattatggaacggactccactattcacttctacttattttcttaataaccgtgttcaactttaaaacttcttatattatggaacggactccactattcacttctacttattttcttaataaccgtgttcaactctaaaacttcttatattgtggaacggagggagtagtttgctttgtttctacttcccgagttaacttatatctgttttatgcttatttagaatataggtttttttagtctttttggaaggacccacaccaaagtaatatatatatatatatatatatatatatatatatatatatatatatatatatatatatatatatattccaagctagaacattaatctttgtttcatctggatgtgtgtgttgttggatgtcgacactatttggtttcagccggaaaaaaaacggcattacaaatccgagaatttccacactggtgcttgccgtgcataaacttacgatatagatgcaatctatctattatattactagcaaaatgcccatgcgttgtactgggggaagaaaaaaatagtaattagtgtgtgggagcataaacaccaggttcattgaggtctttatagtcgaatcgaatctttctagtgcaaataagacgctaacatgatataattatttgttgctctaaatccactgacatggatactaaactttgaaaccacaaaaaaatatttacttttttgtcatgtattattatgagtcaattgcagtactttgttattttttttactcgatattgataagcactttttttcatattgtaaagagtaaccataatataagatatattttttgctagctatcagattaacctcactgcactccaattgcataaccactcacttaaataatcagaaggaaagaaaaaaatgtggtatatcgcagaataactttcactctaaataatagaagaaattatacgatgaatgaaaaaaagtgatgtgattaggtgtcctgtggcgaatgagcaattgatgagggaaaaaaaatccaaatgtaaacacgattcaatttgttggtgattactttttttttaaaaaaaagaaagacacatgtgattatttttatttttaaaaaagaatttattttgtcggtaaataattcattttattggtgactacatgttttaagtaataagatctcttctttactttattcgtgttcggttgctacagtgttgcgcagtactgtgctgggctggtgggctgcttctcctccgctctgtgggctcgctggtgggctgcggctgctatctgggccggtctgcagctgctttggatgggctgcctcgtcactaatccaatccgggctgctttggatggactgctccacaaacaaggttttctctttttatttttcttctctcctttatttgcaggcgtaagagatcgtggccacgctttcggatcgtggattagcgacgaattatcgtgtgggcccactcttaatgacggacgaaaagattaaccggaagccttacttattttttaattagttatatagatatagatagatatagattaaaggaatagaaaaaggagcctccacgttcgctcttatagcctagaaattctcacattaatcggagaaaaataaaaaaagtagagtccatataaaaatacaatttagaaatagctgaaattcggaattaaaaaataaaaaatattagaagaggagactagagtccatatagaaatacaatttagaaatagttgaaattcggaattaaaaaataaagaatattagaagaggagactagagtctatataaaaatacaattaggaaataactgaaattcggaattaaaaataaggaatattaaaagtagagtatagagtccatatagaaatacaattaggaaataatagaaattcagaattaaaaataaggaatattagaagtagagcatagagttcatgcagaaatacaattaagaaaaaaaatagaaattcggaattaaaaaataaggaatattagaagtagagtatagagtccatataggaatttaaaactaactaaagttcggaataaaaagagcctccacgttcgctcttatgaccgagaaattctcacattaatcggagaaaaagaaaaaaagcagagtccatacagaaatacaatttagaaatagctgaaattcagaattaaaaaataaggaatattagaagtagagtatagggtccatataagaatttaaaactaactaaaattcggaataaaaaggagcctccacgttcgctctcatgacctaaaattctcacattaattggagaaaagaaaaagatttataaatagctgaaattcggaattaaaaaataaagaatattagaagagcagactagagtccatatagaaatacaattaggaaataactgaaattcggaattaaaaataaggaatattagaagtagaatatagagttcatatagaaatacaattaggaaataatggaaattcgatattaaaaataaggaatattagaagtagagtatagagtccatatagaaatacaattaagaaaaaaaatagaaattcggaattaaaaaataagaaatattagaagtagagtatagagtccatataggaatttaaaactaactaaaattcagaataaacataataaaatgaaaagtagtgtttagagtccgtataaaaatataatttacaaataactaaaattcgaaattaaaaaaaacatgggaagaagagtttaaagttaagataggaatacaatttagaagtaactgaaattaaaattaaaaattaaagaatattgaaagatgagtttagagtccacgtagaaatacaattagaaataataaaaattcaaaattaaaaaaaaatattaaaagacaagtctaaagtccataaaggaatatatatgatttacaaataactaaaatttgatattaaaaataattaataactaacacgtatataaaatacaatataaatattacacatcagtagtttcgtaaagttattgcaaaatttaaaattatgttgtcattgtaatatattttaataatataatgacaaaacgtatatgctattatatgagagaaaatataatgatactatccgcgcaatttacgcgggacaccttgctagtttacaatatataaacatataagatgtttaaaccgttacaataatagttcacagcccacactggtgcaattgggctaatcagagcgattcggcatcaacatgtcttatatatacgtcggacgtccgaaaatttgcgaaatatcagacgatgctccgcatgcccctctacccctgctgttgccgtttttttgacaaattggtccttatagaaaacttatttcgaaactagtccataccaaaaactatatctagaggttgttcatatcagcgccaatgggactggcgctgacatcgcgccagcgtggcgggcgagacgcgacgtggcagggcctcagcgccaatgtatttggcgctgaccccttgtacaggctaattaaaaggatgcgcggccattaataagcaatgcacttgtggtgcaatggtatgaccatttgcttgtgtaccctagcaccatggttcgactccctatcacggcagccttgttcgttcttttttttttcttcaaatcttcaatctacgtgcgtacattagtacatataaatgattaatgatgctctctgttttttaaatatatatatatatatatatatatatatatatatatatatatcagaatatatgttctacagcggcgctggcctttatactggctaaataaaagcaaaagcaaaagcaacaattaggtttggcttagctcagtggtaggtatttgaaaggtggcgttacagtgaccagggttcgaaccctctcctttatgtttttactaaactttttttttacttagttctcaacttgcggttttaactttttcaaagctcaggtatttttaagtccattcttttatttttaaatatgtactaaatgtgttattccttttaaatattttttaaaaaagtgatatttcttttacaagctcaagtgttgttttaattttaaaaaaacacgtgacattttagaataaaacttacccttagttctcaacttgttgtttattttttaaaaaaaaactcaagtttttttaaatccattcttctaatttcttttttataaaaaagtgatatttcttttaaaagttgtctctaaactttttttaatccattcttctactttttaaatttgtactaaatgtgatatttctttttaataaaaattaatttaaacaaaaaaaagtacattgaagatttgaagacaaaaacgaaaatggagatcatcattaatatatacgcacgtagattgatgattttaaaaaaaaacaaaaatggctgacctgggattcgaaccctagtcctcagatatagcaagaaagaaacttaccgttgcaccacgagcgacaccgttaattcattgccgcacatcggtctatttagggtgtgcaaggtgtcagcgccaagtgcattggcgctgaggccctgccacatcgcgcctcgcccgccacgctggcgcgatgtcagcgccagtcccgttggcgcagataagaacaacctcagcaccaaccgctttggcgctgatccgacggcctatttctggatatagtttttggtagggactagtttcgaaataagttttctgcaaggaccaatttgtcaaaaaaacgccctgctgttgtgttgcatgcgctgctagctggcaagtagccactgccacatagcaactagcatgcctcttgctcacatgcagtgttgtttgaccatcattgctatttttttttctctccccattttcttatatatacgtacttattcattacatatctttacacaatattttcttttaaaaatacatatatgatgcacgatcaaattagaatattatatttgtcttaattaaatcgttagaataatatatcacattgatgaaattatatatatagtcaaccattgtttcactatttatataaaattgtttcatcgcatgaaaaaaaatgtttcaactcacttaataaatattttatagagatgcaacatttaaaagaattgtttcattatttatataaaattgtttcatcgcatgcaaaaaaaaatgtttcaactcatttaataaatattttatagaatgcaacatttaaaagatattgtctgcaaccatgataacaattagacgaaacattaagttctatgttatagcatgcatcaatcatcaagttgtagttgttgaaaaataaaaaatattgctgaaacattcaaaacgccaacatgtgcaacatttacaaattacatagtgaacaccacgaaatatttattgcaacatctaattaacactacgtgcaacatttaagactgcaacaaactaaaaacccatcaaaatattatcaagtgagatcttattataaagatataatcgtaataaatccaaccgtgtaattagattatagatcggatgaatagttgaatagacaaaatcatttgaattttgggatttaaatgagtggccgactgcttcttcagactgtatggtcatggtccatgacgtcatgccgcacaactaacgctgatgatgtggttaaactttcatcagacggctaattataagcatttctggaatcagcatcttgcaagtttgtccgatgttttggttccgcccggacgaccgatcctcttctgctctgccctggcttgactttcgttagatcttcttctacacaaacatttatacggaactagaaatagtttaccgggattgctatatggcattcgaatgaaatttagggatgaaatcttacagattttagaccattggatctatgccaagattcgtgcatcggcttctctcctccaactccggcgggctcctcttcttctccggcgccggcgacaccccaacttcggcgggttagggtttgaggttggggtgagggtaggaggagggttgggggag

SEQ ID NO: 70795 - DNA, 522 bp, Oryza sativa
ccgttgccgtcgccgtgggccttcgccaccgcctccgagcccctttaaaaggatccccgtgctcttctcttctcgccgccaccctcgccttcgcttctcgtcgccggagtcgtcctagcgccgtgcgccctagcttcgctgtcgccgccgccgctccagccgtgcgccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtctgttggtcgtccgccgtcgccttggtcgtcggtgagttcgccgtgccgtccgctacccgttggtgtcctccgtttgcgtcctagtgccgccgttcgccggcgagtgtccgccgcccgagccgtcttctttgccgagccgccgccgccgtcggtgacgtcatcgctggcgtcatcaagcccctctcccgtgagccgccgtggactc

SEQ ID NO: 70796 - DNA, 607 bp, Oryza sativa
ttctttttttttctgcttttaatattgaatattgatttcacaccatcccctcccatatccaaatcatcacatattacagaacatctccaaatcctcaaacaaatcatctccaaatacattacaaactcttaaaaaaattccatcacagggttctaaaaattcatcacagattcacatctcacgcaaaaatacatcacagattcacatctcaaaaaaaaaagaaaaaaaatccggccggcggccactgccgcctcccctcctcccctccgcgccggccggccagcgccgcgccggttgccgccgagcggccgcccaccgcagccgccgcctccgcgcagcctcccgcgccgccgtgccggccgcccaccgccgccgccgcgcggtcccccgcgctgccgcgccggccgccatgcaggccgcctgcgcgccgtcccctgcgtcgccgcctccgcgccggccgcctgcactgtggtgaaggaaaaaaggaaggagaggaggggagttagagataaggaaagagataagaagttagagaggaaaaaaagagatagagggaggagtttgttgtgtggacgggaaaagaggatcggtactatggattatatag

SEQ ID NO: 70797 - DNA, 39360 bp, Oryza sativa
caggctttctaggaggtggatgagagtgattgagtgtctgcagttcatatgccttgattacagagattttaaacattggaaggttgagaaatttgctcgctttgtggacaacctattactcatccgttctaaagtagacctgcatactttccagctttattggtttcattatcttccactgaactgcaatgatcttaggaagtggatcctctatgcggtgaagcacaatgttaaagtgcttgatgtggaactggatatgtatgataaaacggccttaccgtctcgcattttcacctgccgttcagttgaggagctaagtttgcagatgggagaagcccctgatgaagatcttgaacacgtaggccttgtgcttccggacataattcaacttccttctctcaaaaagttgactctctctgatgtagaagtggaccagctttctctgaaccaattcatcggtcggagccctaacctagaagatttgcatttgataaactcggcaacatatcttgatctgattgcctccaaagtgctaaaaaggctaactcttgatggcttcatgcatgggcccaaaagattcacaatttccgcccctcatctcgttcactttgagtgccagggttgtgcactgcaagatgtttcttggggagagaaaccatctctagagagtgcacacatagatacttgggggaagaaatatgatggtgaatctgagtttattggagtacttttatctgccaagacactcgcactatttggttctgacgtcaaggtatattcgcaaaagacaagcctgctgtcttttgttacttctctactcttttgttttgcaaaaatcttgactatatttattctagttaactactctgaatgaaaatgtgcatggcttgaaactataccaacttggtatctagggcttgtgtaaccgactagaatcttggggatttgatatggaaaaaagggttctattctggaaagatcagatcatagctgtgtctgtgtctacttgctgtatatcttttctaattttgcccttcgtatatgtgtcctgcaaaaagagtaagtttgctagttcagtaattagtagttcctttgatctgttagtttctcccatacaactttcaaagctgtcagctgtagtatgaaaaatttgtacgatatggtctcacggtaatctcatgggatgaatgtggaattttctttcacatgtcaatattacattgttattatgcttggagtttggaaatgtcctggttttagttcttagttatgacttgctcactcactcaatacaaggttatgttggaaaaggagctgccggcatgtccagtgtttgagaggctcacaactcttgaaattggtaagtggtgtttaactgaggatttctatactgtgcttcgtttccttcaactttcgccgagactaggagaactgacattgatgcaagaggaggtatgccgcacgtaaaaatcttgcatcatattggaaattcctcattaaatacacccctctttttatttatttcctgttatgtctctagcttcctcacgcagcaagaaaaggagcagaaacagatgctatgccaattgatggaatgaccttccaatgtccgttccttgagactgtcataatacaatgttccaagggcgatgatgggatcaacaagctggtgaatgttctggcagcaaatgggattaacccaaagaagatacaggttaatttctatgaagatatcgaagagatggagcgggctgagaacaggcgcatcatagaggagcgggagaaggagctgtgcaacttcgagaagatggcgaagaaaaacccagaatgggtcgacgaaagccgttatgctgacagtaaccctgaaactgatagcgatgagtatgatgatgactacgatgatttctagagtcctgcagggtgtgcttccatcctttcgcggccgcatgaagcctgcattttatcttcccttggaactgacttggtgtaatggtgttagagactttaagcatttgcctgtttctgtttattttgtgctcgtgactgctggactataatggagcaaacaagacaatttgtaggcactaatcctttgcggtttctgtttgatcatattgctttctccatggtacctctcagccttttgctgctcttgacatatcttgagctctttgaatttgaaagtgaacttgagagtgttttgttacatgaggtcgaaaatcaaaaacaaatttataatgagaaaatatcattggacagaccaatgacaaaccagttgtccaatcccaagctgactggcaagatttggggtcggttcaagggagccgtccgatcgtccgttaacggatacgatttagtcagaaacaattgcgaggaattttaacgaaggcccttcttgtcatgggcctcctttcttgtgcttatgttttggcccagtagcttcatacccatacccccaagcaaaacctagccgctcgccgcctccgcctccgccgccgcgacgagatggaggtcgacagggccgcgagcgccgccgctgcgggggagtcctcctccgccggcgcgatggcggtggagaagccgcggttcgaggcgctgatgccgagcgagatgagcggcgggaggccccagttccggaaggtgccggtgccgcagcaccgcttcgctccgctgaagaaggcgtggatggacatctacacgcccgtctacgagcacatgaagatcgacatacgcatgaacctgaaggtagataaacccgatgctaaaaactcactcttggttgtatacttatgattctgttgttcggggcctcaaattgggctttcgtgtaatatgtggttgcgaattcggtttttaaaaaaaacgtggttgcgaattgcgaagggtgagacatgtcctgccaggcttcgtgatttttgagcatgacgccggggtgtaaaagtttcatcttagacatttacaggttaagcgattgtgtgaaccatatagtaatagttagaacaattatcgcagctgttacaaagttggtagtgacatgcttggtgctagaggatatcttagctggtgctaggactaaatggtggtactgtttagttcagtggatcatggtgtaaaagtgtgctccttttatggccattccttatgttgtagattcctcattggaactggaaagcctttcatggatgcgtctggtgtaagagctttcatggatgagtccggttttaacaacaaagttttggcaatatgactgaatataggaatacaaaaagaactaagttagtattgcttatagattcaagtttgccaaacacttggttatttgtatttcgattcaagtttgccaaacacgtggttattagtactatgaatgtactatgccaattcagtaaaggaaagtgatgcagaataagtacaaatcacaagaagaatgcaggttgtgtctaaaacgtgtaggtaaattggttttcttgtgaattttcagttattactaaactcgaatggtggctaccatgttttctctgatgttttttaggtaacgcaacgactgccatcagtgcttacattattttactttctgaaaaagaaaatcctgtattaccattttaatattgaatgctcatgcctgcactgtatccactatcaagcttttcaacctgtttctgttatcccaggcaagaagggtggagctaaaaacaaggcaagacacaccagatgtgagcaatcttcagaagtgtgcagacttcgtgcatgcttttatgcttggatttgacatcgcagatgccgttgcattgctccgccttgatgacttgtatgtggattccttcgagatcaaggatgtgaagacactccggggtgagcatctgtcacgtgctattggccgtttgtcagggaaaggaggcaagaccaaatacgccattgagaattctaccaggactcgcatagttattgctgacacaaagatccacatacttggatcctttgttaacatcaaggttgctcgggattcactctgtagtctcatcttaggttctcctgctggcaaagtgtattcaaagctaagggccgtttctgccaggttggctgaaaggtattaaatgagttttggtccaatcatatagttgcagttttgatcttatagtatgttctactagctgatttgtgtgagtgggcaacttattgtaatgttccgatgaataaccaaatgtatgctagtaatagatttgtaatgatatgccttttctaccgcctgtttgagggaatggtaagtcgtgctatgatgtactgcatgtaaaatgtttacatccagctgtgccactgaaatgaattcagtgccagaaacctgataagttgcttcctagaattgtcaccccgttccttcagaatgcaagaaatgttgatatcgtcaagctggtgatggtcgtttgttcttttgtcttgcctattatgctccgtcattctggttttagttcttattaccggtctattagaagaagccattgcaaatcttgtttgtgctgagaaactctgcctgtcaacactgcacaaattactaaccaacaaattgagattttttttcgtctggtttggttcgtgtggaagtctaaaaatgacttgtgctgggatgcattttcggatgcttgactatgatgccaaatagaacgtgtaaaaaagaagtgactagtttactcccttggtcccctgtctcaaaatgtaataatttataattctttaggtgatagcgaatgttaagaaggaattatggtagaaatagctacttatcttcgcaggatagataacccgctgactcggattataatagagtcaagagataatagatgtaatatgggtgatttatactctctccgtttcaacttataagatgttttgactttggtcaaagtcaaactactttgagtttgactaagtatgtagaaaaaagtagtaacattttcaacccaagacaaatttattataaaaatatattcaattagcgatttgatgaaactaatttagtattataaacattaatatatttgtttataaacttagtcaaacttgaaacagtttgactttgacaaaagtcaaaacgtcttataacctgaaatggttggagtagtaaacgttatctttatactccatgttctagctgctatgttttgaatagatttaaactctagaactttgctatattttttaatagtactataatatgtgaagcgggactaatatgacatccttcaccttcagatagatacgatcttcttgagaagactaggggctttcctgaaaaattcttgagactaggttggcaaaggctcgaacacctgaacggcaaacctctccgagactccgatgcgcgctctcctccgcctccgccgccggttgcctctgcccataaacacgagggccttctcgccgtcttcaccctcccctgcgccccatgagatccccaccgtctactccttcctccagccttccgtcttcgcgccgcggcccaaaccccagccgccgccgccgccgccgccacctacacctcccgcgcacaagacgctgcccgtcggcgatgccgtcgcgctcgaggacgagctgctcgccgccgtctccgaggaccgctcggacgacgcgtggctcgcgttcaggtccctggcgtcggcctccctctcgccctcgcctcccgccgccgcggcgctcgtctcccacctcgccgcagcgcaccaccaccgtctcggcctcaagcgtgccttcgcggccgccgtgttcctgctcgagaagagcccccacgcggaccccgtcccggaggccgccctgcaggccgtcttcacttcgctcgccgcagcggcctccgccgctccggccttggccctcgtgcgcgctctgctgcgctgcgggcgccgcctcccggctttccctgtctggggctccccgcttatagagctcacgcgcgctgacacgggcgccttcgtggccttcttgaaggtcttcgacgaagcctgcaagcaaatggtgtcggagaagtccccctctgcggcagcggcgatgcgtcctgaccttgctgcctgcaatgccgttcttggtggctgctgccgtctgctcggttcagtcacagaagctgagagggtattggagatcatgtcggctattgcagtgtcgccggatgtggatagcttcggatgtcttgcgttcttgtatgcttggagagatattccaagccgtgttgatgagctcgataaattgctggatgcgttaggattcggcaagaagatttttttcaagaatttgatcagtgggtatttgaagagctgcagctttgagtcagtttcatcagtcattcttcgtgtggtggaggagagaagagttgggggtagcaatgcatttgatttagaaagctatacagaggttgcacagcgttttgtagataatgggaggatcagggaattagctcagttgatcatcaaagcacaggaaactgagtcattgcagcagtcactggcagttgaggattctgttgggtttgggattgtcaatgcttgtgttgagcttggcctattgaacaaggctcatagtatactcgacgaaatgactgctcaaggagcctctgtggggctaggtgtatactcctcaatcctgaaagcgtattgcaaggagcaaaggactgcagaggctgcacagcttgtctcagagattagtgcagcagggctgcagcttgatgctggcagttatgatgctcttattgatgcttctatgacagcccatgatttcctatctgcattctctctcttcaaggagatgagagaggcgaggttaccagaccttaggacaagctatcttactataatgacaggcttaacagagaacaaccgtcctgagcttatggcatcattcttggacacagtcgtcgatgatccgaggatagaaattgcaacacatgattggaactcaataatacatgccttttgcaaggttgggaggttggaggatgctcgaaggacataccgaaggatggtattcctgaggtatgaaccaaataatcagacctacctttcgctaatcaatgggtatgtctcagcggagaagtactttagtgtgcttatactatggactgaagtgaggaggaagggggctgatttcaaccatgagttaattgatgcatttctgtatgctttagtcaaaggtggattttttgatatggcaatgcaagtgattgagaaagcacaagagttgaaaatatttttggataagtggagacacaaacaagcattcatggagacccacaaaaaactgaaagtggcaaagctgagaaagcggaatttcaggaaaatggaagctctgattgcatttaagaattgggctggtctcaatgcatgacattataatctttttatcagtctatcatgactgattttaatggcacgtatctgagatggcatcccatagtcctcttggaagtaacaagcagcggaccttcagagatgaacaagtgaggggttttgtcatcatgtcaaattttgataaggttaggaaggccggtgcgctttcggtttcttcttttacttaaagtaatacatgtttaactatataggctgacctgtctctgtactagttctagtcatttacgctgatgtaatctccaaaccatgaaaatcttaaatgagctaatatcatgtttatcctgaaatactcatgcaatacatatttgtgttcatttggttcatttagattctccaatccattcactcctcttactgttagtccattacatggacaaggaacttctgctatcatgtttctgattaaaatagtttgtacggacaaggatgtaagaataactgagtaagcagctcacatgtttctgctctctcatagtgttgaatagtgaaagcaggaataaccaccatagttgataagccctcaacactaaaactgaaacattctaaaattgaagtctagatgtttcaagtccagtacgaacagcttgtggcaattgggctcatagtaagaatgtaagtttttcctttttactcttcaaactaaaagagaatgaagttttggacttttggttttcgaaaaattgctaagttgtgcagtgaaggttttcgaaaccagtttccttaaaaaaatatatattcaaaaccaattcggcaagcaaggcaaatggaggtaattgaagaggcaatttaagttctaaaagagcatccatagaataccaaatctgcaaagaaaactgcacatcgatgttctaaaatagcacccatagaaattaagaggcaacataggttctaaaggagcatccatacgatagcaaatgtatccgcgtctctgcgaagcaaactgcatcggtacacggcagtcgacatccatcaggcgcatactacattattacagcaaagacacgatataagtttggccttaaaaacattattacaggttgttaacacaaccttaaagttctaattaattcagcaaattctgggagatgcagggtgatcggagccgatgaatccccttcgcatgttcttgatttttatctgcacacggacctcccttttctccctgtacaaaacagacgagagctcatcagcaacactagcataatatcaggaatcagatggaacttcattagcctagtttaacaggaaacttgtcaatgaaatgattacctctggtgtttttctgaatctaggggtggaacgggctaaccccgtagataccagaatgctcgttcatcagcgtcttcttgacgagggcaatggtgtcagtcatgagcctgattgccgatgccgcagaccgggaatacatgcgatccccactggcgagcttcaccggaatctggaagcccatggtcatgagagttcccccaacctcgccgagggcgatgccgctgctgtcctgggcagcctcgacgtcagggagaagggagaagccggtggggtagagggacggcccgccccgcccgggcggcaggtcgctggggctcaggaccatggtgttcatcagctcgctgtcgatctgggagtagaccatgaacgagcccgacgcgtcgtacccgttgttctgcaggatcatggtccttcccctgtcctccctgccggcgcgctgatcaacaccgcacatattgtcggagtcagccggagtacggcacgagagatggccggtggaggtagcaaaattaaggtttgtggtgcggtaccttgcagtggaggacggtgacagtgtcgtcgttcccgacgcctctggcgatggtgacctcctccttcaccacgctgccgtgcaccaggacgtcccactgcacggccggccggcgtcgcggtgagttcgcgagaattaggaaagaaactaatttttcttctcttctttttttgtttcgtgtacgtaccttgcagcggtgagtaaggttcctgagcagatcgaaggttttcctcatgggcagcggcagacgcagggacgcggtgacggacaggatcgcgttgtagctgctgctgccctcggtggtcctcctgtacgcgaccctgatgtccttctccgtgccggcgccgatcacgacggtccacgttcctccgccagtggcggcgatgccgccggcgaagctcgcgagcaggtcgtccgctagcttcattagattcttcctccccttcgtgctgactgagacacacacacacacacacacacacgcacacaacaaaacaacgaaaggatggaaacgttgttcatgcaaagctggaaacggctccctgttctgacaggaatgcggcaattttcagagtttcaggcaccgaaaggattttacaggttgccattaccttgcggagctgtcttgttgtgatgaacatctctcatgcgtgcagactgccgcgccatggtcgccacccagcgccgagctccgaagacgagtccattcatacaaggctggtagagctcatgaacaccggtgtcatccgcaaggacgtgctctatggcagtgacctgccaagaagatatcatacgacagatcagatacgggattgaatatattggtaaaaaacaattcttggccattttttttataacgtttgtgtgtcacaataccttgcagctgtttggccttatggattggatcagaaaccctgatggcattttacggcatttggagaagatactgccatcgtccaatgacacatcaatgacgaccactaatccttcgttcagcacattacaatagcgcaggaatgtgcatttcctagccggtaccaggggcgatgggaacatcatctcgacagtcatctgttgttctcaagaactgttagtaccaactaaaaagcacatgaatatatatcaccaaaaggtaagtactgctgattttgcctgcactctatttccccataagatatactactagtctatacataccagttgtataaccccattataaccatcactggtaggccacgtgtagatcctgttggttactgccccggaaataacttcaggaaagaaagttcggtagttgtactgcagtaaaaatttaacattgagatcaaattgcaacttgaaatattatctaaaaagaattgatacgggcattcatattcacatctttttagcaaggcactattaaaatctatataccacttacaggatccatgaggaaatccacaacgcttttgtagtccatcatcaccatagaaactgcacgagtagcctctgtcttgaatccaatggcgtttgcactgttatccccaggatatgcttggtcataagccatcttgttcaatacttcataagaacagccagggacgggaaaccatagagcgacatgggattcggccaaaataatcaatgcgtgcattgcgtttttggctagttcagcaatcatttgttggtcatgttgccctgaaaatacatagtctgctgatgaattaagttgaaaggcaaggtttgcagccgggggtgttccattcgaccgtgcaatctgacaaacaaacaacacagcattagttcaattctagatacagtctctataggactctggagcttgggaaataaattccagacaaactatttaggaggtaaccacaatctatagttagatagggtgcagattggtaatcacaaggtagatcagattgtgcaaataaatgaatcatattgagaacatagtttaacatgtatggttgcagctcgaacaaatccattcaagatactgaattgaaaattcaacatgccaagtaattgtaatttaataggagaacatatcagaagatgatgtacctcttgttgcagccactcactctgccccattaacctttccatctcaacggcaagctggttctgtactgatgaattacagcaagtgaggcatacagcagtgcagtgagctatcttaactctcctgttctcatccctcagaatttcattctccaccgacaacttatagttctcttccttccagcacatagtctacattgtgtcatggaatttttttttaatcattccactaaacttttttgttcatcagtacatagcaatgttttagaacaaacctttacttgtgttcttttattctgaaaccaaaacttcacttgatctaaaccaagacctgttgtctcactcagatgcctcttttgtccatcatcgggatgcccacagatgctgaaaaacctgttcatccaagaaaaatgaagataacccacatgatgaaattctcctcagaaaggagtaccatactgcaacatacacaatatatttaaccaggatagaatcctttctttttataaagctaatacccactaaacatttttataaagctaattctcactaaacacctaaaactcaacatgcaagcattgtatttattagcactcttaaaacctacatgtcagcatgcaacatcaatccattaagcatacaaagctcaacatataagcatacagtaattatatctataatttatttcattctaaaactaaacatacatatgctaaatcatcattcttaaattattttcgtaatatttcaatctaaatcatttcatcatttctccaatatctaacatctcgcatcaaagcgcgggtcatcatctagttataacatataagagatggatatatctagaaatatttgttgatgtaataataataataataataataataataataataataataataataataataataataacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaattataattgctagctttcaataaatgatgatatgtgcttcaagaaacatacccctcaagtacctccgactgtttgccagtgagcctctgtagacgcctcttccttttttcattagtgttgctactgttcacaggcaacaagcctgagtcggcctcaattgctgcaaataattctcttgctggaatactcattctctgctccccatcattctgattaaaagaaacaagatactctcagtgctagattcacaattcattctacaaattatagtcagtcagagagctaaaacataatactccggcacattgaactgaaaaaaaaaaacaaataatttaaaagccatcagaaactgataatgtacaaggcatctataacatgccaaaaataacattcacctttgttcgttggttatacactgccttttctaatccttcctctctgacttagtacataagtttaggtacagtaaaaaaggaaaaccaatgactagtatatttaataaaggcatctggattgaaattgtatacgtactattaaggcccctttgttttggcccatatctaaacaaacaaatatcctttttataggcacacattattaagtcaaatgctaaatttaagtagattttttagttacgtaagttagagttaggatattatatttaaacttaagacttaaaagccaccgattaacaaaagtgtacactgctgggcaaagccccggcagtatttccggtcaaaaaaaaatgtacaagtcaaaaagtcaacttaaaatcctaaaccgaacagaaactatagatctcactaattaccttttaccaaccacttaccttgtttatgatctcatttatgatatacctcacgagactttaatattttttcgccgggccggcgaatagccggccaatgtatattaagagtaagaaagggaatgtacaaggtagcgcggtgcgtcaatgcaccaccattacagacataaaaagaaagctaaaatctcacagaatgagttgctacagagtgacacatggggctaacaagacctgcagctatccaagtctcccattcatcccccatggcggaacagagctggggaatcgttgccgcgatcccttcggactttaatattaatagaacccttctagaaaagatggctttagtgatcctaaacatcaaaataagcaggccagggtaattaaacaactaaaacaacttgtctaaggattattttttagacagtccagaggtatcgaaactttacgggtaaaaaagaagaaaggcaggattgacaacaggatgtacagaaaagaaaagaagaaattatagctgtacaagtgtctatggattattatggtctggagttagttttaaacctttactactcttttgtcttttagagcttgtttggaatgtataaattaagaaaaagaagggaacatgacaaaaaagtaggaatcgccttacctacatgagaaagaatcgaaggattgtgttaaaaatagcatttcattatactggtccacagtaaacacaggggacatatgttaaacattgcatgtatgtggcatacatgtcatacaccaaatgccctcacagaagatttcaacaaaggatttgttttttttttcccacaaggatcatgaaaaggtaccgctcaatgtggttttcaaaggaattttgtgcatgtgtccccttttcttttcaatcataacatgtaaaaaaaacataaaaacacatgcatatgctattttgagatctctactattgttaaaacgaaatcctactccaccatcgtacttccacacctaaagaaattatacccaaaaaaaccaccctacccaaaaccagtacttttcaccaacaaaataaaacacttatactgaaccccataaaaccgtttgtttgtgttcccgcagatcccgttgcaatagacaggcatagccgtagttagtgaaacacagtaaaaatgagaaacgagagttagaaaggagcatctaatcctttcaaaaaaaaatatagagagagagaacatataaacagaaatcttgccaaactatttcaagagcataccaaatataacactagaaatcaaagaaccatgcatgccagcaaatcttcaagattcagctcggtatatgcaaagataatggaccaaggaaacatgacgctcaccaaaaaaaaacttatttacagaacagaagtatgcccttatgtgctcacattttgtgaaaaatcattcttctatcccaattctttcggaacacaagcacaaaattctcaagagaagaactatgaaattttgggagaaaataccggtagtgttgccgtcccgtcaccagcaaaaccgttcatcaaggccacgaaagattcgttgccctcattatgctgttgattcatttccatctctggagattcaaccctaaaggttgcaagtgactcccagtgtgtcgttcacccagtattctgtatttcgattctgttgtatttccccgtgtatttgcctttgccctcccctctatttatatagcatttgccagaaggaaaaaatatatttattatatattggtgtttatctgtggtcctcatctgtgtatgtgcacgattttttttaattaagttggcttcaataaaacagtaacgttcgcttaagccgagcaaaaatgataattcattgctccttaacaaagtgacgatgttggtaatctcttcgcggtaaaatatatacaaattagtgggatttgtgggcttgtggctccttaaaagcatgcatcatgccaatgcatgcaacaaatgtgtacttagtgaggatataaaagtaattgtggctagctaagtgattacagtttaggaaaactgaggattgcaatcaaattcaaggcagatatgtccatgtataattcgtatcctaatggatatataattttcaacaggcatttagaaatgctctaccatttagcgaagtaactgttgataatgaaaattgtgcaaatttagtttctcatgtacgaaatgattttcagacaccgatgttgaatgaaatataaagccgttttaacaatgcgaccgataaactaggttagtaggaggaaggccatatttggcccagcttcagattataatctaaagcagcttaatttgaatatacgaactccgccaaatatggccataaaaaccaagacgtcatattagttggattgtgatgggccattatgcgcgcttatattcgagtcaatagttagcagaattacaggttggcctggctagatcgctgcttggaatgtcagatatccgtattagatatgtaattttgcatctattattttataaatgaacggttattctttgatggatgtagtatcgttgacatctccctctttctcgctgtgttctctttgaatagttagtatctctatcccataaactcagatgacagttatattttgttgacagaagaataatgcttgcagtttctttcaaaaacaactaggtagttgatcaataattataaattatgtactcatttcccttcgttcatcttgattatgaaagaatgcaggaaaagaaagatctatatattcctttccattcgttcatctcgattaaaaaaaatggtttcaaatcagtagtaaaagcatgtgtagattgctgcaacgatgccaataacagcgagatatagaaaattagttagtcttaagcggctaatggctatgtgagaaagttaattagatgacagaaaatcaggagggttagttagaatattagtgattcttaagttattttctatccctaaaatgccctttggagcatcaacggtggatattaagtatcttaggaagtacatgaggtaccttccaagcaccgtaaaaggcctctttttttttttgggccgatcaaaatgatggacccaaaatattacaagatttccacgaattgcgggagcatagaaaagtcgagaaaaatgccgacaatctatgtattgattcattcttgtattggaccataatatgttacccatatctggcccaatgcttctctttttcgacatgtgaatcgatacatttagaaaataggtggttggatatttttcgaaaatagacatgaaaaacaaccatctttttcttcattttttcatagtatatatgccctcctaaagaattgttgctcctaaaagaaacctgtttagtttctcttttttaccacaacaacaatgaattgattaattatcaatcgattatatcacattgaataggaacacttattacattattatagcacatattagcaacaaacttaatcaaaccaacaatgagtacatctttctctgtaagcaaagcatccgtgtgactgtgttagtgtgttatgcttgatccacatcaacacggtcatttcaacaaaacgtatcaaacgagtgcatagaacagcgtcccaatggccagcccggccgcgccggcaatgcccgccgccctggggcgcgccgcggcgttgatcgactgctccggcgtgggcgagatctcgatgcccgacggaggaggcggcggcgacggtggcgagttcgggctggtggtgccggccgacggggccagcgccggcgccggcgccgtgccattggcggcgcgctcccccatgaccacgacgatgagcttctcgttgcggttgcagttgtccttgttgccgctgatgaagtagtacgggccggaccgggtgaaggtgaacaccgtgttgccgtcggcgaacgtgtcgatcggcgtgttcgtgttgcaggcgtcgtacgagctcttgtcgacgagcagcaccgagtcgttgccgggttggtaagagaacgctgcatgcaattagaggtttgatcagaatcagtaattccctaatcaaattttttgagagctgacgtcacgtggaagtttaactttctaccccttgggagtaaaccaaacggtgacagtgtcattagccggtgacaaaagatcgttagcacttaaacacagttcgatacaacctaagggaaaggaaccgtcattctatctcgcatctgtcgtgttgcgtctcaacgggcagagagtggaagttttgccggtggaagcttcgcggagatagagagatagagagatcaagcttagagatagaaacgacgtaagctatctagccatagcgtcaaaagtatgcatcaacagatgggattggagatatgcatctgtggttctccatggtcaaggtggggagaaggagagccagtacaaaattgcgcacaattgtcaggtgtgactcataaatgaagtggccctgtgccccctgtgtcatcctggcagcccaacgtcgcttgcaaattgataaatgatttcgatgctacggacgcgcatgatgtgtgtgcttcggctccatgcaactaatgcaaacatatctgataacgctccacgatttagcaattttagcggacacccaacactacaacgtctatcaccctttaatgcagtacaataaatatacatctgatcgaacggctgggaaagagcagtcaaagggagtcggtggagagcgagcgttgattacctatggcgtcacccacgcgaaaccgggtgtgctcggcccactggttgtaggcgctgacgttgccgctggcctgctgatccgggacgcgccactcgcccgtcccgcccgccttgaacacgaacgcggacgcggtggtggagaccgaggccaccacgcacgccaccaccacccagcattgcatccgctgcacgcgcccgtgtgccatcgcgcgcgctctgctacgacctctggttgggttttttttgggggggacgctggtgtagtagtgaattgctggaggcaatgcggtttcggttacgatcgattgaacgagacggtgaaatatatatacgtgcacaaagcaggttggttgtatcggcgttcagatgtgttacggttctttacgtaaaagcgaggggacgtgatcgcggggaactggaatatttgcgcgctttatgttctcgacgtgccatgctctgcatgatgtgactttagtgtttgtgtgttatttatttgttgtttaggagttttttcgtttgctggcacgggagcttacgggaacgggaagctatgctttgcttcctatgtgttgtggaatatccatgccttgagagctggttcagagcaagtggccgggcctcgatcctacggagaaaaatgaacaggttcactttaggtgtctcaatttgattttcatctacagtccgcaaaaccaaatacatcacatcccttaacttataaaaccagtccaaacgaggtgccttagcactattgtccctatttttggctaacatggctcctttgactaggtcttcgtcccacctgacattgacgtggcaatttcatccgggaaacaataaaaggagctgacgtggtagctgagtcaagtgtggtacccatatatcagggcaatttagtctaaataaaaatattaaattggtgggccactgttaacggaaaaatttggtaagccccgaaatcatcatcggtctaaagtcagtattggcttcaaagtactagaatcagccgatgagcattatagttggatttcttgatgggttcgattaagaaaattaatcaattaaagaagcttatctagaagatatcgagttcaataaggatgtgacatgtcaatatatctattaattaggtagagttagttagttccctttagttgttatgaaagtgtgtttagtgtcctttcttcgcccgcaggcctgttgacgaaaaatccgtgctcggccgatggtgccgggtctgtgttggcacaaactaagttgacgaacacaatggtctgggagatccacttaactccagtgcagatctaaaagttgatgagatgcggacgtgccagttagtttgatcctacaactgacaagatatagaaataacatatcaaagagccaatcggcttacaagccgatggagtaattctagccgatgtcgatagggttttgagcaatcagctatatgtccaatgtagatgatgatacaaagacaatcggctgatgatgatgatgtaataaaataataatataatccattaaaccaatcggctaataataacatgatagaataaatactgatcagaaagttaaagcatatatcggctggaggtccgatgtcattaaatccacaagattagataaacaatgaaatctttgttgcgatcggctaaatccaacttgtatgtaatccttataagccgatgcaacgtccagataactcatcggctaaaatcccgatgtaacccttattggcaaacaagaggcagaatagagattacggttctaaacatgacttagtaggtcgaatgtactgatgcagcactaagtatgaaaagaaacacaatatctagacaatcaagcctttgaatgatttttagggtagtagatgtctaagctaatctaatctagcaagacgatttagccgataccgacagataccgtaaagcgagaagcagccgatagaggtagatcgatatgctaagactaaattaacatagatatatgataaattggtaggcaaatatatcaaccgaaccaaagcaatccaagaggtcgaaacgatgcagccttgaacgatgtcgacgtagccaatacaattgccagggccggcagaacgtagggctgaccccttcgctggagatcgaaagccgatgcagcctcgcgtcaagtgccaagttccgccgaatgataagtaaaaacctcggtaaagagagtggtgatgcgccgacagtagttgtattgatctatgagatcgtttacaatgaccccgggtgtacatattatacccatgggtagatactagtccttgttgggaaaaaaaactttcctaaagataaaaggaaaacataaagtcattattggacactaaacacacttttctaaaattaaaaggaaaaccaacagactatttctaattaaaagataaactgtcatgccgcatccaccttgaactcggtcacttctggataaactttcattagtagattaatttcttaagaatccgactattggcgatttgataatttccatcgaccgattccaagactctaggccgagatgacttcggggctaaccaaatttcactgttaataagcccccccgcctagcgctcgtctatccatcgcggcccttcaccccatcagctatcgggcgccgctcgcccgctctgctccgtcggcctactctggccgccgccactccgcgctccatgccctccgccacccacatgccaaaatagggaagggagagaggagtggagcggtcgtcgccgctccgccagccacccacctcgctccgcccactcccgccttcttgtagggaagagagaggatagaggaggggagtagtgaggatgacatatgggggccatgtcacatgggcccacccttttttattagttttgtgtgtacctaacatgtgggccccacatgttttattatttttcggatctaattgccacgtaggacgaagacctagtcaaaggatccatgtaagtgccatgtcagccataccggggttaatactgcgcagggtactcgtttgcatggttttgtaagtggcggatccttgcatctggttttccggactgaggatgaaaatcagacttgcgacttgagggacctagagtgaacttattcagagaagacttgtgcttcatgggccattcctttgggttggttgcttcatggcttgtgcgagactagactagattgtttacatccggaattcctttacagcttaattaggactgctactatcaggcttatacttgggcttcaactggaacgtacaggaccgaactatattatgcaggccttattaagcccagaattgcatcgcaaagtttggtgttaggttggggaatcccctctagcttaatccagccattagtacgagtacgaacaccacaagtcttaaggccccgttcgattcagatttatcaccggtatataaaacaaacaagtcgcacatgactaggtggtaggtggtgtttgtatcttctgaagaagatgaagattaaataatttacgtaaaataaggtggtaataacgtgtgataaattaaattttaattattgcaaacttgaaaaatgaattaatctgatattttagaacaactttcatatagaaagttttcgcacgaaacacaccgtttaacagtttaaaaagcgtgccacgaatatccaaaacttaatccagtttttaagtggaaacgaacggagccacatatatacaaaattttcaaataaaatataccgtttaacgtcggaaagtatgctaactaaaaacaaagggatatctcagttcagaagcggaaaaaaatttcaacctaaagtggaagtggagaaccaaagattgcagatgtgggtgttcttctctcctttggggcttctttcccccaaaggacgtcggcaggcactgatccaaatagcaacaagacaaagttagattcttgatggcttgatgtcggtggtcttcgaattccacagccttcgatcgccacaaattcaagtcagtttgagcgtggcatattggccctccggcgttgagtctttggtgttagcaagtctgcatgaggaattggttgttgttgagctagggtgccagctctaggttgatttggttttcggctaggtaagtttgcaggtggcaaacgccatttgttctctttggggaggttgtctctgtgttgtattatcttctctgtattcctcgtgtattctctactactatcctccaggacacctgcgattgcgtagatgaagcctgccctgtgtaaaatctcttgatgcaatatattctggtggagaaactcttctctctggtgacttgctaaaaaaaagattgcagatgctgtagtccaagcaatgagttggatgttttttagcttgagcagctagtattaccgtggtactagggtttatatttttgcgctccttaccgatttatggaaaccattaaaaattgacaactttggattaacactatacgaaaactaactaatattgatcggttttttagcggtttcacgaaaattaactaatattgatcggttttttagcggtttcacgaaaattaactaatattgatcggtttttagcggtttcacgaaaaccaatcaattttgtgaagcttgtccgctaatttttcagtcgattagcagacttacaaaagtatgcatagtgcatctttcgaagtatatgactcatctgaacaacttgcaaggatcctagttgaaactttgaaagtctgcactatgcggtatgcatatcactgaagtggaacgatacactacatcctactcaccactccacaaacatgcccatcgatgtggtaggctgtaggaagatcagaacaaatcagatccaatctcgtttgtcagattggctagctgtacagtactaacatcctcctaaaataacctcgctatgaaggtatgtggcgccaatgagactgtcacttttatccccactcccactccggcacttcaccagttcaccaccgtggcactccctgggactgaagtggaacgaactagtccaagactcggagtcgtctcctccctccgtcagcgcttccatcttccactccacatcacgatcgcgggcgccggtatgcttcttccattccacctatgtgtttcttccttgctaacaaatcaaccaatttgtccattccctatgtcatctcctatagaaactctagccaattcgttcgtttcttcttaagttccacagaatcccacctgatgctcgcccaacagttgcatcttgtctgctgatcagatcgaggttcagaaattagtccccattcctctcccataggcactcgaatccatcaattcgttcccaaatccagtgcttcccctttgtatgccactaaaaaccggagctttcttggtaaagatcgaggtttttggttgccggagatggagttcgtggcgtccatcgtggacgcggtgttccggccgctcaaggactacttcgcccggacgttcgggtatgtcatgtcctgcggcgactacatcgacctgctgggccacgagatggacgagctcaagagcaagcgcgacgacgtgaagcgcctggtcgacgtcgccgagcgccggggcatggaggccaccagccaggtcaagtggtggctcgagtgtgtctccaggctcgaggacgccgccgcccggatcgaggaggagtaccaggcgcgcctccgccttccccccgagcaggcgcccggcctcagggccacctaccacctcagccagagggccgacgagatgttcgccgaggccgccaacctcaaggagaagggcgcgttccacaaggtcgccgacgagcttgtgcaggtccgcttcgaggagatgcccagcgcggccgtcgtcggcatggacgctgtgcttcagaggctccacgcgtgcgtccggcacggcgacgtgggcatcgtcggcatctacggcatggccggggtcggcaagaccgcgctgctgaacaagtacaacaacgatttcctcatcaactcgccggacatcaatgtcgccatcaacatcgaagtcggcaaggagttcagtctggatgatatccagaaaatcatcggcgaccgcctcggcgtgtcgtgggagaacagaacgcccagggagcgtgccggaatgctctacagagtgctcaccaagatgaacttcgtgctgctgctggacgacctctgggagccactcaacttccagatgatcggaattcccgtacctaagcacaactccaagagcaagatcgtgttgacgacgaggattgaggacgtgtgtgaccgcatggatgtccgccgcaagctcaagatggagtgcctgccatgggagcccgcttgggagctcttccgcgagaaggtcggggagcatctcatgttttccagcattgagattcaggaacaggcgaaggcgctggcgatgaagtgtggcggcctgccgctcgcgctcatcaccgtcggccgggcgatggccagcaagcgcacagaaaaagagtggaagcatgccatcaccgtgctaaaggttgccccatggcagcttcttggcatggagatggatgttctaatgcctctcaagaacagctacgatagtttgcccagtgacaagctaaggctttgtctactgtattgctcactgttcccagaggaattctccatttctaaggaatggataatagggtactgcatcggtgaaggtttcattgatgacctgtacactgacatggatgagatttataacaaagggcatgaccttcttggtgttctcaagattgcctgtttgctggagaaaggggatgacgaggatcatatcagtatgcatcccatggtccgtgccatggctctgtggatagcatcagattttggcacaaaagaaacaaaatggcttgtccgtgccggagttgggctcaaggaggcaccaggtgcagagaaatggagcgacgctgagcggatttctttcatgcgaaacaacattcttgagctgtatgagagacctaattgccctctgctgaaaactttgatgctacaggtcaaccctgcattggataagatatgtgacggcttcttccaattcatgccatctctcagggttttagatttatcacatacttctatccatgaattaccttccgggatcagttcattagttgagttgcagtaccttgatttgtataacacaaacatcaaatcacttccaagggagcttggagcactggtaaccctgcggttcctgctgctttcgcatatgccactggatttgataccaggtggtgtaataagcagcctgacaatgctgcaagtattgtacatggatctcagttatggagactggaaggttgatgcaaccggaaatggagttgaatttctggagcttgaaagcctacgcaggctcaagatactcgatatcacaatacagtctctcgaggctctggagagactgtccttgtcgaatcgcctcgctagctcgacaagaaatctactcataaagacatgtgctagccttacaaaggtagagcttccttcaagcagactttggaagaacatgaccggactcaagagagtgtggatcgcgagctgcaacaacttagcggaggtaatcatcgatggcaacacagaaactgaccacatgtatagacaacctgatgttatctcgcaaagccggggagatcattattccaatgacgagcagcccatccttccaaacctgcaaaatatcatccttcaggcacttcataaggtaaagatcatctacaaatccggatgtgtccagaacataacatcgttgtacatctggtattgccatgggctggaggagctgattactctcagcgatgatgaacaaggaacagcggcaaacagcagtgaacaagctgcaagaatttgcagagacatcacacccttccctaacctcaaagaactgtatctccatggcttggcaaactgcagggcattgtgcagcactacgtgcttcctgcggttccccttgctggggaacctgaagattgtcgactgcccgaagctgaagaagctcgagctccctgtcggtaatctgaatgcggtacaatgcacaagggagtggtgggatgcgttggagtgggatgatgccgaagtcaaagcatcttacgatccactgttccgtccactgcactgattccagttttagttaccacttaaccatttttttgtcatctgctactgttgcttctctgatcgttgtgtagttcaggtctgtgtttcctcacttgtatgatcttacaagttgagtggttttactacctttttgcacagaccatgttccacacacgtcaggtacggcagtaggaaaacttagtatcattagtactggatgtatagatgtgagtatgtaacctgtgaatacagagcagcaccaaaaggacctaaacagcatgtaaattttcttctttttggactataaattgatgattcttcattcacaaacgatcagatcaaaacagaatgattgtgtaagactaagatctgagtctgactgacattatgcctgcgttgtctttcagggactctccgcatcagttgcagagataaggtttgacgttttcaaagcagattcggccacgtaaaaaaagaaaaaaaaaagcaagttattgggcttactttcgtcttagctacataggtaggctttagcttagtacaggagcatggcccggcccagcaatttgcgctagtgtattgtcctttatggtatggaccatggaatataacacgtgaatacggcgtggcagaacgaactttgagatgcacctccgatcagattgatctgatctgcgccattagcatgctttattgcttttatttcctgatgatgacgatgattagtactccgtattggaaccaacagggtgcatgcgaacatggcaactcgtacaagatggcagatcaataatctctacccttctaatcagagcccctcgttgtagttgacgccggtggccttgagccagtttccgccctggatgaactgccccacggtgaactgcatggcgacgctctggtccgtgatgacgtggtacccgggccagttgacgcggccggccgtgctggcgccggggccctggttctggtactcgccgtagaagagcgtcttgagcgcgaagtcggcgccgttccactcgagccaacccctcgggtcgacgtgcgagtccaggtaggacagcatgtacaccgtccgcgagtactccttccacggccggcccaggaacgtcgggaactgcttcgcggcgggcgccaggtcgggcgccgggacgacgcggcaccggtggatggacgtcccggtgttctggttcgggtcggtccggccctgcgccgtgaccgcgttcttctgcgcctgcgcggggcgccgcgccgtgagcacgcagccctggagcaccgccgcggcgttgccgaacacgaagtccaccgtgccggagacggcgcagtcgcggtagaactggcggagctggtgcgcgtacagggtgtcctggtagccgtccaggcggcagcggttgatcacggcgcggtcggcgctcacgcggagggccaccgcctgctgcttctcggcgcccgccgtgttctccaccttgaggtcctggaggatgatcccgtcgcccgacaaggctgcacgcacgcatatgttacgcatatatccaaggtcaaacttagtcatgactgcttgcagtcagtcaatgcatcaatgcaagacaggaaaatccacgcaaattgttcatgtacaagctattgggcatgttgttaactcaagtgtgccatcgtggtctcgtggcggcgtgtcgtacgttttgggccgtctactttgacccttgggcagggctagtggattggaaacagggcattttaatactgttcgtcaagccgtgttcgtcgttaattggtttgtgcgagaagctgggctgtttcaggctccggttttgcactcgccgcggtattccatcgcccttgtgtgccgcctgctaattaaagtattcccagtttgcaataagtgcttttggttagctatatgtcaacctttgattcagagaatgtgcctccaagcgatggttcttctacacttctactgttctacacagtacatactgctacaattaggatgagtcggccagtttgatggcaaaaatcgagtaggaggctaaaacttgggtcctggtggaagaaaaaaagactcggagattggcttacagtatagttagctagggcctaaggccccttactcatacagtttatcccttctttattcagctagaaagaaaacccgcgcagatgcgcgggaaatttatttattgtttgtaagaaaatagattgtaatagtaaagaaacaaatatttatatcctagttatatgtgaactcgcatatcatccttcttcgcaaatatatatatatatatatatatatatatatatatatatatatatatatatatataatatatatatatatatatatgagttaatatgtgtttgtttttttctttcattatacatccgattcaccgatgcatattcatgggtaacaaacaatagaataatctatattgtcaaaattatttgtgctaattatcaacactatttaggtgagaatgttataattaaaagggatataatgtggttccatgtgatattttttatcgtaagtatatatgttttttctagcgaatagtagtttcccctgtacgaatgtacttttctccttttataaggtaggtgtgtaattgtatttataagttgtatgtgcctgcatttatatgagtgctcacaatacccttttataccattagtaaaataaatactttgaagagatttggtgggatggtgtgaagcagcaatgtggtggcgtggctttttcggcaaccccaccagaagtggtcactacatatatacataatttgagaaaaaccttagagctgcaaagaaagaaagagaaaactacttagggagggattagccggtatttagtagcgagggattacttgatagatatattctaatggttgacaataatgaatccactggtctaagtgtaaatcaatggctaaatgattttttctttttcttataattttcttacattttctctattttattagagtgtcttgtggcatcttaattagaagtatatgcaggtgtgtaggaacactattaataatagtcatattctacttgtagtcaactatttttcgtggtggcttggtgtatctctacttacatatcatttattgatggttaccacttagtacttcctttatctttggtacttgataacatatgtacatgcttattggatatcaactaattattagttgcataatgcatgtatgcctcataactattatgacttggcgattggtggatagtaatttctatatagaacttatatacatgggattagtggaaacatacgattgatatatatttggctattcctattgataaattatattatatactacatattaagtgtttaagtaagtaaggttgacttttaaagtgcttatctgattggctactttattatttatgacgagcatgttcccaaactacaaaagtttcccgaactaaacaatgcgtgttttgtaaatactttctatacaaaaatattttaggaaatcaaataaacccatttttaagtttgtaatatttaatacttaattaatccttttttgatgacatgtatcattttgtgtgccttgataaactcagccagatcgattgaaggcctaggtaggagataaaggacatcgacacggtatcaaaagaatatacttcgtcgttaattttctagcaatatatgaagaagaaaacatgatacatgaaaatattcaagataaatttagtaatgtcattttgtcatatgaatatttttatagtaggtattgagtaaattttgaaaatgctactcacagtcgaagttgttttatttttgaaaataaaaatctaatataattatacatgttgttatgtgatatatctataactttaatttatttatatttttcctggatgtttccatgagatatattttttatttgaacaaattatagttaagatgtgctgattattaaattggtttttcaacaaagtgagaaataaaaaaaaggaaagagaagtacgtacaattttttttggtcgggtgtgggtttgaggatacatatgtacaactcacgtacagatatggaacgatgtagatctttcgagatataaatttgattgataattttgacgatagatctaatagttaaaaataatggtcccaccaaattaaatgaaaattaatggctagatgctttattttttcttagattttctatgatttattaaagtgccacgtgacgatcttggagcgtttgtaggagtgctacgtggcggtttgagagcgtttgtaggaagtttaatggatttttagtatataatatatgaaaatcgtttcgttcgaaaaaaaaaaacaattaggacgagtgaaggcgataccgaagaatgtcattgctttatcgcctgtggtgcagtttcagcactgttatgtactcctagtaactgtgttgcaagaaaattatgtaccaatggatgccttgacagctttctgtcctgctgctatggttactgaattaagggcttttttttacttagataccatttttaactttaccaagttttaataaagttgtcaaaaaaaaaattagatacattagtttgctgtcaaattttggtaactatataagaaattctgccaaaattttgtcatgtcaccaaaattttgacaactatgccaaaattttggcattgccataatttggtatgtttttttttcatcaaagtgatcggtccctaaaatccacgcattaaaagctgaaacgtggggaaactctctttgccatggaaaaatcaggtgggaacacgactctcccctccgatgatttaaaaaaaaattgaaatgtgggtgaaaccaccatctagaaggtttgaaaataattaataataaattagaaaagtatataatctaagaaatttaaattatgatgcccaccctctaaaggattcaaattacgatgcctaagatctaaaattactaaaaaaatcagaaaataattactacgagtaaaccatgatactccctccgggctgataatacttgtcgttttaggcaagggtgaggtcaaactttagagtctttgattatgaatcatttttaaaatatttgtcttttaaatatggtgactacatatatatagattagtcttaaaaagtactttaataaaatcatatatttgttaacacttttatacatattataatagaaaataatagttaaagttgttttttggagaccgtgcccttatccaaaacgacaagtattatcaacccagagggagtataaaaaaaactcaaatcccgatactcctaaatgttaagtatacgtaggtgcgttttcaatgaggctaggaatgtatctatagtccaacaacagagcatgtgtttgttaaataaggctgtgtttagatctaaagtttggatccaaacttcagtccttttccatcatatcaacctgttatacatacacaacttttcagtcacatcatctctaatttcaactaaaatccaaactttgcgctgaactaaacacacagcctaaaaaaatagagcaggtatttgtggatgtgtaagtgcggtgtatttatgtagcagtggagcatggcatggagcacgtagcacggacatgtgcaaaattaagtacgtccactgtgtgatgtgatgctaccaccatttaagccaaacaaccattgccgaagattttaagtgctttgcttttggggataactactctatgtttccacctgtgtgtattctagccaatggcacatcgatctgcacatgcgcaccatgtcaccaacaaccactggtaatcatttttctatctgcttatactatattagtcaacgaattagattatgagatccacttgttgattcttttccggttatttcgaagttgacactaactgtttactgacccaatcctacgtacgtgagcttagcggggcttatattatggagtatatcagtgcactacagtactgtgcctcgtacacagtactgtgtagactggtataccgattaccaagctaagtttagatgactagtgtatatcaagcaagaaatgcgtagctatccatgcatgtcagtaggacgttacgaagaaggcaatctgaaagaatacccatggtttagtttgaagaagagaaaagaatattcatgcgcgccaacgttcaggaattatcatgttgtgatttcccttttgaaaaggttgtattatgcaaagtaaagatgcggtttgcgaaatagtcgtagtgtcgtagatggaatgagtgcgaatttcagaaagtagagagagacaaagacgcagacggcgatcgagagcatcacctagcgtggcggagttgaaagttgtggagccgtcgaccacgttgcggctgccggtgatgaccgtctggtccatgccgtcgccgacgatcatcagcacccgcttcgtcttccccacctcgaggttctccttgtacacccccttcttcacgtagatcacgtaccggctcttgccgccgtcgggggccgcgtccaccgcctcctttatcgtcgtgtacttgccgctcccgtctttggccaccaccacgtccgcctgcacggcgcccgcgcccgcgtcgaggagcgtgcggtctctcgccgtcagccacgacgggaacctgtccacggcctccgcgagcacgtcccgagcgccgcggccggcggcgctgagcacggcgagcgacgcgctcgcgagggacttgagcggctccaggtgcgcccccacggagtcgcgcagcggcccgtcgtcgaggccgtccaggcacgtcacgtggtcggtgagcacggcgctgagccacgtcctcgcgtcgtcgacgtcgacgtcgacgtcgggcgcgcccgccgcgtcggcgagacggtcgcgcgcgagccccatcagctggacgcagtcctccagggccgcgcggtgcctcgggtcgctggcgcgccggcgcatgcccgccaccgcttccgcggccgcgtcatgccgatcgagagacgtggcaaggatggcgcggaggacgtgcgccgggcggctcgggtgggagtgcggggacgctaggacggcgtcggcgacgatggcttggcacgaggccgggtcaggggagctcgcgcagaggttcgtggccgtcggggagagtaggaggaaggcggcgcccgcgcagaggcagagcacggtggctaaagagagcagcgtgaacgatagaagtttgcatgggtaggcgtttctgtgcgagggagaagagaggagaggctcgtctctctgacgcatggtgtcctatccctgtgcgacaagtgaacctgtttacaactactgctgcaacctgtgatgtagcggctcatgatgagacttaattaggtcatatttatactgctggggacagcggttggttttgggttataccttatcgcgaacatagttaattagcgctagtacttagcaccggtgcatgcattaattgttctcaactggagtaggagtagttttctctggcgtcgcctgattctgaatagagactggagagtagtagtccggttcgatttttcgttcagctcactgaatgtatcgacctgtcggtagatggtacccgttctgtttttcgttcagccacgtgcagttcactgtgctgtcccctcggtggatgatacccatatgccatacgttccagcacgtggtgttttactgccagaccattgtactatgaacgaaccagaccattgtactatgagctagtatcttgattagtgctggtgttgatgtatggttttgattcagttgctatatactccatggccgtatgagataataggcatgtgttcttcccccatacgattggcatcgacgatcctcacgagttaatctcgcactttgcaagtatcttgttgtggagcttggacatggacagtttgatgtggatcgatttgaaggttttatgcttttttttagctagggcttgacggtccccatttccattactagaaattagaaatgatactcccttcagacgatcaaatgtaagtttactgtcttaaaactagaataactctcacggtcaaggatcctctcacgtcgcccctccaggggcggctcgggaggcgacgacccggccgcccctctcccccacctcccttctccgcctcaccgtcgcctaagcggctgccggcaaagccgcgcggccgcaacgacggcgacggcggggctctcctcgtcttcttgtgctcgggcggtctagggagctgcccagagcggcaacggcggtgaccgccagatccgcgccgttccggccggatctggtggagtggttggcggcggggacgggcgatggtggtggtcgaggtgagttgcgggtggagttgtgggtgatggcggcggggatggcgacagcaatagggcagcggttgtggaggccgcggatccaacggtggccggcggtgggcagcgcatgcaggcatcctgcggctgccactagcgttctccggcgctcctcttggtgtcggccagcgttggtggtgaggagggcggccggatctggctcctcttgcccagatccgctgcgtcctcgggtggggacggggtggattggagtgaatattggggtggatctcgtctgtgcaggtggtgtgaatattgcaggtactctcggtgtgcaggtaacatttggtggctcccgccttggatgctatggttgatgggtgctccaaggcaaaagccttgctccgctctcggtgctagcaacggtaacccctttgggcgccgttcaccttctcgaaggtgttgctactggagccctcattcaactcaacttcaagagatttctccgggtgaaaacctagattcattaggatcagacgatgtcgttccgtcagcgtaaccttcttgaaagcttcgttctaggagtttttctcctgttggacggctgtacttaggttcaatttgtcaatgtcggggttttcgccggttttcttttaattaaccgtgctgttataagatttttaagtctgattttcttcttctatagtgaattgcaggagcaccctgcctgtcccctcgagaaaaaaagaaattagaaatgattaggaagataaagaattcgaaccaaaccaaaaacacgagctgtcatcacagcaaagagcctagaagctgtccatcgagggtagagaaaaaacagaaagctgctctaggcctcccaactatactagcgagtagcgacgcagcacaaaaacacagtttggagctccagctgacagtctctcatctactctaggtgccttgtgcagaccctccatccaaacctggaccgaagacctcatttgctacttgtcttgtaagtttggtccccagcagcagtcttcttcgccttttctccagcttctgcaaattagcctaattttcagtcaaatgacaggtaagaaaaaatagttcaataggatcataaggcatctttttccaaaacatgctttgttcctggctttccagtcttccagagtttatgcagatttataaaggtgctttggtgaaattctggttaggaattagcccgttgtttctccttggcttgcatctgcacggaatcgactaatttttccttgcaagtcgatttgaggggatcacctcgataggatagaggataagcaataatatcacgaatatgggcgtaagatcccatcctatgagattaaggtttctacgaggagttgtgttgtcacttgtcagccgaatgattgttcctcagtttcggagggctaaatgttagacaatcactgcattcgtcccaaaatggtaaccttttttagataggtacaaatattaattaagtaggtaaaaataattagatgaaatttgtgattggttgagaagagaaagtagatgaaaaaattaaataaaaaataatgtgattggttgagaggaggtagtaggtttagaagtaatttcattctaggataaatcattgtgctaaaatagttacatttttagatggaggtagtattacatgtagtccttcatcttaaaataaatcaactattgaagttaaaaccttattctaaaataaaataattcctacaatatcttcttacctacacttagtcctagaataaaaaaaaatatttcttcatcacttcatgctactttcttaccttaccttaccaacccactcatcgatactactttcttgaagtgggtaacagggtaagtgatgtaagtgggcttaaaaattaccacatcagatttatattatggggcggagggagtagcataaaaaatctgtttctttttaggagaaaacctttactgtggaggaaaagttataggtgcatggttatatccgtgagtccaaatctcaaaacggagaaaattccttacgtgtacatgagtttttccttcctctaaattttgtttagttccctaaatgccattgagttctcattttaatcatctccatatccaatatcagttagttaaccatgggttaaacatgtttttttttaaaaaaaaacaacaactatattgcctgtccggccctcaattatacttatgtgctgaattgttgagtaaaataaaattctcaatgtgaaaaaagattcatttgtgatagaattatttcatcacaatttaaaatttaaaattaattttataaataaatttaaattaaaattgatgaaatttttaaaagattttcaccaaaatttaaactcaaataaaaataattttgatttttagtttctcgctgaaacactataactcttgtatggatttgatcgtttttgaatttgtttgaaaatttcaaattttgctttccaaatttggcaggaaataattttattccatttgattttttttttcaaaaagttgatatctatatttttaaagtaggtagcacataactatgagaaaggggcattatagttatttagaaaaatctaatggtccactaacgaaatagataagaagagatcaaaatgaaaactcaaagtacatgtagagtatgaagcaaaatttataggcatgaaaagggttgagccaaaactcacgtgcacataagtaattttctataaggttgtgtttggttgaaggggttggatgggtcgggtggggttggacccaatttatagggttttcgtttttgggatgggtgaaatggaatggacatattccatttagatccagatctaaatcagccaacaaaatcaagcggaccatctcaaccaacatggacggggcacacaacatgagtctcgccgctactcccagtcgtctgcttgccagccggtcgctacccttcagtgtcgtcggttggcaccgctcctccttttttttaaaaggtatacgattttaacctttgtctatttcttttttttaattataaaagcattattttcagtcttgactcatatatttgccatgtgttaaaagacattgtgatagtacacatatttcctgtgtaactgtaaaaaaatggttttcttgtctaaatggatgtaaaccggtagcccatgcatggagatttcaatcgttccacggaattacttaacaatcaggagaaggcacaacacaacacggtcatcgcccaacttattctacgatgctacatgaacgaaggtaaaagtacagaggatgaaagcgaaacggtagagacggcccggagaagcttctcgcaatctcgcatccacatgggcccaaagcatcctagcaccctgttcctttcggcagccacacgcaacctgctgctagccgtagttgagccggaatatgtcattctgcacgaagaagcttccctgctcgttgggcaccagctgaaacatctgggatcaaatcataacataaacacgagatcagaccgtttccaaactgaaagtaaaaacaagagaagggaaatgaagtcgtgtcggtgtcagccaagtgctaacgggttccaagaattgttacctggctgaacctgagctggtgctcctcgccggcgagctggaggttgccactgacgaagacgaggatgcctcccgggaaggacggcgtgggttggcagtcgacggtgcagacggcgtgccggcattgctcgaagggcagccccaacagcttccggccgatctcctcggcgccggccaccatgtgtccctcgaaggagagcatggacgtctggccgtagagcgcggcgagcgcggcgcggttggtgtcgaacgtctggtagtagtactccacgaaggccctggccaccacgtcgcactgatcgctccagccgccgccgccgccgccgctggcgccgttgctgctgccctccttcccatgcccgtccattgcccctgtctccgcgcgccgtctgtgtctagctatccgtggctctcgtgtctcgtgcggcagaacagacagagtacgaaacgctcgccgcgggcgcgccggctatttgtatgcgcgctgacggatgggacgaacgatttgtatatgggagatcgaagaggtgtgttgctatgctttgccgttcttttttctgcatattggcgtaggtcgcacgcccatatcgtgtacgcgagtgcgtggaggtggagccacgagagcgcggacgcggagatggacgaaaagcagagacgattcagctgaacacggaaaaagagaatgagaaaagtgggaggcaggagaaaagcggcaaaggatggatatgaatctctgcatttcggactatgggtgtgtctagttcacgctaaaattgaaagtttagttgaaattggaatgatgtgacgaaaaaattgaaagtttatgtgtgtaggaaagttttaatgtgatggaaaagttgaaagtttaaagaaaaagtttggaactaaactcagcctatattgcctgatcacagtagcggcatatattatttgatgggaagttgcaaagttgcaatgcacatcatctcaaactccaacctttcatctgaaatactgatcctttgcattgctggctgcttcggaagatgcacgcaaagaatccacacgtggacgtggccaatcccaaatatttggctgacaaggcgaaagataattcggaagcgcttgcccactagccgcttggagcgagccttcgaccaccatacaccgaaagccggcggttgctttcggccacggaaaggcgacccgatccggcgccgtcctcgcgtggtcgcacagcggaaaccgcagcgctttcgccgaccacacgaggtgccaatggatcgcaccattctttgccgagtcgccgcagacacagcccgcaggagttttttttgtttttagatttttttttaatatttacagaaataatctatcgacaaaaaaaattgcagaaatagcccctgccgccctaatggtgggcggcaagctgacgtggcagacggtgggtcgaccgcgccgtctgccgccgtcggccaaaattgcgattaggcccttgctg

SEQ ID NO: 70798 - DNA, 2644 bp, Oryza sativa
cgtcttttaatatttcttttttttaattccgaattttctataaattgtatttctatatagactctatgctcttcttctaatattatttatttttatttctgaattttcatattatattttatatacgtgttagttattaattatttttaatatcaaatgtttagttatttgtaaattatatatattcctatatgaactctagactcatcttttaatatttttttaatttcgaatgttctgtaaattgtatttctatataaactctatgctcttcttctaatattatttatttttatttctgaaattttattatttctaattgtatttctatgtggactctaaactcatctttcaatattctttaatttttaatttcgaatttcagctacttctaaattgtattcctatattgaccttaaactcttcttcccatgtttttttttatttcgaattttagttatttgtaaattatatttttatacagactctaaactctacttttaattttattatgtttattccaaattttagttagttttaaattcctatatggactctgtcggtgacatgggaccgggagtatcatgactagaggcttgggcagccgcggtcacccacgtggcctgaccccctcgggggggtcgggcccgggggagacgtgccaccccctcctctgtctccccgaggggtcgggccgctcctggtttcggcccgagggctggggcgccccgaccccctgtggtattggcgccacgtgtgtgggttaggtgggcacagcggcttctcaccaaacccaatttattgcggaatggacaagcgcgcccacgcccatttaatgcagcacggcgcacgcatatccggtccgtgaccggtcgcagtgtgtgaccggtcacagaccggtcagatcgcggagtaagtggcaggcggcggcctgtcacacgcctggccccgtcccgtcggaatgatgagagcctcttggcactcgtccctagctggagccggcgtggtacctcctggagttagcacgtcagtcccggctcgattcatgccaggcttcatcgcaaccattgcaaggaagtcactgtatgaagaagggcagatgtgcggcatgctaaactgacgcgtggtggagaagaatgaccggtctgtgactggactgacgccggtcacgtcatcggcagacaaccgtgctcccacgttgcatctgtttccggcggagtggaggtaggtatgacccatcccatcggagggtcattcagacagcggccattgcagatctccgcccattaatgaagagatgacagggtgatcccctgtgtccgacgagtgacggcgctgggcatcactcaaggacaagcggtgatttagcttccaggcgaaggcgcgagtcaagatttggtcaagatagggtgggtccccacccaaaagaagagtaggtagaagtggtgcatgtggtatccccttgagatataaaaggaggaccttgcccacaaaggaagggggacgactctgagaagactggagcttggaggggagatcgagagaaaaaagaaccagaagagaaggaaaaagaggggttctagagcttgaactctcttgctctccggctctctgtaactctttctcacacatatccaccagaacacaggagtagggtattacgcttctcagcggcccgaacctgtctacatcgcccgtgtctcgtgcgtttgctctctcgcgtacattccacagatcgagggtgaagaacctcactcagcgcccccggccgaaccggcaaaggggggcctgcgcggtctcccggtgaggagccccacgctccgtcagactctatactctacttctaatattccttatttttttaatttcgaatttctattttttttcttaattgtatttctatatggactctatactctacttctattttcaattccaaattttagttatttcctaattgtatttctatatggactctatactctacttctaatattccttatttttaattccgaatttcaattattttctaattatatttctatatggactctatactctacttctaatatttcttatttttaattctgaatttcagttatttcctaattgtatttctatatggactctagtctcctcttctaatattccttattttttaattccgaattttagctatttctaaattgtatttctatatagactctgttttttctttttcagttatttcctaattgtatttctatatagactctagtctcctcttctaatattccttatttttaattccgaatttcagttatttcctaaatgtatttctatatggactctagtctcctattctaatattctttattttttagttccgaattttagctatttctaaattgtatttctatatggactctgttttttctttttctccgattaatgtgagaatttctaggccatgagagcgaacgtggaggctcctttttctatggactctattctcctcttctaatattcctttttttttaattccgaatttcagttatttcctaattgtatttctatatggactctagtctcctcttctaatattccttatttttaattccgaatttcagttatttcctaattgtatttctatatggactctagt

SEQ ID NO: 70799 - DNA, 4627 bp, Oryza sativa
ctagcatgacgtaccccttcgctagttcgctgtatccaatttctggactttatctcgcagcagtagattttacttctaccagcttattgagccgatcagtcttgcaatccatcttaattaccactcgtttttggacaaaaggcaagcgacttcccagcataaaccaagcttagttgctgttcaagccggattagcagatactctgcgtctcctcccgaagtgttgttggggatggaaccttgccacctaccgctgcactgcgggtttggtgtgctacctgcagtacggtcaccatttcgtcacatctgcatagaccggatgctagcttggagtagctaggaactactacgctgcatcttcccgtcagtagaatttgctttcgttggataatggcgtaacgctctttgacggtgtatatccatttgcgaatagagaccaaactaaaaaaaaaaatattggcataatgctctgctcgggctggtgggtggtatggcagccactttcctatgcacagtgtgcatgtagccgtgagagtatacctaatgatgattgcttttatgctttggtgaatataaccaacttaattacctacttggaaatgacagaccgaaagaaacgtgcgaaagctaaagagaggaacatatacgtttatgtctaattcgccacacacaaggaaaaacggaagaaaaaaacaaatgctaacaaggagtaggattgatgggaggtggtagctagactgaattagtttaagacgtacgcaaccatctctatgatcgatcagcgttgaacatttgactactcgtatatataaagctaccgggcgtatgatttcctcgtgtagtagttagttattctcgcattcgttttttcctcgtgctatatgcacaatctttggatgcattcaaaacattctgattgtgactttctccatataccaatgggctcatgcttatggcgtaacattaaacttttcgccggtttttattcttgttctggtggtcagccggtttcttggaaagaggaaattgatcgtagtttcaaagtctcctatacgactcgtccagttggggatgaaacaatctacaaatcaaacactagcagagacgtacgcagaatttttttttccactggcagcaccatttttctttgacccgaggtagaaatcttcaggtctaccacatcatgattagatttcaaccaaccagtgctccaattcggatacccattttaacattgcgccactaattagtcagctttgtgttgcttagttgagccatactttacgcgttctgatccttcacatcagctaacaaatccaatccttcccctgaaccaaaatctttcagtactgctcccttcaattccctagcaagaaagcagagaacctttcgacaaacaaatagtgttgatactaattataagtgggtgctggacttctgatagcttcgtttcaacagtctacacccaagggccattaggaaaatttatctgatgatagcttagctccaatcttaatctggaacaacatgtctggtccattaggcctccactggaatagaggaatatcacgggagttgaactaattcttgtgaaaatcctgtagaagtcatgcctttatctttatgctatcactaccattctctaagtcatcgcggataagaaaccatgggcaagaaaattttcagaatatcaaaaagataaaatcctctctccggtttcccagccagctacgaatagttggaaacacacctgctgcttggctatgcttataatagtggaacatgattcatatttctggttttcaaatggagtcaggtgagaaggatggaacgagattattgataaagtaccgttccaaaaacgttcttatccttatcggacaattatcaatgatagataacagaaagtaaaatcacacggcatcatcgctattattttattaaagcaacatggcttctttttttttgtgagtattcatgcaaccatcgtaatcttgacgtgtaataatttggcttattgctatttgctacatcgcagaggacctggacaagctgagggagatggagatgttcggcgaggacggccgggacggcgtgtggacggtgatggcgaacgtgacggaccccgagagcctgcaccgggcgttcgacggatgcgccggcgtgtttcacacctcggcgttcgtggatccggggggcatgtccggctacacggtgagtgcaccaaactcggtccctaaccttaagatcctcgcaactactacacctacctatgttatgtgttccctaatgctgtcacagaagtcactaagtaagttagttatgtgttccctaatgctgtcatatagaagtcactaaataagttaggttagtaaaatatagaaaaaatcatgcaaacaaaacagagtgaacttgaagagaatggcggaaaacagagtatatatgctccatctaacattctaactcaaggcgcaactgaacatcaaagattgatgttgaatgtttggtgtactataaaaagagcaatattatttatggtcgttaagaaggtatcaagaagtactacaattttactagaagacactaaattttacaattaaaaaaagatacctcctgatacaccataaaataactcgtaaaaggaacattgcgattttctttgtggtgatgtggtggggacccagtaacagtctgaacttctggaaatcaagcaattaattgacacataacggcgttcgggaatttttgaagccaatggacatagatcattttcgtaattaatggcatgcacatcacagagcctcagacatctggcccagagaaatttgtacagttgagctgtagagtttgcatctacatgtacatggcctttggtactgcacgtggaggcactcatgcctcaaaattcagaaagattttgtaagaccgagtgacgagactctgtagttcgtgtaccacacggggaagattctgctcattcttggcttctcctcccaagagacaccaaatagtttatggtacccgttatctagaaacgttgggcgctgcggtgtccatcacagatgttaacggttataccttccatggttacttaaaaactgagaccttgctgattgtcgattccattggtcgtacagtagtatcaagatttcaaaaatgacaaaccagtactattgactgatgtgaagagcggcagatgccataaaactagccttatttcgagcagacttaataaaaaaagggtttatagaaaaaggctcaatcaccaactcgtaccttcaaggattattttgtttacgagccaatgtcttgtttgttgccaaaggcagggtgggagaggatcttgaggctggacagtcctccttgtcgccctttcgttgacattttgccaaacctgaagtcctcctgatgggagcaggttgtaactggtagtcctgcctatgcagatggtcttgcacctatctgatccatgaagtagagcttccggagcacagcattggtgggcgcacgcctgtcaactccgtcacctaattcattgacagaaaatcgcttgtccatagcaggggaccgggtttattatctgataagaacgggtaatcaggtaggattagtatctgagtgtgatgagagtccgcattgcagcaagagttggacaatacaaccaccgaatccacttcggttgggtacttccaagcagccgtcagaatcatgacgaccttagtgtaaccaaggcgattaaagaacagagatgccatccagttgcgtcctactctgcaacaatatatactccctctcttttagatttattaacatatatataaatataggcaatattataaaatcttatattgtgaaatgcacaatagagggagtatgctagtaataggctttattttactgttcttgaatacctttattttttttaccattcttgttccacacaatataacctctttttaatggaagaaatttgctgcaatttggaggaaatgaactggttcaatgaaaatcctgtaaaatttatgcgtttcaaagtagccctacgttcgattttgctatatatttgtcgacaaattttcccctaaaaatttaacagatgtaattacagtacaatcgtagtgtaattacactataacttgcatgtaattacactgtaactatagtgtaacttgtatgtaactttcaaaaatctctccgtaatatgttatttcgataaaatggaggtcgtgggaacaaattctttcacatatgtgtgtactatgatttgttttcttcctcaccaaaacaaatcttgtaatagatctaacaattcaaaattatgtgaaacttacatataagttacactgtagttacatgcaagttacagtgtaattacatatatgttacagtgtaattacattatgattgtattataattacatctgtcaaatttttaggagaaaatttgtcaacaaatgtataggtagtcccccctacgtttggtatctcaatcacactagtgtttatcatttatctgcagtaagagcctattgtagctaaaataaaccttaccaaattttggtattgccaaaattttggcaagatgacaatattgcgaaaattttggcaggatatcttatgtatttact

SEQ ID NO: 70800 - DNA, 711 bp, Oryza sativa
tcctgcagcccaaccgggactaaagatgggagcatctttagtcccggttggtaacaccaaccgggactaaagatattttttctttttttttctgcttttaatattgaatattgatttcacaccatcccctcccatatccaaatcatcacatattacagaacatctccaaatcctcaaacaaatcatctccaaatacattacaaactcttaaaaaaattccatcacagggttctaaaaaattcatcacagattcacatctcacgcaaaaatacatcacagattcacatctcaaaaaaaaaagaaaaaaaatccggccggcggccactgccgcctcccctcctcccctccgcgccggccggccagcgccgcgccggttgccgccgagcggccgcccaccgcagccgccgcctccgcgcagcctcccgcgccgccgtgccggccgcccaccgccgccgccgcgcggccccccgcgctgccgcgccggccgccatgcaggccgcctccgcgccgtcccctgcgtcgccgcctccgcgccggccgcctgcactgtggtgaaggaaaaaaggaaggagaggaggggagttagagataaggaaagagataagaagttagagaggaaaaaaagagatagagggaggagtttgttgtgtggacgggaaaagaggatcggtactatggattatatagtgtgttttgatctttagtcccggt

SEQ ID NO: 70801 - DNA, 681 bp, Oryza sativa
attcctgcagccccgcgcatatcaccgtaacttgcttgaagaacttgttcatcagcaggcagtggcatgatattaatcacaacctacacaacaaacattagtatacggtggttaattacatgacagagtgatcaaacaccaaccaattaaaccgacctttacaatgtttataataaggtattccctttcggcaaccactccaaaagctctcctcacctgctgaatgctaatctctgttactgaaaccactcaaacacttgattagatcgaaaaccttaatcagagcctcccactgcagctgcagcgaggacagccatggcgtctccgaacagcgaagctctggaacggtacaagaacgccatcacggcggcctcctccgtcgtgggcgctgccatgctgctgcgccggatcgtcgccgacgtcctcccggacacggccctgggcgcgctgctcctcctgccgccaccctcgtcccgccgccactgcgtggtcatcgaggagttcgacggcgccttctacaaccgcgtcttcctcgcggccaaggcgtacgtctccaccctcctcgccgcggcgcccgtgccgctgatgaaagcgagcctgccgcgcggcgccggcgcggagcaaatcacgctcgccatgcgccccggcacggcggtcgtggacgtgttcgacggggcggag

SEQ ID NO: 70802 - DNA, 564 bp, Oryza sativa
cgggactaaagatcaaaacacactatataatccatagtaccgatcctcttttcccgtccacacaacaaactcctccctctatctctttttttcctctctaacttcttatctctttccttatctctaactcccctcctctccttccttttttccttcaccacagtcaggcggccggcgcggaggcggcgacgcaggggccggcgcggaggcggcctgcatggcggccggcgcggcagcgcggggggccgcgcggcggcggcggtgggcggcttggcacggcggcgcgggaggctgtgcggagacggcggatgcggtgggcggccgctcgtcggcaaccggcgcggcgctggccggccggcgcggaggggaggaggggaggcggcagtggccgccggccggattttttttcttttttttttgagatgtgaatctgtgatgtattttagcgtgagatgtgaatctgtgatgaattttttagaaccctgtgatggaatttttttaagagtttgtaatgtatttggagatgatttgtttgaggatttggagatgttctgtaatatgtga

SEQ ID NO: 70803 - DNA, 14433 bp, Oryza sativa
atataataatgttcaacttcttcggcgggtaattatgttctcaattttatgagagagagagttgggtggcttcacagccatacgtcttaagattaataataaagaacttaaaaggtcttaatatggaaacgattgagaccgtcaaggcattaattggagcttcaaaaagaaactttaatgccctaatttcggaatattaacacctataatataaaggatgtttttcggtcaagtttgtcgtagaaaattgagggttttaatacccaagagagtgggattatctaaagaagcaccttgaaagggaactggtttaccagggaggcctcaccggcgccgttgaccttttccggccagccagcgaggcggccggcggcgcggtggggcggtgacggtggtgccggcagcggatcgcgcgtgggacgggaggagggtggcggcatgatctagaaaccggggggagaggaggaagttagggttaaggggctgcacgaatcttaaagcacatccaatggtccaaaattcgaatgataggaggtgggattttctgtcacatgatatatagacagcccctaaaaaaaataaataatttaccttcttgtccgagtcctatgctgttgcatttgactcccaagtttgatgctcatagaagatgttctatatataagaaatattgctccaaacaaaattattaacaagggattatataccaattgtaacactcgagaaaagaaacgaatggtcaccagttgatacaagatttttctcttcatacaggagtactacacagaatcacaataatattcaattcggtcagttactaacaccaatcatttgttacaatctctcaccaggaagtgaaacaaagttattctgtctatgctttgaattgttcgtgtgatccatcacattgctgcacagtcaacaaattcaaacttctccagaaagttaagcgagcagaagtaaaatctcgagccttttgagatctgtacagaagaacagtataagattcaagctagaagacggcttccactgggttcttggcatcgccctcgcaccgtaggagctggaaacgcatctgacagagtcctgattattctctccacctggagcattttctgcatcggcaatctatctgatgatagctgacgcaaccgctcgatgaaatcctccatgttcttcaccgcattcatcttacccacatccctttcaacaatctcgtagatcaaggaaattgctgagaggatgcccttacgtgtcaccggcccacttgcatcttcagccatgacgatattcaccaattgcaaagcctgatcacagatttttctgaaaacacgtggggattttggcagacggtcaagaagaagcaggatcccatcagtgaacatgtggcattccagcagcatctgaggcacctcatgaaatctggctggttgctcgccttcaccatctgcgtagagtgcaaggatcgcagtggcagcctccgttatcacttcagtatcctttatcttgagcatacctcgaagcattttcattccaccagcatccagcattcttttctgaacatgtcaaactctgacaggacagcaactatagaagctaccttcgccaaggatgatgttcgcttaccacgattgccagccttcttaacaattttttttatagcacctgctaattcattctgtccagctaggatctccctgttttgcctgtgcatggtcagattgaggattattgtgagcctctcttcctcaagatcttgtgtccaactcgatttatatttcctcctaagatttatcagcactgggataatgtccgcatacttggcaaggcaaggttgcacccctttggtggttttagtgagtagctggatcagtttcaaagcctctcgttgcgatgcagaattccctgagaatagttttaggatgcgttgaatttgttcctcctctgaaggttccaagggagtggaaggtgtatcagaagtggtagatggggaaaggtccgagtgatcgaggcaccatgcagaaatcatgtcacggagaaggtggtttggaacagagagagagtagggcaaggagtgatcagtaaatgtgctggtatttgtccatggattctgccgtttttggttgttttggtatgtttgatcaacagactgcaaccaaacaagcaaaatatggttactgggataatccaaatcatggtggatttgcagaacataaccaccatagctaacttcagaaaaacagcacacagtaacttattgtggcaaaaaaaaaaagttttactaatcaatatatcaagcaatagaatgctaaatcgccaaaatgttcataagttatggtacaggatattatagaaaaaggggcaaaagactatgcatgaatggaaatgaaagaaactagggtaaaattattattttgtcccgtgttctatccttcaggatcactatacattctagtcattatatcataagatgaacttatgaaccatcataacgtgcatgaataaagtatcaaacctaagcagcatttgacaattcaaactactacagaaagcaggaagcgggtgttaattttaacagaaccaagagaaggttagcatttgatttgaaagattaaaaaataggaatctaagatttaagatgatgcaaactcaagagtaaatctaatccaagaggatttgcattttagtgttcggcaagtgaagcctaaaaactagaagtgcattgtaaataacaatatttaaacaaggacactaattactaccatccagtgtaacaagtgtataagtacaacgaatcaatgttttgtcaattggtgatagataatttgcctggtttctgacaatcttagctttttggcagaacattagctacaacaaacaaaactgaaaacacccagcagataattatacagaattccaactggataaaaacctccattatctaaaacaaaattggataaaatcctagcaaaggggcaatcttgtcacttacatatccagaaggcaagataacaggatcacgcattacttccgcttgaagcgtaccatcctgtgaacacacataattgtaggattagtgtaggtgggtaagaaatggatcaaacttttgattcgatgcaactatcatacgtatgaagaagcagagatgggtcaatcgatttgactgaatgcaactgtcaggcaagatgccatgggacttgcacaaatgatcgaattcgagcgcgtgtaaggaaattcaaccagatgctaattaataatgcccaactaaaggaaagggaattcttcattgatcataaatagcacaagatgtttcccattggtgatcactgatcacgatgcagggaaagaatcaaacagcaggcagttcttgcacaacaacaaacaaaatagatgcagaaagaaatgcaattgatctccttaggaaattcctcgtcctaaaacaaacaggaacaaagaaattcctactacccaccagcagcaaaaacaaacaagaaacagaacaaggaggcgggtttgcaaagaggcaaagatgacaagaacatgaacagagctggaagcctcgacaagaaatgccaagaattcagagtcaagagaccaaggagcaggcacttacatgagcaataggaataggccatcttgtggcgaactcgtaaggcagctctggaggcttcgctttgcggtaggtgaggtccatgaggccggtcatcgcctgctccatcaccgcggacgccgcctcctcgtcgtcggcagcagcatcgtcgtcttggaacttggccaatgccatccgcatcatcgcggcgtagtcagacctcgtggggccatcatcggcgcccgcagctcttgctgggtcctcgttcttgggcgcagacccagccgtggcttcatcagcgccggcatttcttgctgggccatcgtcctcgggcgccgccgagcccgacgtgccggcaacatcagccgcccacgccggcgggaactggagcgggggcgggctcgatggtgtcctcaggggcgaggttggggcggaccgccaccctggcggcaatggcagcggatacaagccggcgtggtccaagccgaggctgctggagcgttgcaacccagacatgtccgccttggccttctttgccaactccatctcgaggcgaagctgcgcttcctccgcctccggatccatggccggcggtgtcctccttcccgaggaagaatcgctgcttcccgccggcggtgggtgggtgcccgtggcctcgagccggcggtcgaggagttcttggtttcttgcgttgcggggtggagtggagcgggtcggtttcttggagggaaaaatgtgaagaggtgtttggatacaaagaagcctggggcctttctatttataagccttgagttgaggacttgatgaccaggagatttctggttttgctgcccctgtgcagatgtaggacgtgaagcttctgacgagatttctggtttgccttgagtgaaacatgtaactctgcatcatggtgtcacttgatcatcaactgatgaacactgatctgaggtcttgacaggaagacgcatagaatggatcgatggttcttgctatctgggaaattgatcttgctgccatcagatattgctactagaacaaccactctgatcaagatcaattcgtatgtcagcaagtatgagccgtgtagctgagcctgagcgcaaccccgcataggcgacatcgatcacacatctagatctcttcaatctccactgcccggttgtcatcgtgtcaagacatctgccccagtgacacatgaaagcagaaggtgcccaattgggagccatcatgtccatggcaacagtgctctgcctccgccacgccatcgcggcaacccggtcaaaccgagcatcctggcccagatcccactgtacgttcacggcggttgaccctgccgcgcgctcatccccgaaggccgcagctggaacagcgccttcccctcgtgcggcatttcgtcgagcacctgagctgcatgccttgcccgcaagccccctctcttcgcggtcagcaccgaggcaccgagcgcccgcaccagcctcactcgccaagcgccaccgccggagacaacgcctcccaccacctcgccggctgcctcctccgtttgcatcctcctcgcgcccacgcgacggagaccgtggcgaaagcgcagacacgagtggtggtagcattcctgtggagtgtggagtggtgggagcccggccgccgatctagattctagagacatctagccctctaggccatataagcccaataaatctggccggaatttcccgctaactgcacttagagaatgttaaataaaggaataagttcacctgccatccctctttgacatcccttatcctctgtaccaaaaatcttcacccataaactatataaaactgtgcagtttagtcccataaacgtggcagcatagagcgaaacaaaaagtatgtagggcccatgtgtaagtgagagaataatgtgggccccacatctcttttttcttttctttattctcctctctccttacttctcttctcgggcgctcggcctctcgtcctcctcgctagcagtagatgggggggaggtggccgccaagcccgcccgagctccgccacctcgagaggctccgccgccgccacccccaacgacgacgacctttcttctacttaccgtcgcatggatcccgccgcggcctaggaaaggcgtcgtgccagcgcgggcgggtcccctatcggcggttcttactcttcagccgccgccgcatggatcccgtcactggcctaggaaggcgtcgtgccagtgcagatggatcccctttcggcctctcctcgtcctcgccgccgcggtatggatccccccgctcacctagggaggcatcatgccagtgatcttgccacacctcacccacctaccacccccacctccccatcaaacactaccaatatccatatccacccattcacgcgagcgactaatcaattcggtgagagtcaacggcggcggaggaggaggtggagaaagaggaggagagtagatctggcgggcggcagcgatgatgaagttgttgttgccgcaaagccagctgtggcaatcggcggcaactttggcagtgcagtcttcgggaagaggcatggcgtccggcggcgtcaatggggctggctccaacagtggcgcatggatgatggtcaacaacaaaacatcgttggtggcgagatgataccagtcgctggcggtgagaaaggcggggtgcttggtcaggcggtggagcacacgcacatgtcgtcgtcgtcgggtgcagcggcggcgaacatgggcgccgccctggcgcgtgtgcgtcgtcatcgtcatcgttaggtgcggtagcggcagtggtgacgacaaagcctcttgagatggcggagctcgcccaggcttgccggtcacctcttccccatctgccgccggcaaggaggatgagaggtcgagcccccaagaagagaaggagagaagagaataaagaaaagaaagaagagatgtggggcccacattattttgtctcacttacacatgggccccacataccttttgttttctctatgatgccacgtcggcaaaaccaggcatctatgctgctatgggacctaaattgcacagttttgtataatttatggggtgaagatttatgatattatggataagggatgtcaaacaaactcggtgtaaagttgaggaatgacaggtgaacttattccttcaataaacgtgcaaccaacgacatctaagagatagctaaactaccatacatacaacaacagactattaacttgctttcaccaattcaaggtttcaatgttttaaacttttaatcgtaacagtcccttgttccaaggagttgggcattgctgcatgttctatttttctattgtgcgccgtgacatgtagagagcccacgtatgtgcagatttgcataagcgcgtctaattagtcacgggcttttctctatacagtttactccctccgtcaaaaaaaaagtcaacctacctagtataatgaatctggacatccctttgtttatattcgcatcccttcctaggttggcttttttggaacggagggagtatttctctgctaatatgctaaaatcctactatataataattagattagattattaattcgctattgtactcgctcttacattactgcaacaaaaacttgccaagctggcaaacgagaaaaaagttttgagtgcacaacagaggcgacaacggcaaaacagtatcgatgcatggagatagagccgacttagatgatactaaacaaacttgtaataacataaacatatcctattcacataagcttttaatatatgttttgcatatcaattagcaaatataaccgaaaattttagaaaaaaaaattatacataaatttctaattacacttgtatgtaaattttatcttcaaattcattatattttaactgtaagaaaaaaaagataattctgataaattttaactgtaagtttcgactcatcaactctccaactgcccaaaaaataagtccgccatttttacatgcatcatcaatccatctaaacatacaccttacagttttcagtttgcgacacaacatacaacctgtgaaagtcctgctgataggggcaggcaggcactaggcagcgagggatgctgcggtttggtatatgggccatggcaaagccaacgttgggaaaattcttttcctcaatggcaaggtgtacaacatattatacctttctaggtgaaagaatccaaaaataaatcaatataaatggctccagaatgcctcatcaaatgttgcatttgtcgtacccataaaaccatgagctgggatcactgcttttggagacctcgaccgactggaagggcttgaactcctctcgccattgctcatcgccgaagctcccacctgtgtcgtatctagcggggccggtctcactaggctcaggtgactgtacaacattgctgggcagtttggattcagcgagccgctggtttagcacaagaacttcttggtcatgatcccttttcaagttgtcgatttctgcaaaggccttgttcatctcctgctctgctaactcagcccgcttctgcagcaaaggaaaatattgttcttagttttgatgaaatagtgacatcaactcaattatcattgttctaatttttcaggttacttaaattttagttgatactgcacaggtttaagataagtaacgagaaccagataaaaaaacaatgcaaatcatgaaaggcaaaataattggtagtacattatttccgaatgggaaattaagatgcatcaatggatattagcctgagacaagggtgcaattggctcacaagagttgatttgaacagaatttcatttggacgcagaagtgaaggcatggaaccataaaaaaacagaacaagggaagaattaggtgttcggttttaactgggagtatcgatgcaaacatcatcagattggctttgtactggagtctaaagcagagcatataaaaaagatgcttacactcaggatcacttactcgaggaatttagcatgtgataaatagctttataaattatagaatcaaacttaatgtacagtactccctccgtactcgtaaaggaagtcgtttacgacaatgtttaagtcaaatcttgggaatataaatcataaataactctcaagttgttgagtttgaaaatttaaaaattatatgaatagatttgtcttgaaaaatattttcataaaagtatacatatatcacttttcaataaatatttttatagaaacaagaagttaaagttgtgttttggagaccgtgtcgctgtccaaaacgacttcctttacgaatacagagggagtatgcgataactacgtaccaaggttccaagcatatctatgtatgcaaagcagaaaatgttacctgcgcaagtgatgcagcttcctcagcatcatttaaccgtacaagaagctcaccagcagcttgcacagcttcagcagtatcacttagctgttgctgaaggcctttattttcatccatccaaaaccgacgctccttctctcgctcagctcttaaaattgatacttgcctagcaagagcattaatgaacttagattcagcccctcgcacaccagcttttgcagcttcctttttcacatcttcaatcccatcattgatggtgcgacacattgagagcaaggatgcatgtttttcctgtaattcacaatactgttctaaaattctagcatgcccctgcattgccatttccaatgccccctttaattcctctgagcattgcttttctgattccacttcaagctgcaaacgttcagatagagatttactcttctcaagctcaactctaagctcttctgtaagagtaatccatctactctcagcagcatcgacaatgctgtggccgtcatcaccagcttcttccaaagccgaaatggttggacgatctgagacagtactaattgcctggacaagttcaactggaggcctacacaatgccattgatgatgacagcatgtaatgcaactgatttttcaggtgttggatttcctccagtaaaacttccttctcatccttgaagtttctgtacctctccaattcttcttggattctttcaagctcgattttagcactcaaaacttcaggatggttctcatacttctgatggagaatctgtttttgttgatacagagacatgtttaagaatatagctttgctcagttcaaaagaaccaagtagatatttggcaacatagaaaataaatggaaaagcagaagaccttgttttcgtcttggagagagagattctctgcatgcataagttcttcagttggtaaaatcccatccacaagtgtttcaagccttgcaattttttcttctcgtatttgtgcaattgcagcattgcattcacgttcatgcttatattgttgcacctgcaaaaggaaaacacttcagatcgacgaataaaagatcctaaaatctgatagcatgggcaaggcaccaaccaaacgttttagctgttgaatttcagcagcttgctttgcacactgttcatcacgtaacatctctcgtctgatggctccagcaaggaccttctccacagcctataggaataaaacaaacccttgcataagttgtcatgctgatattgcagataaatggtgcacacatctgcatagtaagttagtaacctactttaaagacttgttcctgttgctttagatcattagagggtattgatccatcaactgttactaactgtagatttatgcaatcagagatttctctgtttccatctgtagttgcttcaggctgattgctaggaattagagccatagtgttttgtcttggttcagattcttcggggtcggtttgaatagccacatcaactttgcaaactggaactgaaagatgagcgtccataagtctagtgttaagacctaatgatgatctcctccaagtaacactattccgatggctttcaatgacttgaaggcccttctgaatgcttgctgccaagtttgacttgcatctacttgtttcaacatccccgtgaggaaatgaagacttgttttctaaattacaaggcttttcaacatcattgtcatcaatctccatctcctcatcactatcatctttgatggtggggaatgcagttggacgactcaagctcattttcaaaagaaagctattttgagaattccacccagtggaagggctgccattgcttcctggcaagctcccatttgatctcacgtgttgaagctcctcctgcaataacgatagagccaattaattgaaaatcatgattaccaaaaagaaattaaaataataccttcagctgcctgatttgctcacggagaacattgacatcatcctctctttgttcattgacaacagcattgttttttatatcttttgcacggtgagcaaatcttagagtgcttagtgtttcactcttacagctgcagaagaaaaaacaaattataagcacatgaagaagcaagaatggcaaaagaaaatagcatgtcagtctcaaacagtacttctgtgatggtgaaaccgcacaaatcattgcgagcttagcattaccaccaagtgattcttgcaaaagaaaggttaatttcgaatctcgataaggaatatgatgcctttgttttccagactgggatacctccgccagtatattaatcaggtttctgcagcaacaataagtagaaaaataattagtgaatctttacttccctccgaccatattttttttatgattaggacaagatttggtcaaccttttgaaatttgatcatcaatgacttttcaactgcttattttataataaaaattggtgtatgcagatttgccttgaaaaatactatcataatattatgaacttattagaatttataaagttatataatataaaacgaatggtcaaattttcaaaagtttaatgaaatcctatcctaagcttcaaatatttctgaattctgaccagcgtaattaattttaaaatgcaaatgactgaatgtctatggtttgttagttctaaagaactttttttttgtgtggggggggggggggggaaggaacataatgtaactgtatctaggaaattttgcaatcatatagcagtataatgcaagacataaaggatcagttaaggagcccacatctagtccatgtcaaatcagtatgaaaaggccataaagaaatccctgggtatttgtctcaagtttagtaatttttcctgtcttcaatacatatttgtttccaaatgcattgtataccaggatgtatgaaaacattctcaaaatcatattaaaaaatgaaaatgacagtagtttcaaattcatgtaatactctccatttgttttatgaaatactgttcaaatatgaatttcaaatataaagggcacaacaatgcttcatatacatttagagactcacatctggccaattctatgatgactgatactttattaggtacactgaaactaatggtgcaacgtaaagaagctatgctaaatttatgatggcaacagggaatacttgtacaaaccaaccataaatccttcagatgcaacagaaagggcaatagtaattaggctttcaacacattcttcattcattgaacaaatcataccccaattgtgaaagtgaacggtttatgttccctgcttcttttaagcgatcaccagctgcgtttgttaatttctgccgttctgatccagcaagatcaaccaagttgatcctacttgttcttgtaaagtttgatccgtcctccatattctgtcaatagtaacaaagttgaagaactataagatcatgctgaacaataagttattggaagcatatgaattgaaattagcatcagagtaatttacaggtacttcatatatacatgataatccctccatcccaaattatgagccctatatttttttttacacggtctgcaatgacatactttgatcattaattcattacatgttatgtttctagtgaatatgaaattagcatcacatgaaagtactttaaaatatgaatctagtgatataacatgcataatatttagcatagatatggttagtatgattattagtcaaaagttaccaagtatgattttccttaaaaagggggtgacctataatttgggatggagggaatagctcgttgaatttacagagacagcataacatgcaaatacatgagcaaaagatgaatcaaaaggtaatgccaccattttttcccagggaatgcccaccatatgcgagaaagctaagtgtgaatatatgctcagcatgccagcaaaacacatgaagatgtaacagattacttaagactctctaaggatgtcctcaaagagccatcaatgcaactttgcactatcaggcatcaaggaaataccctaatggtaatgcgtccaaaaaattacaactacaagtagctatcctacaattcagttaaagtttgcgttctgtagggaaaaggaaaagattgaggcaagggtaataagagctactccaaagagaaaatgtcagttcagaaaaagaaagcaacctattgttaaaaaccaacaatgctcctataaaatacactttgctttctaatgtaataaaaagatgcaatcatgtgctcaaaaggttggttgaagggcagggatgagggataaaatttagagtttcactcgagtatgaataaggtaatactttggattctgacttaatgaaacaagtaaaaacacagtgtgatcgtgagctttctgcatttgcagtagtagcctcagttcttcggtttgccaaaccctgcaccatcattaataaataaaatgaaattatccatgaaagagatgcacattgccaggccatagggcagaaccattattaaagacacttgcatggaaaattatcaaaacatgcaaaaacagaaaatatgcatcatttcttatcttttttcttatctaaaattatcttaggatcaatttttcttagctactagtggaacaaataatcttaaaacgacataagctatgaagtagcatattattattatatggttagaacatctacatcaataaagcacttctgagcagtaaatacaacttttgttaaaaattggagtaagcatttatcattacaactacatggaagagcaaaacaagcactggtgataaggttttagatgataagacaaacagttttaccttttctagcaactgtgtaacatcatttatcgtgaacacggattcctttgtcaatgactcaacataaacagaagaagtaccaacatcttctctaatctgaaaatgtacgagacgtatcagaacagaagcagcctacataaacagaagaagtaccaacatcttctctaatctgaaaatgtacgagacgtatcagaacagaagcagcctaggaagtattttaattaaattctgaaactccatttcacctgaaggtttctttgcacggggtccaacaaatcagtaatttgttcattgtagatctgcatatcttaaaaagtaattctgaatttctatcacaagagagaatcataattattgtgattttagaggcttaaatagcacttgcctcaaggaaagagcagcagcaatggtatactagttgtttattggagtgtttagcttgctcctgcaaattaacagtacatatggacctttaatttgcaatcaggaaaaaagggagctatatagcaaatcatgacgtacctctttgatgcgtgaaaacagtagttcaaaaacacgaggagtcagccccctctctttgctgaccgtatcgtcggacaaggcagacagtggcccccacatcgtgtaagtcttccccctaccagtcttacaaagtagaaatttgattgtattagtcaatttgctttacag

SEQ ID NO: 70804 - DNA, 718 bp, Oryza sativa
  unsure (1)..(718): unsure at all n locations
ctgtcccttgatgaccactgttgtagcncncacncnattgcgttgccctgcatgataagcagcaaaattgcggccttgttgtggattgtgaagattttctcgaatgaattgttacattaggggatattcgccgtatgggatttgaattacatggggacagtttcacaagtggagaccagctcaagcccgctgtacgtttgaatggtgaaaatatgtatttccattagaatagttctacgtaaataagtaatgaattggtgtgcatcatttcacttggtctggtctaggctggacactgattttgtttaaaccattgccatttaatgcgatagcttaaaatgaattctaaattgaatgtacatgctttctatctctgaaaggtaaaaacaaaacaatttacacaggctggcaaggaatgtgtactaattaatggagatgttgcaggaaaattcttcaaccatatcattgtgtcttactcgaggattccagtacgaggggaatgaacgtggattgctaacctgctttcctgatactgatttgaccactgcaaaaaaccttatggaagccagaggaataaagcagctgcctgtcgtgaaacgtggtgtcggccatagaactgaaggaaaacgcaagcttattggtcttctacattatgattctattggtcactgcttacggntagtcataagcttatatgtgttctttcaaactttatatt

SEQ ID NO: 70805 - DNA, 6118 bp, Oryza sativa
aattagatctatcattgagcatgtgatatcaatataaataagagtatgaaattcctatagagtttttattggacaattatatttcatttgaagaaaaaaaatcatgtaatatattttctacagaaaaattttaggcttcgaataacataagattgtgaacaggtgatgatagccaatcatctagcaaaaccggtatgtgtaataagtccaaatactccctccgttctcgaataattgacattggcactattcaaatttcaactttgatcagttgtattttttgtgttaaatttatataacacttgaaaacatattatattatcgaagtgtgtagcatcataaatataaccatacatttctatttttatcataatataatcacctaaaagtaatccatggtcaaagtgagacggatgtaatcagcagtctcaattatttgaggacggaaggagaacagagggggtatttaaacagacttagcacagcagattagcaatccaaacagtactgatcagattcttgggcacttttgcttgtcttgtttaggcaaatcacccatacagatcaagagccgagacacagcaccatattagtaactcaacggctcggtgctcacccatctccagaaccagaaaagactcacaaccaatccatttcctaacaggtgtaagtctgacacagaacaccatcgagaatagcaggtttaccgagtgggtgaaacttgaaaaaggtgtaccatttctaacctagaataaaccatcagaaataagatggtcaataaaatagcctagaaccttttttgtcctcttgtttcaaggcggaaattagatagtctccaagttgcagttgttaaatctaagtaaaccaaagctacatatgcttccacaaattacgagagcacggaagtaacgaatcccccaactcctccgggatctctttttttctccccaaaaaaggagtagacccctctcccgaatctaatcaaatataggtactattcgcagtccacctccacccacaggaataaaagaaaagggaaagatcttagtagaaaacatccaagagcataacaataataagctactaataaaaggaatagtaacaaatttcaaaaacaaaaacccccttacccccgagctgcttgggcttgggctcgggctgggcctgggccctggcgtcgaccggcggcgcgggcggcagcaggaacgaggctggcgacgaggccacggactcgtcgagctcggcggcggcgcggccgaaccctagccagtccgcgcccccgagcagcgccggcgccgccgccggctgctgcggccgcgggtcgccgccgccctgctgctgcaacgagagcatctccgcgggggcgggggtgcctcctccctaaggtgaggccgccgctcggccggccagatcgcccgggcagccgcaggcagcggcagatcgggcggagggggaaagcgggagggggttgcttcgagcgccttcgagaaggtgggggaagagagaggagagagagagcagtaaatgccgccgtgttgggaatcgggaatggaaaacggaagagaagctgcagctgctggctgctgcgggacggagagggcaggtgtgcgatatatacggcatcgaggtggaggagacctgcccctgtgcagacggagtggggaaaaaaaggaatttatttttgctcttttcttttttttatctactaaaagattgtccagattcgttgtattagactatattagcttttttttatgccaacatatataaacttttttagattggtacggatattatgaaaatatgtgtgaatgttttaagaaaatgagtgattggttaaaaaaaataagtagataaaagagtatagttacgattggttgagagggtaaggtaggtggagaaataactttattttgggacaagataatatactagaaatagctatattttaaaatagaggtagtagggctacgcggcaccaggaaaatattctttttattttgtgttcttgcagctctgattatcttcttaaacctcatttacttaaatgcaatataatatatactccctatgtttcgaatgtttcgaaatgtttgacaccgttgattttttagcacatgtttgaccgttcgtcttattaaaaacgtttgtgagatatgtaaaattatatgcctacataaaaatatatttaacaatgaatcaaatgatagaaaaataattaataattacttaaattttttgaataagacgaacggtcaaacatgtgataaaaagtcaacagcgtcaaacatttcgaaacggagcgagtataaaagatccgaagcaatttacggcaaaataatttagttaccgttagacaaaaacttcgttgagttgtaaacacgactttttaggctcagtcttgtaggagtataaccgttaggtttaatttactattaaactaaggtttttcttgcggaaaatattaaactaatgtttgataatatatatctccatcctaatataagtgcatcctaatataagtgcacctagtaccaatatgatatttcatggtacaacgaacctacacctacacatacagctatccaaattcattgtactataaaatatcacatccagtttcatgtgtatttatattgggaaggaggagccccatcggttggcctaataaaccaaagcaaaagctaaaatttgatttttgaactgaattttaacaagattttaaaatattttcaatgtaattttgctacaaataaaagtgtaaaagttttacctataaattaattttattccctaataagccaaaccgatggggctagtagtatcctcgcatgattctttcagtacattccaatattacaataacatggttgtaacacatgaaaacagtctagatccaaataatgcaatactttcttctatcataaatatttgatatctttgtataaaatttagaaaaaaaaacttcactcattaattttacattatgacaagatgataaaatttattaagtttatgttgctaggatagtactccaaaacattttgtgtgtatgagaattgggaccatatattaacgatgtagtatataattataagtaactattgtataaatgaactattaaattggttatagatgatttggagctagtagttggctatctctaagcactttcaacaaaatggcattatcataatccactatccaccataataccaagcaaaacatcagcacacagaaccaatattttgtgaccaagcttaaagcataagggagagaaaagtccctcgtttttcatgcgcacgcttcctaaattgtaaaaggtatgttttttaatatatatatatatacatacatatataatgttttttaaaatcgtattaatctaccttttaagtttgaaataattaatactcaattaatcatgcgctaatcactcacttaaatttatgtatctttttaatcttcctattttccctcctctcaaacacacccttagtagttaaggcatactctgtagcaaatcatcacaagaacattgctcgacgtaggaggacaacagtaatgtgacataataatataactaaaatataatatattcatttgttgcgtagagatgttattgttattgacccatatacgtgtaacccgccctcttgccctacctgaacctgccaactactcatccacctcagtttcatactactcgcatgctagtactaaggttggtattcaaggaaaagcgtgaatagtaggtcttcaaacgtaagaatgaggtcgtattagagaatatgtaagccagaagtcattggatgatggtaacccatggtggagacgatgggaggtgagcaggggcttggcctccctcataatttgaggtttgcaatgttaatcactattgcttaagtggttttgcgtaaaattactatctctctttgtcctctttagcagaaaaatgaaaatagaatttaggattcttgttgtgtcattggagccgatgaaggacccgatgaagagaactagggatgagcatagatggtgctttcaaaatggtgctgcaataaatgttcataattgaagtcaacagttgggaaatcaagcttctccaaatttccaaatttgtagtacattttttattttgaattccatcctaaaatataagacacgatccattttttcccgtgtctcataatataaggcgtgcatgtatgcatacattaactatcaccttttaggccgcgttcgttacctcccgttcccaacttcgctccctcgtttttcgcacgcacactttttaaactgctaaacgatgcgttttttgtaaaaaaaaattctatacgaaagttgcttaaaaaatcatattaatccatttttcaaaaaattagcaaatacttaattaatcacccgctaatcattgctccgttttccgtgccagggagtgagggttcccaacccttactcccgaacgcagccttagatctataaatttggtttattttaaatcatgtaccatcaagtattccaatcatattgcttgcatatatggatgtgattcaatcgaggaggtgattaatcttttcttggtttttgtgttagaagtggttgagccttatattttgggatgaagggtgtagtacacttcatattgaaaattcataattggttattccatgttccaccaaaactcagctaaccgctggttgaaaatactactccatccattccattttgatcaccttaaaatttttgaggtcttccgaaaacagtcattatctaacaagggtctctttatttatttgtgcagagagtacatgtgcataattgaatgtattgcatgcatccaaccaaaattaatttctattgatgcaatggcatacagtatttaaaacatgagaaatccgcaggacacaaagcgatgaagcaccttaaccgaggaggattaatttaagaatgataaatatttttgggatccatagtcttggtgtcatttgcttatgggatgatcaaactggtatggagggagtattactaaacactagacacttagggtccgtttgatgcataggagttatcaaaaacatattcacatgaacttcgtaggagtcaattcatattatctagatttcaagtgcctgaaatttcccaaaaaaaaatcatatgccttttctaatccatacttatcaactatcactccccagtagtttgaaatctaacatagaaaatgtcgacgtttgatgtcgtgattccggtatttgcataatatggggatcgttggtactaggatatatgcgagactgaggtaaaagagatggggacgaggatttttatataggttcgggcccctgaattgtcaggtaataaccctactcctgttggccgaaaccagtcgttgctcttattcatcataatcacaccagtacaatatttggggtagcctatctatctgttgtcgacttggcggccataaaaccatcccgtagccgacaacagagtagtcttcctcctcgaatctgtatccggcgagatcaaagacagcgctatgtctctcctgatagtatccgtagacaccgtaggggactagccatgcttatctctgaagtcgatatccggcgtcttgtcttggtgtatgttgacttgtatgttgatcttgtgtattgatctattgttccgtctcccctctcctcctagggggccttgtatttatacccataggtgtccccttgtccaagtagaactaaggaaactaatatggatacaatccgagtagttcttgttgtttccatgtagaactctagtcatcctcccttatgcggaactcctcctatatccgaaggttgtttccatataagacaaggtatgtggtgggtcctgccgagatttagtcaactactattaggtatgtgctatccataaccctgacagaaaaaaattacaaaattagatgaaaacaaacttaattataactcacaaacaatacaaagtcacataaaaatcaaacttagacaaaaaaaagaagtaaaactatctataacaacatatttgcttttgaaatgaataaaagttgcacattgcaacttagggttagtagtgtacaattttaggtgactagaaatttata

SEQ ID NO: 70806 - DNA, 10755 bp, Oryza sativa
  unsure (1)..(10755): unsure at all n locations
ataccatatacctaatagtagttgactaaatctcggcaggatccaccacataccatgtcttatacggaaactgacctcgagggagttccggataaggaaagacaaccagagttctacatgaaaacgacaaggactactcggattgtatccatattagtttccctagttctacttagacaaggcgacacctataggtataaatacaagccccctaggaggacagcgggacacccaccatggggtgatcaacacagacaatcaacgacctcaatcaacacccaacacgttacacgggacaacatacaagcctacatacgccaagacaagacgccggatattgacttcagggataagcacggctattctcttacggtgtctcaagatactgtcaggagagacgaaggcgctatctctgatcttgccgggcacggattcgaggaggaagattaccctgttgtcgactacgagtcagaccttcagaccgccatgtcgacaacagttagataggctaccccacatattgtactggtattattatggtgaataaagagcaacaccggctccggccaacaggatgtagggctattacctgaccgctcagggacccgaacctgtataaaaatcctcgtctccatctcttttaccttagtctggcgtatatcttagcaccaacgatccccatattgtccaaataccgtagtcgagacatcaaacgtcgacaaaatctagcaattttcattcttgaaacaattgtttagttttatgaaatcatactgttatattcctaggacacgcgaaagttagggtttgattgactcattaccgagggcatgttggaaagagttgtgtggctgttgtgcttattcttgcacatgaaactgaacggatcatcactagcacatgattagttaaatatcagctattataaatttttaaaaatgtatttatttgatctttttttaaaaaaacttctatatagaaaatttttatacaaaacatcacaagtagcagttcggaaaatgtgtaaatgaaaatcgagtaagttgtcgtttggagttgttggaaataacagcctaagagtgtgcgaaggcacaagcctctggaatacatatctaaagttggtcataataattctttgtatataagcaattcttctttatcactgggtataaatcaaccgcggctctgataaacaaacgttttgaataatgtctaaatacaaagatgatatgcatatcttggtgagcaccaaacaatgctcgacatcatgagaaccttatcccttggaaaaaagggtgctgtgctatctttttcttattaagtatgggcgtgaagcatcagaaggggtttcattggttaggcggttgagcaccgcaaccttcttggctcttttccacggagagtgagacacatgcaaatggagaaagcgactgagagtcgatcgatccgttaatatgaacactgctctggctctcgatggagtctcctcgatctcctggagccgacaattcaagagccagcccaactgtgatggaggagggaagaatcatctccgccaggtctagccaaacacaccaattaagtgattaacctgacagattagcttgatcggatccagtgtgcagacgcgtgctgcgcctcctcttgcctaggtctagttcttttctttttaacttcaaacttcacatttctcgtattttattaacacgattttcaaactattaaatagtatattttttaaaaaaaatattagattgtttgaaaaaaattaaataaatcattaattgctacttaattaattatatgctaatgagttttatcttttgcgtgtgctgaaaatctttctctaacttgagagactcagcttagaataattagatatcactgctcgatcaatggtttgggttagcagtaaaattatcatggcaaaatccatactgtaggtgagagtgtgagaccatgcatgaaacctccttgcaaatggaaaagaatatagaaaagaaagtagatattcgatgttcatgtacacatagaccagtggttagtaaaacactgccacataggtgtttaacggttcataggaataacacaatgattttcggtatcgatgtaaatcggaagccttgaaatagcttttatacgaggatctcaattaattagaaatgctcaaatacatgcatatttgttagatcctgcgaaatttatctgaagttatcactcgttctaattaattaaggcctccttgaaacctataaatattccatatatgattcatgtgcaaaacaaagttgcattcttacaaaaccttacaaaattaagccctttgattcaaaggaaaatcatagaaattttagagaattttatttttataggattttctatataaaattatttgaatcaaaggaataaaccctatgaatcctaccaaattcatatggaatgtctcattccaatgtaagttttgaaggaaatttaacaagaggtagaacctcatgaaaagttttatttgagtctttatctctcctcaaatttctatgcttttgtgtgtgtctattgttagaaatttggtcataattcggcatattttaatccaaaatattaagataatacatatgacatttgtaatttgagtagatctagtgaaattgctagatgtgtacaacatgagcatgcttaatatagaataagtatcaacatagacaagagaacgcaataatattgcgacctacagttataggaaacgaagaacgaacggtaatagtgaaacgttatacaccgagaatggccatccgctggagtttgagacagtattgcctccgttggtgttgacgggaggctcctcctccttgtcaccagtgttgttgttgtcgccggttgtcgacatgttggtgaagatgatgcagagcagtcgcgcttgaagcgctacccaaaaacatgatcgcccgcctacccgtgcaggttctcaagcggacggagtttcggaggcacctgctcgttccgatcacctgtgtgcacgggatgaacagaaccggggaaacagagagacatcacaggaacataaggagagtatcaccaagaaacaatagcagaaggaagacacaatctttgagagcctctgttttgctttatatatagagagagatctccattaccatacaaataaatctcatttattgtgaaggttaccacaaaataaatctcatttgttgtgaaggttaccacacaatgaatctttcatttgttgtgaaggttacaacaaataaatctctcatttgttctggatgttacaacacaatgaatctcttatttattgtggaggttacaacacaaataatttcatttgttaatggtgactttattctcgtctgttacaaaacggaagagcagcaggcaggctcggctcggtcggccgcctcgtctcgctacgcccacggccgaggccgactcggcacgcgcgcatgcgtgtggcagtccaaccatcacctcaaccggtcaacaagaaatccccaatatcactctatttaagttgaggttcttccacctaaattttcaatgcagtattattgtctctaacattacttgtgggctattaagattttaatttaattaaattgggcctagcccatttattccaacatccattgctcctaatcaaaaggtcattccggtgttttattatgttttacaatcctatattttatacttatattttgtcaaaattctatatttttgttccttcttttttattcctacaattgaaaggggcatagtgtattctaaattcctctggaaaatactcaggacacttggcaagccaatcgagtcacggttgtccaagttaaaaaaaaaaaaagagccatggttggaagctgccgtagaagatcatttggtggcaaggaaagacaactgccgcgaagactacagacaagcctcgccgtgtcagtcaactccaccacactcatgtctccacgtttattattctgcaaacgattttccctccccaatttatattattccactcaaagagtacattagtaatttcgaacgaattggtctggtctagtttgaagactatatagtgtgaaaaatgtgttaccttaagaaaaaagaacttcactctagctaatcgataatacgatttatgtgtcgcgctcaaaaaaaaaaaaaagcccatcaatgccctcatgtacgcattgcatgcatatgctgttggaaatatggttatatatcggtatattttaatccaaaatattaagacaataattatggcatgaacaatgtggggtgatctagtgataaaatcaaacataaacaggagcacgcttaagatagaataagcatcatcatcatacatagaacgcaattgcattgcgactaacagagatatcaaaaaccgaaataacagtagagagttataccctgtgaatgtccctccgctggattgtgaagcagagctgcctccattggtattgtcgatcggtgcacctggtgcggcagctcttgctctggctcccggcgcgccatctccaggtgcagatgcggcagacatggttgatgcagacgtacggtcgacgacgaacagaggacgaggagcagtcatgcggaagcactccccaaaaacctgatcacccgcctacccggtgcagatctcaggcgaaggcgtggttccggaggccctgctcgttccgatctctcgtgcgcgcaagcgatcagaaccggggatgtagacagaagcagcacaggcagcggcggcggcacgcggaggaggaagaaccagcgtttggaaaataaccgagaggatctgatcgggttcccactttccttatgggcgcaggagagagatccgcccgtggaggaagaaccagcgtttggaaaataaccgagaggatatgattaggttccctctttccttatgggcgcaggagagagatccgcccgttaccgcagtaacgacgcgatcaatgggtattgaatcgggttccctctttccttatgggcgtaggagagagatccgcctgttgccgcagtaacgacgcgatcaatgggtattgaatcgccctctttccttatgggcgcaggagagagatccgtccgttgccgcagtaacgacgcgatcaatgggtattgaatcgcctacccgttgtcgcaacgccacgtctcgccctggccggctcggctcagcgtgcgcgcacgcgtgtggctttccgatccccacctcaaccggtcaacagggagcctccaataactccctatttaagttgagatactcctcgtttaattcccaaggtggtaatattattcttaacatttattatgggccttttgagatttaatagaaaaatcaggcctagcccatttattctaacatatgcctccatccacctgttacacaatgcacacttgaaaatattttttttcctacttatatagtttagccgaaaaacatagctatacataaatacaagagaattttctatttggcctccaaagttgatcgattttctcattttccccacgaaattgattgtccctctaatgccttgcattcgtaacttttgtcctccatggctccatcttttattttgtttgttttccatcaagtaggtgggtaaaaatgacagctttgcctcagcttgttttatgcatgtcagtagtttttatttttcttttgggtgggattatactttgttattatggaccaacggttattgaatatttctcacgaacctaaatgttattttgagtaatgaagcgttatgaaaaaccctttgaatttgataaataacttttgagaacgaagggggagccaatttcgtaaggacaataggggaaccgatcaactttggagcacagataaagaattttctcttcgtactacttgagtgaattgcagtttagaccacccttttatcgttgaagtttcactttagattatcccatatattaatcaatatttcttcactttgagctaggtaattttatttttattgcatatcaataatcttgagtacacctgtccctgtaggttgatgaactctatcacctatgcatgtacctttactaaaggagaggctagacatgattagagaagtgagttggagtggtccataatgcaaaagtataaagttacctaccccaaagtactccctctatccgtgaatataagggatttttttttacaagaatcaaggaagtagtaaaataacatgtgatgagacaaaaggtgatggataaaagaataaagtagtataaagttagtaggtgggagaataaattagtataaaagtaaatgatggagaaataaactagtatataagttggtacatagaaaatatagtactgtcttgggtcttaaaaccccttatgttgtaggacaaacttgatggagaaaattccttatattatagggtgaatagccgaagtggtccttcaagtttcatctgaggctcagtttaatccttgatgtttcaatctttccatattagtcctttaagtttttattttagtttaaacttatccttgaaccaacaactctcttgataaataacacttatacccccatcattcacatatataagagaaaaattgtatgcttgatttttttatagataatgtatagtaaattatgtaaaacgaaaataaattatgtactagcaagtgtatacgatagcaattgcttaagtttcatgtgcacatgtagaaataatgggaagtatatctacaatgttatttattcatcttggttttatcctttttatatatagttgtatataaattaagggcaaaagggacattttctaatagaaatattgactaaaaatagccatatggcatgttaagtgggcccaaggatgatgtcaagccaaaacaaatatttagaggagctatgtggacaaaataaaaagtgaaggaccaaattgagccttcgataaaacttggaggactaaattagctattcaccctatattataggatggatggagtagaaagattagtgtacaatatacaagctgaaaatttgataataaaagttgagtcaaaatggaattcactctagatactttgacgaagagtatctcattactgttgtttcaatgtgccaaattggaatgtgatgcatactccctccgtccaaaaaaagacaaaccctggtttccgtgcccaacgtttgatcgtccgtcttatttgaaaaaattatgaaaaaaattaaaaagacaagtcacgcataaaatattaatcatgttttatcatctaacaataataaaaatacgaattataaaaaaaattatataagacagacagttaaagttggacacggaaactcaggatttgctttttgttaagacggagggagtacatgcgtggccaagagttgttaaacccgctgaccacaattccagaagcatatgaaagctgaaattgtccatgcatgccagccgagctaaccatgcatgggttgacagctatcgcgttttatgtacggaaaggtcgtctcaatttaattggcatacggatcatccaacaaacgggagtcgaaatgaaggccccatacaaatattttataccctctcgtatcgaatgtttaaacacatatataaagtattaaatataggttaaaaaaataaccaattgcacatattacaactaattttgcgagacgaattttttgagcctaattgctccatgatttgataatgtggtgctacagtaaacatttactaatgatggattaattaggcttaacaaattcgtctcacttgtttaataacggattctgtaagtagttttttattagtacccgaaaaccctatgcgatatcctactacctctgtcccaaaataagtgcagccatgagtttccatgtccgactttgatcgtccgtcttatttgaaaatttttttattaatattttattgttattaaattataaaacatgaatagtactttatgtgtgacttatttttttagtttttcaaaaaaaaaaagacgaacgattaaagttggacacagaaacttatgactgcacttattgtggaacggagaaagtactactcaatgtgatatacacccccgaaatttaaagggtaaattggaaacatgccattgtaattttacaaagtttgagatatgccatcggtatctcaatgatatataggacccacatgagtcaatgacatgtgggtcaggatagtatatcttaaattttgtaaaatttataatggcatggttccaattttcccaaatttaatttaaaagctaaggtaaggagtaggcatcgtgagagatatggtacgtaggcccatctggcctttctaccaaatcgccaaccacgcaccttgattccgtatcacgcgacctccagcggttgacacctgtgccgcttctctgtcgcaggatcactggtcagatcggattcgacgacggggaaggagacactcgtcgcgggcagcagcacccgacagaagcacgcggggacgtctccccgtcggcgccagctgccttgcaaagccaaaactaaatgggggcatttgcaaatttgccaccgattttttcaatattgcaaggatgccactcgaatgatagttttaatggtatttttgtaattttctagtgacagttttataataacgattcaagatagtgataaatttacaattgccccaaactaaattaccccaccaacccgtaaaacggagcaatcactagtatatgattaactaaatattaattttttaaaaaaagtaaattaatatgattttttaaaaaactttctataatattttaaaaatacaccccgttcagccgtttgaaaaatgtgtgtgaaaaatgaataagatgagttgagaagtaagagtggtaagttgggaaaggagaaagatcggtgaataactccactattccatcttttcaaaaaatacattagattgaaaacccaatgtacatagccatagtgctcgactattccacgcagttagacgtaaaatgtgtcaatttcctgttcttgttcatattaaatgcctttaaacttagcatttctttcttaagaaaaaaaacttggcatttctttcatgttagaaactagcagcatttactaaggggtaaactcgtctaaaatgtccagcactatatggaacgatatacattttcgtccattctgtaaaacgctacaacaataggaaatatgattaatgaaatattcctggaaaaatcctttgtcttgacgaaataaagtgtgcattatatttttgttcatagattcatgtcaccgcttgtgtcgggaatactatgtgtatcactcaagtaaaacaaatgttttgtaggaaacatgaatcaaccgcatgtgttgggaatacatattttttcaaagaagatgaatggtcaatcatatcccgttatatattaaaaagttggagggagcaactattataaagttaaaaatatattttttttgatttttttaaacttgaatataacctttttcatatatcgtttagtagttaaaatatgctcacaataaatgaggaagtagcccaatgcaacagctcttcaagctctgttcgatgcggcgattggatttagttagttattagaacatgattaattaagtgtaaacaattatattttaaaacataaatatatttatgtttttctttagaaaatttatatagaaagtttttacgtgaaatacgcactgttagctgtgagcttacggtaaacaagagatgaatcgaacctaatctcagtttataacacgatcttaagtatcctaaggaagatatatggcctgtttatattagtgttaaaatcaacctttccaaaatggtcgtcaatgtttggtaggatatgctaaatgtattgccgccaagattctctagggattaccaatctcaatcttcacatctatatctttatcaattatactaaaaattttatatgattcaaaattacaccaatctgaacaggctcatacatactttggtatgtcagggcttgtttggttcaataccctatcaaaatattggtagtgccaaaacctaggcaagttttggtactaccaatttttttggtagggtagagttatatttggtttgagaccaatttagaaccaagcattgagtagaatatagaaaatatcaaattgggcattggcaatgccaatgatttggcttcaaaccaaaatcaccagatacactgttcaaactaccaaagtattggtagggcacgtttttggcactaatccaaaacagccctcattctccccgtgttggaaactaactttatggagaaacgcaatgtttctaaaagcacgatcaacagagggagcaaacaacaccatcaaattccagcacgaccgagcaagtgttgattccaaatatatttttggaattgtttggcacaaatccatttaaactgagagtaaagttgagtggagctcagccaaacagtttcagctccacataaactaggagcggagctgggtgaagcgttatcacaaaatgaactagagatatggagctgggttttggctgctccacaacttcactccagacccaactcctagagccaaattttggagttggagttctaccaaacatgacttttttttaaaaaaaaccctcaaatataaaaatactcgagtctactctacctccatccagtttttaatttaaaccagcgctactactgctccagccacttcattcaaggccgtcgtgtatagaaccagctgattcggcaaaacaatgantcatccgg

SEQ ID NO: 70807 - DNA, 42707 bp, Oryza sativa
  unsure (1)..(42707): unsure at all n locations
tggttatgttggttgtcaccatcacattgccgccataatcaccctcattgttgccatcgcatccaccggctgttgctgcttccgcaaatgccgtcgccgtccgtatctgcagctcgagtgggaatggagaagaattgtccaccccccctccccgcgcgtcgcgatcaccgccaccgtcaccaccgcagatgctgacgccaacatacattgccacgctccaggagtcgattcgacgcacccacgcggtgccttgcccttcgaacatcgatgctctttggtcattgagacgcggttggtagcagcctaggtgataggcgcacaagcaagcagccctagcatatggcccactaagggctagacaaaaaactcgtggctcattaacttactcatctcgtgactggctcacttcgctcgggtcggctcattgggaattactaacaagtcaagccaagtattttgctcgttaggcataacgagctaactcgacttagcttgcaacctaaatgagctggaacccaacagcaggcaaccatgaaagcatggcctagtaacagcccaatcagccacaaggcccatcacaacccaagtaacagtgtcaaaaccctatgcaggcaaaacaacagacacaaataaaaaatgcggccggtgctggaaagtacaatcgcaaagagcatcaactgccacatacccttctgaattactatagcatcgatttgtaaaaatacaagtctcgtgatcatcacttttcctatctgaatgatgcgaaaattaactattttaaaattctaaaaatcatcccaactcggtttgatattgcaacctattttgtttggcatatagcaaaacttgctgcgacggtaattaaacatcttttagtaattctatctatggtatctcactgctgaagaatccttttgtactccctgttcataactgccaatagtcccggttttccaaccgggattaggaatccgggactaaagatgcccatctttagtcctggttaaaataacctggactaaagatgccaaccatgtttagtcccggttgatgttaccaaccatgaggactaattttttttcttttttttctccttcggttttttcttttatttttcctcctttcatatcttttagtaattctacctatggtatctcactactgaagaatccttctgtactccctgttcataactgccgatagtcccggttttccaaccggggctaggaatccgggactaaagatgctcatctttagtcctggttaaaataaccgggactaaagatgccaaccatgcttagtcccggttgatgttaccaaccgtgaggactaatttattttctttttttttctccttcggttttttcttttatttttcctcctttcatatcttctcattcacagcacgattcacagattcatcacaaatacatcacaaattcattcacaaacatcacagattcattcacaatatcgattcacatattcattcaaaacatccacaaatcaccacatccacaaatcataaacaaaataaaaaaactaaaaaaaaaatcaaatcaccgtccgaccaccgcccggcctcccatcctgccaccggccggccacccatcctactacttcccctccggccagatctggaggaggggagggcgaggctgccggtgaccagcctctatcccgccgggccaccgccggccggcctccatcccgctggcctgcgcccggccacccccagcccgcgcccggcctccatcccgccgccggctgcctctgcttccgccgccgcctgccggagggtagtagggggagggggaggggagggaaggggaggaggagaggaggngagagaagagcaagggtaggatggaaggagaaggatggagatgagggaggagaagaaaaagagataaagatgggagatggaggctgcgcatgcacaggatggagagagtgaagcaccggagatggtgcactcgtgcgggtggacatttttcttcctggttggtgttaccaaccgggtataaagatcaacttgatcttcaatccctgttggtgttaccaaccggaactaaagtttccatctttagttacggttggtaacatcaaccggactaaagatcccctggggcctgacaaactctaacacaatcccaactgggactaaaaatcatctttagtcctaattgttattaccaaccgatactaaagatcgcatagtcctggttggtattaccaaccgggactaaagatcacatagtcccgttgcacttataaactggaactatttagtcccggtttataagggaaccgggactattgtgaaatttggtcgaccgaccaaatatcatttctctagtagtgtctccaaaagaagtgtcatgactatacttctataagtatttaattttggtaaaaactatattcataactcacattttatgagaacatattgattcggctaagcatgtttgaactggggtggttttacaccacaactaagtagtagggtggacatttgtaagaaaaagacttatgaggtagaatgtcagaacttaagttatttttagagtggtttttataactttaagtcacttgtttcattcctactatgttttttttccctgagggtttagtcgttatcatagtgatgtctctctgccgcttcaagaataaaaaacgaaattataatttattttccatttctttaaattaatcattttcaccatttaatagattgattgtgggcctcctccgaagaggataaattataaaaacaaacgatattttaggtccattgtacatgagaacagtgtaatgcacattttcgtggcggaatattatatacgagtacctattattacaggaaatcgtcggtatcttcttaaacaatgtacatatatagactgataaattaaatcatacaaaattttacttatattaattcacggctttcatatcaatatcagaaagttattagtaaagctacaaatattcatacttattttgcaattagaaatctttgttttaatcgggtaaaaaatttgaaatcccatgttaaacaggaatacaaacatgttataaaccacgcctatgccattttttatagacatgaaaatttgattgttggatccacagaaaaaattatagcatcgattcctagttttgtagcactactacgaaaacattttttttctagatgataccccgcacgttgctgcgggacatgctcaaaattcagctattggttaagtaaaaaaaaagaatatgctatccattgggtaggacatgcatcctcaagctggaaaatttaaaagataataataaatagattttttgaatcaatatttttttagtagaggaacagaagttcttaaaaacaatatatgttaacacattttagctaaaacttcaaaagatgcgatattgtttgggatcatgagttaacatacaatgttgtgtgtttactcataaaacgttgtcacaatgtagtttacattatagagggatagtttacattgtacagtgacaatttatattgttctgtgaacgctagccaactaaaactcatttcaccgtcttcctgttaaatggtctacatattataattttggtgaggctttcaaatttattgtgtggatctacatataaccatgaatccaataaatattatttattaatccataagagaaaaaaatcaggaaatacaggaatttcagtaatacactctaatggtgatgacaccacaacacttaatcaacatttaaattttttattgttgggatctagggaacacataaaaaaggttgtggtaatctgcttgctttgttgcactgctccaactctagtatttgtttaaccgttcaagaaaaaaaaaactctgtttaatgaagagctgaaaggttgaaacagaggatcgcataacgataagagacggtggtacgaacaaactgaaaagcacagtgcctgcaatttcagaataacatcagaaattgacaacaatatatagaatgtgcaagcaatttaacatgtaaaaaagataaaattgaagcaagaaataggtgaatgcaaagcaaatatgtggccaactaaacatctaatagaaacttccaagtgatcaatctaacgaaaacatgcttcacaaaagataaaactgattggccaagcatgatcacaagtagcgatccatgcgcaatgggagatcgaggaccgatgaacgaacccgtgcggccgtgccaccgattgagcaaagaatagcgtgtgaatatatcccactggttccttacattggcgtgtgggtgtggatgactcatctggtcgcactttttataggttatgggtgttgccgtcgagtcgaatcctattgcagttacgaaagtccaatcaatctctaatggctaacggttccaagaagaggaagcgcaagggaggagatgggggtggcagaaaggcggtagccgaatggcgcggttggcggcgacgctcgcacgcaggcggaaggatgctttgttgccgagaatagggaacggcataagggtggtgggctgggccgatgagcaagatgggctaggagagaaggggaaagggaaatgggcttggagaaatacactggatggagcgatctaggccatccaagcttcatcctatggctaaatctaattagggatggaaaataggtattaattgcagtttttggatcaattgtacagatatataggatgtacgggcaaaaacagtttttatgtgcggaggtggcgcccgtctgcccggaagtgtcttcaaaaatcagggattctctgtgcgggtggcgcacccaaatgcggaaattggatttttgcgtgcgggtgcttatgtcgaccgtacgcgaaaataaaaatccgaaaaaaaattaaaatcacgaaaaaaaatagaaatcgcatattgccgttttccgatcgttactgcgctgctttaaataataaccgtcacctccaagaaacttcacaccgtcacttccgttttcaccgcctagaccatagctgtcttccacctctccggcgatcccctcggcgaagaaagcaatctcaaaagcaactcccgttccagcaaacttctgcctgcaacgatgtcgtcccccgctagttcatccgcagctccatcgcctgagtacgcagaggtaagcccttaccggccaaatcccttttcttgtgcagcagatcggttttcctcctctcagtttgttttcttctttgcatctgtagcacctttcaaatttggttgcgattccctgcttagcccacgaacatcagtttttcctcggtccgattagtgatctagatccaacagagctcatcatcgccgaaaccagtaggatctcatacagaataggcaaccccaacctaaaccattggaaaaacattttcaaatcttggccctcattggagaaaagctggcccgcatggtataagcatgtatcggctagcaagcaggttcactggaatgaactaggaatcagccaagcactagcccttaccctggaaaattcagctaaggacgaaactttgatggcttctgccacgtacttctggtccaacaccctcaacgccttcatgttcaaccaagggccgatgtcacgccttgaaaattgcataatttaataattcattctttaatgcatttttagaaattattttaaaaacctacaagttaaactctaattatctaggaaaaattgcaacataaaattgagttagataaaatttctttaaatactttgcatgtttatctattttctagatttttctgggaattatttgagcaagtaaagtatttttaataaatgaaacattatttcactaattattttaattgaaaaagtttttaaatcttcccctaagccgttgggctgattccacctcatctccctcctttaggtgcgcagctgtgcagcccaagtcagcccagccgagcttccccttctctttctttctttgttttattttcagccagccaaaactgaaagtctactttgcctccctttgcactgttcttcttcaacctctggcagccgatatgagaccgagttggttcggtttttctcctccaaatccggccttttctcttgtgttttcctaaaattagttgaggggaaatatttcccttatctccctctttcgtttccctcaaaaaccgaagtttaattccttgtattttacccgaatcaaattcgttttcgagtttatttctccaaactaaccatcggattttccggctcaaatcctctcgtatggagtccgatctccctcacccatgcctatataaagcatcccctagtcgtcctcttccgtttgcctcaagtcttagccgcagccgttgcctgtagcgccgccgccacgtgagccctagcgtcgctgccgccgtcgctgcttcagccgcgccgcagctgtggtcgccgctgccgccttccgtcgccaccgtcgggttcgccaggtggaggagcatcccgtccgccccttcgccgctgctgcatctcgcgtgagcgccgccgccgacatcaagccgagccgtgccgctgtcggagctcgtcgccggtcgtcgttcgtcgtatttctttgcaccggtgagttcgcgtcgttgtcctcttcgtgtaggtgccttcggtttagccgcccgagctctctatcgtcggcggagtcgtggtccagtgccatggctgcgatgatgtcatcgatgacatcataattcccttctaaatctctaaaagcttttctgtattagatgaaatctgattaaaacttcggaaattcataactaaatcatcgtaactcggattcaggtggttcaaattgctaatttcacctaaaatcgagatctacatgataaaaatatccacatgtactgtttatgcttgtttttttactgttttattgattttattcatttgctttagtttccgacgttccggaggagagcgtttacgttgaggaatgttcagaagcgtttgaagaagatcaaggcaagtcacacagatcccaaacaaccctttgagcatgttgaacatgtttaaagctaatgctttatttcaacttatgcattatttttcgaatgtcatcgggtagtgagactttcccagttaattatggccgaagatgactttattttcctatgggtaataaattgattagcttgaaccttatatattggtttggttcagctaaatgctatatatatataattgcttagccatgcttagaaacattagctcattaatgggatgattacactacattattacacatggatatatttaatggtagctcacgatggttaatcgtgttatgaaaattaattgataattaaaatttaatgaatgatgggttgtgagtacatggttttgatggtcatgctcagtcgtgagctactgttgtgcaacattaaccgtaccaacctcaagccagcgtgggcaacggctttaccttttgtgtagcatggttcattacggggtgccagactgagaagcggcaagaaatccatgggggtcgctggggagtccatgcctttggttgtagagggggttattatgattcaggtatggtgcactatggtgagttgtattgtacgaggggtactgtcacagttcctttccgaggtaccgtggtggtattgaggtgcatggtgacatgttgtggagctgtgtcttgtgggtacagtggtacatctctggctagagtaaaactattcaaatagccgtgcccgtggttatgggcaggtctaacaatgtttttcatgattagtctcacactacttatcattggtgataataatgtgataattaatttgactcctggtttggaatggtatattcctggtatggaggtttgatttgtacagccggggttggttgatttgtactcctggctttgttgtatagtgtttatttaatattgcttaattactcaactgttttactattctctcaaatgtttattaaatgttgtttatgcaaataagctatattgtgccatcctttgttatcttgtgcacttgcatatttgctgtgtggcttgttgagtatgtcatatgatcattcttgcaatattcattcatcagagaaggagtacttcagtgaaggtgatgatcaggaggattaggctttgttcgggtcaagttgcttgtggagtggagtcgccatagctgtttagtcttttgtttattttccgctgcgtagaattttattcttttgagaggaactatccacctctgtaataatttattattttgcgaatattaattagctgtttgatagtactctattatcaatttgttattgtgtgcctcggctgattcctggacgaggatttaacacacatgtaagcttttggaatttttgatagaaattctgggcgtgacaaattggtatcagagccaccttgaccttaggacaagtcaaatggtaaatcttaagtagccttcaaaatattttgaaaaataggactgctcttctctattatcttctaaattaattaagttggcagcacatgcaagttaggtacaaaattttctaaatcctactttaccaaaacagaacctgttcttttctaaaaaaagactttactgttcagggtattaaatagtttaattttatgatttcattggttagtcggcactgtagtatcgattcaatcaagatagcactagtactactcatccctgttaatggtgacactgtaccgtgcttatgatagatcctaagtatttagttttattttattaatttatctaaagcaatttatctctgtccattgttgatttttttcttccaaaacaaaaaattttgtttcgttatgttctggcgagtactgtacaaaaaaaatatatttgcttctttttgtctacttccaaagtctatactcctgtttaaataaaattctcgggaaaaaaagttctgaaaaagaaaaaaagaaaaaaacgaattgatttctgagaatttatgtttcggtcagaaaataaaaattcgaaatttaattaaaaaaacgaaaaaaaaattagttttgtttgctccttttcttttatttttctttttggttcaaattaattgagtctagattgtgcagctaacttaagtatatgcattaattcttcctttctatgttcctttagatgccgccccatccaccggaaagcttgatcgatgcggtaggattcgtcagggagctgagaatgatggcatttgaagtaggctacgacgttgcccccgagtatcgccaaatttcatgtgaccccaacgaggagaagtgtcgtgttcacgtgacattgactagtgatcgtgaagaccttccgtcaatgatgtttgaagctgggggaagaaagtacagtcatgcttgtcaggaggcagccttggtggccattcgagagctacgtcatcgctttgatgaggaattagtcatcagctttccagtatcatccacacaagcatcatgatcaaaactatggagaatacaactgctctgaagatgaagatagcaccactctgaagcatgccgtgtatatgctttgcgccatggatgcagttggcgtggagcgggagaaagcagctcatgagagggaaatctggaaccgtggcaagattttcaagctagagagcaaggtgtatcgcttgcagaaggaacttgccaagctcaagagagaagcaccgccgtcaactaccccaaaggaggaagatccagaagaaagagagctagctaccccagaggaagaagatccatctcttcgctccgacgcaaggcgggattagtgcctcgttagaccgttatcgtagttcgttgtgttagtttgcttgtgcgtgtgtgggtttagcgtgttgcttacatcattggtgggatgtaactacatgagcttagttcttttgcttgtcagagagtaaatttgctggtgagatagtgttaattcgatttaaatgtaatcatacacagttaagaacaatagaaattaaattaattaagttatccgttctaagggtatctctctgtcgttctcccctcttgcccgtgttttcttcagatggtgaacactcgcaccggaggaagtggaagtggaagtggtaacaatgaaggaattcctttcccatccaaacttatcttgctagaatccaagatcttgatgttatcttagggatggatgggctaacctgtcacagaggagttatagattgtgctaaccataaggtgactttatccagtagcaatgggcaaacagtgtctttctttgtgtcctcccctagatctcattgtttgacattaaatcaagttgctttgcatgagatcccaatagttcaagactatccagatgtattccttgaggatttgccaggtatgccacctaagagagacatagagttccggatagacttagtacctggaaccaaccctatccataagagaccttacagaatgggagctaatgagttagtagaggtaaagagacaggtggatgatttgcttcagaaaggcccagtacttcatcgtggggagcaccagttatcttcgtggagaagaaagatcatacccagagaatgtgtgtggattatcgagcgttgaatgaggtcactatcaagaataagtatcctctacctaggattgatgacctgtttgatcaactggaaggtgctacagttttctccaagatagatcttcgttccggatatcaccaactccgaatccgtgaggaggatataccaaagactgcctttacaacacggtatggtttgttcgagtgtaccgttatgtcgtttggactcactaacgccccggcctttttcatgaacttgatgaacaaagtgtatatggaatatctcgataagtttgtcgtggtgtttattgatgatatccttatctactccaagacaaaagaagagcatgaagagcatcttcgtcttgctttagagaaactacgtgagcatcagctctatgccaagtttagtaaatgtaaattttggttgcccgaagtgaagttccttggtcatgtcatctcagctggaggagttgtcgtggatccaagcaatgtggagtcactgctaaattggaagcaacccaagacggttaaagagattcgtagtttccttggtcttgcggggtacaccgcaggtttattgagaacttctcaaagattgctagaccaatgacttgactgcttcagaaggatgtgaagcataagtggacggatgagtgtgagcagagttttcaagaattgaataaaaggctagtgactgcgccagtgttagtcttgcatgatccatggaaaggtttccaggtgtattgtgatgcatctagacttggtttgggttgtgttttgatgcaagatgggaaggtggttgcctatgcatctaggaagttacgccctcatgagaataactatccaacacatgatctagagttggcagctatggttcatgcattgaagatttggcgtcattacgtttttggtaaccgtacgaagatgtatacggatcataaacgtttgaagtacattttcactcaacctgatctgaacatgcgtcaacgaagatggttagagttgattaaggattatgatatggaaattcattatcatccaggtaaagcaaatgctatagcggatgctctcagtaggaaaagctactgtaatatgtcagaaggacgacatctaccttgggagttatgccaagaattgtaaaagttgagcttgggaatagtcaagaatggttttgtggccgcttgagaagttcaacctactctttttgatcaagttagagaggcaagtgaatgatcctgatatccaagaaattaaatagaacatgagaagagaaaaagccatcggttatatagaggatgagcaaggaactgtgtggctaggagaaagaatttgcgtgcccgacaataaggagttgaaggatactatcatgaaagaggctcatgaaaccctgtattccattcatcctggaagcactaagatgtatcaagacctgaaggaacaattctggtccgcatgtgacgagagatagcggaatatgtggctctatgtgatgtgtgtcagcgagttaaggcggagcatcagaagctagccggtctgctgcaaccgttgaagataccagagtggaaatgggaggaaatagggatggatttcatcaccggtctacccagaacgtcgacaggacatgattctattttggtagtggttgacaggcttactaaagttgttcatttcatacctgtcaaaacaacctacttaggaaataagctcgcagagttacatatggcaagagttgtatgttcacatggtgttcccaagaaaataatgtcagacagaggtagtcagtttacttcaaagttttggcagaagctacaagaagagatgggtactcgttttaatttcagtgctgcctatcaccctcaaactgatggccagacagaaagagtgaatcaaattttagaagacatgttgagagcttgtgtttagatttcggtggaagttgggataagaatctgccgtacgctgaattctcttataacaacagttatcaagctagtcttcaaatggctccgtatgaagcgttatatggtcggaagtgtcgtacaccgcttcttcgggatcaaaccggtgagcgtcaagtttttgggacagacatgttgcgagaggcggaagaaatagtgaagattatccaagaaaggttgcgtgttgcccagtcgcgtcagaagagttatgcagacaatcgtcgcagggatttgactttcgaagaaggggattatgtatacctacgggttacgccgctgcggggagttcatcgttttcagaccaaagggaaattgtcaccgcaatttgtgggaccttataagattgtgagtcggagaggtgaagtagcttatcaactagagttgccttcgtcaatggcgggaatacatgacgtgttccatgtttcgcagttgaagaaatgtttgcgtgtacctacggaggaagcagatcctgagcgtatagagcttcaagaagatttaacttatgttgagaagccagtccgaatttcagaggtaaatgagagaaataccaggaatcgcgtcatacggttctgtaaagttcagtggagtaatcattcagaagaagaagccacttgggagcgagaagatgaattgaagtcagctcatcctcatctttttgccagttcttctgaatctcgaagatctgcttaacttcagtgcaggtccaaaatcttgcctttaggttcgtgagcgtaccggttgatttgatcatgcaatcaacaagaaatcgtttgtgtagtagtcaggggtttttatattccgattaatattcgtcaccgtattcgtttcgcttcgtattcgctccgtatttgtatttgataatattcaatttcgtttttatatcagagtttccgatttctatttcgatttcgaacaaaatataaaaacgaatatgatagagctagtttctaaccgtattcgatccgttttcatccctaaatgcgtgtaggctgccctcttttttctcagttggatgggatgctgctatcgtcgttattgctgtcagtctctccagcccagggttttctgtttcgaaaaagcaagaaaatttcggtgggcaccgaaattctgaaattttgaaaaattcggatattccgcacgaacttttttgaaatttaaacacatttttactgaatttgattaaattatgaccaaattcacaaatatttggaaaaaaaatccgaaatttcgcttgaaaaaatctgaaatttccatccctgctccagcccaccatgtcctcatcctctatgcctcatatcagccacactggagtcctcatcctctacgcctcctgctccagtcaccggcaaaaagcgtcctcagcgatctctggctgcatgtgccacgctgcctgccaccaccagccgtgagctcctatttctgcctccgtcggcttcacctgcagatgcacactcgctgctgccaatgatattggaatgtaggatgcctccaccactcgccttggctctttctgccaccgccctcgatcgactccggccatcgtcgccacacttagtcagttataacattaatattagcaactaaattctaactttcaacgaccaaaatttcatgtcattattaccggcacttgacaaatagcatctgtgaaatttgaatttaaacctggatccattactgaaataacatgaataacagaaatcgaaagaatatttgatataagtatatatgtagatggattgccatgttggctggaaaattaacaatcaaggtctagatgggaacaggcttgacaaagagagactcaacgatctccctaagaagtgtgccaaatgtgtatgcatccttcttgtcatcgtagaagagtgccatggaaacggtaaagttcacaattcgctgcaccatgggtagcagtgtacgatgctcaagtcgggtctggttcgtggatctccattcgtcttcgactagtgcattaatcttcgcaaaggcagcctcacttgtgaccccattctcattcatgtagcactctacggagctcgcgacatctctcttattctttccacgcttcacgtgtatattacatataaaaatataaaaagaatagaagtttaaatagaaaataactattggaaggcaatatttattttacttgttttgttcgtaatcagatcatgtttttaattattatatgtagtcaaggctcaaaatataactcactaatatatgcaaatatattaagatttattatgtgaaaatgccattataacttgtatgcttattgtaacaaataccttcatattgtaatgttttcataattttcatgaacatatattgattagaaatggcaatgttaaaaatgtgtattaattagaggttattgatttcataacacacaactaaaatagaaatgcaaaagtagtgacatatatgtaccttaaatgcagcaatatcattcatgaaacgcccaatcttagcacatgctatgactgcagcgttgccactagctacccactcgaatgcttctgtcgtcattgtcccaccccagccaaccatagcagccacacacaataattgcacagctgaggatttggtagacaaaaccacctggtctttgaagccaggcttgtatttctggttcgaccattcagcttcttgcagataataagtggactgcttttgaaactataagcaaaaaattaaatcaaaatcaataactacaggataatgccatcagaacatatatgtgcaaaaaatagtcttatctccacactcgaaaagtatgtaatatctatattttggtgtgtgtgcgcgcgcgtgtgtgaggaatatacagagagagagagcgtgtgtgtttctacctcttcttttgtgcaagcaaccatgtatttttcattgtctgtcacttgatcctgaaactccttaaagttgatcagcaatttactataatactttttgaggtactccggcagaatagaaatagcactcttgtcccatctgcactagttttgcacgagagttagtcgtgctagatacattatttctcattttaatgatccctcaattctttctttcttgtcaattaagacatttacatcaactgatccagagcatacatttaatcattatcttttctaatgatatgtccatacctcaaagtatttgaaatataactgcatgaaagtatttttcacgacaatctaatactccttctgatcccaaatataagtcgttttaatattcccaaatatttgccaaaatacaattcgtttcaggaattgtatgaacttcttttatattttcttacctcgacaattctctcacaaataattgacgatttctttccaatgcagaataaatgaaggacaacaaagtcatttgaactatttattagttcttgtatccaagtctaaaacaactatatttagaatcagagggagtaatgtcacgccatagaaatttgatatcttcttcgatatatttattagtaggctaagatgttacaatttgtcttcacttgtcaggatgttatctattttggaatggataaagtaccaataaacaattaaacatactgaactaatcctacctttgtatcgctgtgttaagctagtggcattcctcgatggtggcatgagcatcatatgtatcatccatcacagtaaccagtgcaattaatttggcaacaaacattctcgtgaatgcaaagccttcctcatagaacatcatgtaggaccaagtgtacccctctattgtacgatccctaatgtaacttagccccatgtatccataaagatctttccaccatctggaaaataatcattccaagagtgtgcttagacctttagttatatgaacagataaggagctaatcattgttttacagtgctagcttgtgggtattgggtatcccatggataatttttcaaaatatatacaatgtcagtgtagttttgcacacaacaagagcattcttctgctccaagataataagtgtatttactccgaataaaattgaatgctgaggtgacatatattcttaagaaccagatagtatatgataacatgcattcctacgaacacctcttgccatcaagtacatatgtgaaaggcatggactgttaatttatttgcacttaacaattttagttatttagtgcattccaatattatctcaaatgacctgttaattatccttttagataatggataaaccagttgttgtatctaagatgcacaaaaccatctatcatttatctatagtcaacaattatcaaagagatcgatcgacaggcatactcagaaattgctttgagttctttcaagtgaatatgttgcaggaggttaaaatccagccttgcgagatcaagaagaattgggatatttccttcctctagttggtactccaacatgtagcaaatagtctcaactctcttgaaagtccttggcagtggtaaggtaagtgcacgcctgacttggcaagctaaaggagggttgagaacattgtcttgactcatcaatttaaggtgctcccgtgcgaaagtgattgcttcttcaagctctggctcgccatgaatgaggaggtgagccgcgttgtataaacttagtagcccccttgggtcattcgctatctcatttcgaaacctcccatcatctcccttaaatttgttgaatgcatctgcatgacaaaaatatttctcattgataactagaaggttgggttattttttatccataatgcgactagtttttcccgcaatctacaaaacgctttttgctgtacccaacatcaaattagaaccctctgttaattttcttacgttgtgtaagctgtttgttttagactgacaaaaataaattattgtgtcttaaacaaattaacaaaatgtaagttttagcaactatcagcaaatgcaaagataaaaatatctaatcagggaataataaattgttggtatatataactgtagatacaaatagaaagagctgcaaacatctcctaaaaaaagttttaggttggctactaataactgtatatttgatcttattgaactacagaagaagcaaaaaccagcaagacctgtcccacaaagtttggatcgtctatggtgaatcagaatcaataacgatttttgttcggcacaaatttatctgttccatattcgtagatggatgtatgcagttggatacctggaggcacccaaaacccatgctccctaagcaggcgaaaccgaagagcaacctcatagagactagagcttgtgaattcactctcatggatgctcattagagcatcttctatctgctcttggaagaggtgaacgattccaagatgttgaatggaatccactaagttcatcctcgccgaaatgtcattgcaggtcccaaacaatgtccggatgtcccctttcaacttctcggccctctcctgcatacatgtctctgatctctgcttgaaattaagtatagattcatcagaacagttagttagcatcgcattaatcagaatgcaagggcaatgcatatatgggaaataacagtgtggtaatgcctgtaatggttgtggttcatagttgataaagaagtcgccccacacagagggctcaaagccgagtacctcctcatggacagcactgtctctcgacaccataatatgtaatacttacgagcaaatatgagagattagcttgatctttatgaatgcaaatgtgtggcacctcaccttatatatagacacaccagaatactgtagttatgtgctctgtccgtttttgttgtatgacgtgcttttgaacatgacattcaaccgtttatcttactcaaataaatattgcaaatatgcaagaatataaatcatgttgtttgtcaaagaacaacactgctcttaaggatatttgtaaggaaacaactatagcgtattatattttcaaaaacctgcttattatggaaccatgggataatcctagagtttcctttacaagttgttctacattaatatcaattgattgggaaggttaaatggatactcactttctagccttcatggatctagtgggccgtagctgagctgcttctttttgatgggcaaagctgaaagctactttcctgtggccaactcatccgtagcgatcttgcccgcctatggtggttttcatcatcttcggtggtgcttcaccatctttggtaacctttggcatcctcaatgtccttggtagccttcgccacctttggctgccatcattacctctggtgggatttgccactcttgatggtcttcgtgatctttagtggtttcgaccatcgttagcggtctttcttaccttcggcctctacattcccttcagtagctgccagctgaagtagttcgtgacctcccaaaacaatgctaaaggacactgaatgataaaagaagtaaaagtaataataatatgggtggtcagacatcatgtccaaaggtgaaaaatgttatacatttgtaaattagagttatcactaattactttaaaggatcgtcaaagcacgtgtaggggcggcttatgcgggtgggcagccaattattgcttgcttgtaccattacccatacatgagagttgcaatcatgtcatatatcgagtcaaatgcgacgtctcttgtactccctccatttcaatctaattacgattcgagcaaccaaaagacaaattaggagtgtgattgaaaatgactttagatagctgtcatgacattacatatgggattgtcaggaatgggagcatgggcgaatttaatgttggggcttgttggggctaaagccccagctccaacaggacagggaatagcgtgtgctagagcacaaggcaggagaagcaggttgcagggaggagcactaagaccctgtttagatgagactaaaacttttaagtctctatcacatcaaatgtttggatactaatgataaatattaaacgtagattattaataaaacccatccaaaatcttggactaattcgcgagacgactttgttgagcctaattaatccatgattagcctatgtgatgctacagtaaacattctctaattatggattaattaggcttaaaaaattatctcgcaaattagcttttatttatgtaatattagttttgtaagtagtctatatttaatactctaaattagtgtctaaataaaaagactaaagttaagccctgaatccaaacaccacctaagaagaagctggtcaactagtttgctagtaggaagaagctggccaggctccatagcttggctttatccatttagacctgctaggcttatagggtgtaggtcatgataaaaatatgaaatcatttttttgggctttaggcataaacaaacaactaatttattctttattgtcaacatcacaaaccatttttatcttttttggtgttttgatactgatttgaaaatttgagtattacgttgctagcgtaaaaattatcttatgttatgtattaaactcaagagccccagcttaattttcattctagattctccactgattgggagagtgattgagaatatgatggagaaaattttgaataaggagaagttacattgcaagggaaaaatattactgtaagaatatgcttattttagaagaaagttctgatctaaaaaaatgcactttattagaaatgggtgtagcacatgaaacatcttcaccgacagctgtggatttttatatgcttttaattttggcgagtagctacaggagacaggcgactaaagtaacaagatacaggctgcacacctgatatgattggctgaatgttcacacgtgatatgaatgatgtattgtttatagctactgacgcggacggcgtctgctggcgtttctcggtgctgatcgacaggccgcctaccgatttctcaatccagcactacttaataaaaaactaatagaagacacccatatatatttggggaaaatccaaatacccccctacaagtcactgctctttctactctcccccctacaacttaatattgttcaaaacactacacataagttaatttctcttccaatttcccacccctattcggttttcacgctttctcgtgatgcgctcaatttctcgttatcatgggccttcagcgcaacccatggatggagttgcctcgtgccaccttggcggcaaaagtgcgcgcatctccatccgcttttaattctgcgagccatacgggtaggacgacatgacgctaacataaacacaggaaaacaatttttagtccaccagtgcaaaacaatagtgtctgcctcatgatttgtgattccacatcaatatgaagaatggcaacaccaagtcaaaaacacattccagaatatttaagacatgcttattgaagtagaatccccttaaaaatcacaattcaaatctgatagttagaagtacagaaaattatttgtcgtaaaaaagctggtactgagattaagaagggaccaacatcccctactaattgtagctaagaattttgatgtaaataatactactgcataaaaataggagatcagtttctcctaatttgcaactttcttccagtaggaccgatataaggcccatgtggcacatgatggtagagaccaacaccaaatgcattgtacatatatactggtggctatgtggatgttgttggaatatcatctcttgaactagaactaataggctgggaattgctcctcttcttcctcctagttatttgtgttttacactgagagaaacagacaacaaattgtgagaagtagcaaagtacaatgtctttatatgataaattagtagtgtactcacattttgagatgaagaactttggttgtcttttccatgctttctgctgttatgaccaaactctttgcagacgctacatctaattgttgtctttgcaaccgaccttccttgaaccctaggttcatcagatgctctagttctctttgtttttggcctccctggttgtgtcctagccacaggtgggtctacatctggaaatggagttttttcccattgtgtctcatcaggaacgggataaatcatcccacaatatgttctcgcatatgcatcctttgtcaatatgtcatcaacatagctctctggcctttgcatgaagggtaccgagctcgaatagctgaaacagcatgcaaacatgggattccagttaaatcccattttctacacccacaagtgtgcttgttcaaatccactacatattgattaccaaatggggacacttgccaaatgcccctaccagcacacacagatttgcaatatcttgcctcgttcttctctgcctcaagcttctttaatatatttggtgggatttgccaattgtccctttctgcaccttccctcttattattgaaatcacccttcatttttgtccttatgtgctcaaccatggtaattatgggttcatctctagctcccagtatctttgaattgtatgtttcacttatgttgttaagaagaagatctgtctttgctctagaactgaacatatatctacaccaatgcttagttggaaccttgcttagccactcccatgccctcaaattgttagcctttagttattgcatagcagcattgaactcagattgtctatatgcatatgctgctcgttccatcaaacccttcagatattcccctctaaatcctgcttgggaaaaattggcatgtaggtgcctaaggcagtaacggtgctcagctcctgggaaaacttcagccactgccttgagtagtccctatatatggcagcaaaatgttaaaaaaacagttgacatgtattaatgcaaagtagacatatatgatagctattaccttttgtctatctgacatgaatacccagcccccaaactcttctccttttccaatggccttctccaaacatagtaagaaccatgtccaagattctgtgcactcagactccactaccgcaaaggcaatagggaaaagattattgttggcatccctaccttgtgctgctagtatttgagaaccattgttgagtttgatgtgacatccatctataccgatgaagggtctgcaaccacctaagaagccagtaatttgagcatcaaatgacaagaacaacctttgaaacctaggccttatttctggctcaggtgatacttcgcacttaacaaaaactttgcttcccggattagcagatagcacagcatgagcataatcttgaattcttttaaactgcaaatcatgatctcccataactttcttgtaggcctccctccttgccctatacgccttacttatgctgacttctacattggtatctcgcctgacacaatcttgaaaggcatgtgcatcccatttcttgtcagatctaaagaattccatgtattcattagtaagccatctccagtcaagctgtgctatattgtgtgatttcccacagctatgttttgaaacatacttctttattttaaaggtgtcttcaccaggcaattttgaagcatatatgtaccaaggacagttatctgccttacacttgacagaaacttgattcctatcattcttgcccttgaacacctccctccccatgttgatgatcatattcttcaaagcagctctaaaaagatcaacattactgaacaacatgccaacttgcatgtgtggacgccgtagggtggactcataaaaaattatatcttcaattcctcttgatctgtgcacatagataggtgcttcgtcattgaaatctattgtgtcatcattgggctcatctgacaaataatccacctcagctgattggcctatatccttctcttttctcttgttagtttttttccctactagttctttttcctgtgtagtttttccccgatgtggttctgcttggttaacctctacatctacctggttagtaccatataggtcctcagtatcagagtctccttggaagaacattactggctccttgccaataacaggttccttgccttttttcttttccctcaactgttgctgtacatactcttcatgcaatatcaaatcatctttatcaaaatcacctgggacactattatgatgtccaattaatgggatactacttgggcttacaaaccttgatgtgcttccattatcagtcaccaattcccgaggccttgcaaaaaagtacagtgagcactctgtttccgtcttatgatcatccaacatcatcttgatttgttcatcatttagaatctgtacaagaccttgtggagggacataagaaggcttcaagtagtatacaccatctcctttttgatatccatgtataagcaatgactcctccaaatcgataaatttcagagaatccctgtctaaaagataaatcgatgaacaaatcctttccccaccagatttcctagagcttccaccagttgtacaaccagtatgaacaatgaaggaaatactagttcgacccatctgcagagattataccaatttattggtttgcaacctaaatcaaagagcaaatattcgatgatctgaatctagtaagacaactacatgcataaaacatgatctaaccaaaaccagggagaaaaaacgaacctgtagaatgaattgacgaggtgatcgaagtacaggctgctttagtgcttccttctatgacttctcttgccgggcaggagatttgatatcccttctctgtactatgcgatcatcgtcgtacttcgccgttgtaccgctgttctttcgccgccttagtgttgcagtagagatcgcgaaattaaagcagggaaagatggaaagtggaaggaggtgcgcgcgcttttgctgccaaggtggcacaaggcaactctacccgtgggcggcgctgaaggcccacgataacgagaaattgagcgcatcacgagaaagcgtgaaaaccgaataggggtgggaaattggaagagaaattaacttatgtgtagtgttttgaacaatattgagttgtaggggggatagtacaaagagcagtgacttgtaggggggtatttggattttcccctatatatttcggttcatctaataccagcataaatgaggcttttccttgttctcctgaccccttaaatggatgtaaaactaaaaaccagcacctatatataacactttcaagttgaattataaaaaaaaaccaactataataataaaagtgctatgttttaataaaccagcatctatataagcgttggtttaaaagaaactaacacttaaatggagccaagatgagtcgagtgcgtggagtgtggaagaaaaaaataattctttgttggtcttatccttatcctcccagagtattctcattcttatcatctccatctcacttgatccccccggcacggcgaggcctccttgatctcccaggtgcagcggtgtccgtgtcttcttccgctgcttcttcctctcccctgcatggcgaccatcgaatcaggctaatgggagctcgtccttactctcccagtcaatcttccctctgtcaatcttccctctcttctctagtgaggtagaggaggaggcacgggtgcctctggtggtaatgacagcttgtgctgaaggattgggcggcgacggcggcttgaacaggcaggatctagcggtggcgggggttctcacgtgtggatatggcggcaacgacaactctattagattaaatgggccaagcataatttaattctaataaattccatgccgcttaattaatgttaagggaataataccaccttagtaatcaacatggagggatctcaactaaaataggctgctatccgagggtaactgttgagcgcttgatctggtggtgggactgccacatgtgcacgcatgcgccgagccgagctgagccgtgggcgagggtgaggtgtaagggacgggacgagacaggacgggatggattcctctgtcgatgttatgatgagggagttaggtcccgatcttccgatagatattgataaacagtcgatttgggcgaagtcacgacacaactcgatccggcttttgaacgaacacgctactgagccctacaatcgcggcaccacgtctcctctggttatcaaccgtaccaaaacccggttgaactcaccaagaaggctaatcgctgcatgcgaatcgaagaacacaagcaagaacaagatagattgcaaccaaattgcatatgaatgattaagcactcgaatttggggttccacaaaccgatctagcggcgaaactgttcttgacagaataatctatgcaaaacccaactctaaatgatgatggctacaagtatgattagggacgtcctagggttgccctagggcgcacacccccatgggctaagcccacgacacaattaaaaggcccaaaaccgaaatcagattcggactggatgaaatacgtggcttgttttgcagatttccggcagctcggtaggaattttcatgtgggaccaaaaccatctgaaagtagactccataagctttccatcaagtactcatgggccccaaaattccttctagatcagcggctaggtcggtttgaagttgatgctgtcaggaggcccgaatccgaatccaaaacgtgtagaactttatctcttatcttctatggaccaaaagtgacgtggtgagatggaagtggacttggagaaggtcttggtttggtccccaatcaacttcttcaatcatccatgcattccttacgcttggtctcttttctttcgcccaagcaagtacctctgcgaacgaaaacacacgaaactcattgtgtagcaacgtttgttcaaatatataacaagtaaatctaatatagaatatatgcacctttggttgattaatacgcaaggtagtcatggttatattcgagctagttgtgtcctcatcattctccccttcttgatttgaaaccgtcctcagttttaccttgtcatagagcgtattgaacttatcattatctgtctcaacatccggtgaggaacatttttcgatggccatatggttggatcctgaaatcttggtagtcgaaaaaccaccacactccccttcttgcagactaacatgtaactcatttaaacagctagaggaactagatagagaattacttatacgcatgtggtcctctagacaacacatttcatcatcaaaaggaggtatagtcaaattcgaacaaatatatactcgatgcacattatattctcctttactatcataattgccaataatatgaaaaatcacatcagaagggcatggcagttgagtggacaaagataatcaaattaaatataaccccaagtatttaaagaagatagcaatttaagctcttcattctcgctagcaatgtgaataacatgtttaaaatcaacacatggtggctctactatagaactaacatattcattcactagttgtggtatggatataagtgaagcatcgcacaactcttctttatcacaagaaacatgaaacaaattgttttgtgacaaaggtatttcaacaattgtttccactatgggttgctctaatgtagcataagtagtggacatagttggcacattataactatgcataccttgagcagttgtagcaccgttatctttaccatttttctcatcttcagaaattgtaggcgcttggtcaattaaacattcctcaagcatgcatgaagctatggataggtttttttcctcctcatctttcttctcttcctcattaccttggtttttctcagatgcttgcaaaatattagtattcaaagcaataggcacaacaatacgttggtttggtaataactcatacttagttaaaggcatcgcaatattagtatcattccaaatatctctgaaagtctcattgattctattcttcaacctttcaagatcatctttgaaaagtttagaaacactcattggtactaattttatttttcgaccattatgcctaaatgtgtatgtattggcaatatcattatgcaaaacattattatcatatatccatggttgacgaaacaacaaagaacatccttgcataggtacaagatcaaaatttgcaatatcatggtaacttccaatcgaaaattttattctcacagttctatttaccttgaacttaccacacgagttgaaccatttgatgtaatatggatgaggatgcagttgtatagacaactcaagttcctcaaccaaatctgaactcacaaaattattgcaactctcactatcgattataacacgacatgctctatccttaaccacaaacattgtttcaaataattcgtgatactgcctttgctccgctttctccatttgagaacttagcatttgttgcaccaaagtactttcatcacgtgcatctgcggaaggtgatgtagcagctatggtttgtctcccatccaactttatctcatgtccataagagatgtaacatgccattgtcagtagaaaaaagagaacaacataacattattgttcctattaactatagaacatggattgtagtggaggctagcaaatggaagcgtcttaccgagctcttacaagtgtcttaccagcaatgctaaggacagtacaaccggtggcaggttagtgacaccttgaaggacgtgatgtggcgattgcaaggatcaaagcggtgctgaccagaagaatatatgtggagcttgggaggcacaatatatagtagaaaaggaacgcaattgtgctaataagaaaatgcaaagttgaataatagttcaaagtactagtcaatgtgctggcctagcctagactcaactctagctcaagcaagcacccgacaacactaaggactagatatgaatcaatgcacaactctgcactctgaaaacatactcaaaggatgaatgattttttttctttcttggtgcaactttttttaagcacctttctgcctttttttcttttctttaggtgcggatttttctttctttttctttgcacctttctgcctttttttctttttttttattttttactattttttttcaacaagcactaacaactgacctcaaacagggactcaaatgtaaatatgaatattatagggactcaaacgcaaagtgaaaaactaaaattggatcacctcaaaaatggaatgctcatgtcacgtaggttctgtttttataaaaatatctctattctacaaccaccaaaatacccaacaatgtggtgaccgaggaggaggcagggaagaaaccgtgaagaggaggtggggtggttggccgtgaagtggaggtgttcggccaaagaggaattcggcagaagcactggcaaaccctagccgcaactccaaactcgaccgacaaaaacttctgaaaattacaaaaacggaatctcgacgacgaaacgattcaatatttcaaggtcccggcatcaactgacgacatacaaaactggtcccaaactgacggataactcacacgggcttgagtgatgaaccctagacctaagtgaagaacatatgcaatactcaaaagtagaaattaaatctaaaaactaaaccagcacacgacacgacgatgcaatctagaattcaacaaagcaaaatctaatagaacaatgcaactgctcaaattgtctaggtaaagaataactatttttgtgtgacaattttctggttatgggaagataaattacctaacgggcaacaacgctctgataccaactgatgagggtgttaggccccgatcttccgataggtattgataaacaaacgatttgggcggagtcgcgacacaacttgatccggcttctgaacgaacacgctactgagccctgcaatcgcagcaccacgtctcctctggttatcaaccatgccaaaacctggttgacctcgttgagaaggctaatccctgcatgcgaatcaaagaacacaagcaaagaacaagatagattgcaaccaaattgcatacaaatgattaagcactcgaatttggggttccacaaaccgatctagtggcgaaactgttcttgacagaataatctaagcaaaacccaactctaaacgatgacggctactgattaagtatgattagggatgtcctagggtttccctagggcgcacacccccatgggctaagcccacaacacaattaaaaggcccaaaaccgaaatcagattcggactggatgagatacgtggcttgttttgcagatttctggcagctcggtaggaattttgacgtgggaccaaaaccatctgaaaatagactccataagctttccatcaagtactatgggccccaaaatttcttctagatcaggggctaggtcggtttgaagttgatgctgtcaggaggcccgaatccgaatccaaaacgtgtagaactttatctcttatcttctatggaccaaaagtgacgtggtgagatggaagtggacttggagaaggtcttggtttggtccccaatcaacttcttcaatcatccatgcattccttacgcttggtctcttttctttcgcccaagcaagtacctctgcgaacgaaaacacacgaaactcattgtgtagcaacgtttgttcaaatatataataagtaaatctaatatagaacatatgcacctttggttgattaatacataagatagtcatggtgatatccgagctagttgtgtcctcatcacgttacgatttgctttgatgaacaacaacgtaatctggtttctcgggaaaggtctctgttcttctgttcctgagttgcgcatttgtttccccggtgttcttgagttgtgcatttttttcctcagctccgagcatatatgcatacatgtacacaggatgagcaggcctctagaactccgtctgcttgagtacatgtataggtaggcagtcgatcaagtttttgggagcacgttctccgcatgactgctcgcggtactgcatcttgttcaccaaggtattctcctctacatcacgatgtctaccaccagcgctggcgctactggaggaggagggaacattagtactggaggaggcgaaactgagaacatcaacatcaacagaggcaataccaatgcctcatcatcctctgcagcttcactggtactagaggaggcgaaaccgagaatgtcaacatcaacggaggcaataccaatgcctcatcatcctctagagcttcactgcgtatttcactaccctcatcttagtgctaaacatattttcagatgctttgttccagctagcatattcatgtttatcaccatactaggatctagtgtttatgtcatatttattatactaatttctagattgtaatatgttgaattatgactagatttccgaaagactcgtgtggccaaattagttggcgcctggtgagctattgcggcggcagagttccccacagctgtggaggcatgaagttttgattgttgtattatgtgagtgacttcgtgatttgtttccttgcactggttgattcacatatatgctattgattgtaggatattcagttctgtgattgattatatgcttttgttcttgttcttgtgctttcactactaaaaaaacgttcactggtggccaaaatagcttgtcactggcagccgactgtaccgccagtaaccaaaggccagtgaaaataaattcatttgtgctgacggtacagccggccgctagcagccacgcaaagacagccgctagcgaaaatcgattttcgctggcagccaagctaagacgaccaccagcaaaaataggattttgttggcggcaatgttaagatacccgctagtgaaaatattttcttggagaaaaaataattccaatcacaaatccccaatccccaatccccaatcacaaatcacaaatcacaaatcacaaatccccaatccccaatcgccggttgctgtcgtcgagctgcgacggcaaaggagggagctcgctgcagatgtcgctgtggctgccgcggttgcaattgtcaccgtccgcggagccgcagttgcctcccgccgagccacggtcgtcaggtggccccgaactgctgcatcgtcgggagaggggagggggttggaggatcaatcgccgcggctgaatccgctgcccgcgccgctcccgcagccatctggcggccggtcgaccatcgccgcggccgaatccgccatccgcacgcttccctccaccgcccgcgcttgtcccgtgactgaatccgccggctggatccgctgcccgcgcaagccgcatcggctccacggggatggctcgacgaggaaaggggccatccaccgtcgccatcatcgtccctgccttggccgccgagaggaggaggagaggtgcggccgtgggggtcaaggacaggaggagggcacaggggagagggattggggtgaggaggtgaggcgcagggagagaggggttgaggaggaggagtcgaggaaatggggagatgggggaacgggaaaaggtgtgagtgaagttttaatgtagtgaaataaatatttgttggcagtggccattagcagccacgagcgaaaatcatattttcgttggcagtaagttaagaggtccacttgtaaaaatacctctatttttgcaagcggatctcttgagtgaccgccaacgaaaattgattttgctggcggttggtaaccggaatccattttcataagcgcattttcataaaacccgtcggtaaaaatgaaacggtgatgctatgaaaaatgatttttttagtatgtttcgttctggatgtggaagatgaatgtttggttgtagagatactccaagaaatgccattgacaagcgtccaagtcccagaaatgccatcgataagtgtaagttccaagaaataccatcgtacaaacgattttgtcccaaaaatgctatcgtcgttagggttctgtccattttgcgtcgttaaatacactgttcatcctatagaacttaatggcgcgaaatagacggaaccctaacggcgatggcattttttggacaaagtcgtttgtacgatagcatttctgggatttagacacttgtcaatggtattttttggattatctcttgattataggatttttcaatttatttttagtggatttgatgcatggagcctgctttttttttcaaatagtacgaaccagatgccttggttcttaaaccggcaccgttagacctcttatcagtcgcctgacaggtgctagttgtgaatccgacaccaaacatcgatttctatccggtatctaagtgggtttgtgtacaatagtgcaggctgaccaaaagctccccagcagttgaggtttttcgagtatttgtttcactagagtatttttccatgtttccagggtacacttaatcgttcagtgggaacagtatgtttcccgcatatcagaggcttttagtcctacaagtctagatagcgtatgtatccatggttgtaaaaaaaaaagaaaaaaaagaaagaagaagcttcagaatcgatcccactattgaggaaaaatacaataatattattttctatatcaagtaaacccgtgcatattaccattacatgcaacacagacaaaatgcattcagaaatacgtctcattgcaaagaaaactatagaatgttaacatccaaatttaacatctaagcacgaaataggaaatcattcgaatttggaaaggactgagttttcttcttggtgatagtcagaccgaagcctatgggctagtctgactagctggtggtgtgcagtggggctggtcggacagactgtatgtagctggtcagactagctaagttcggttccaagtcgaatttcatcaggtctagagttttcttgcctgcactgaggtttttcgagttctacttgatctctaccacaagtaaaacatggagaagaccatgcagaacagcagaaagcaagactaacccctttgtaagagctatgaccggtataatcgagcacacattctacttccaacttagccaattgaattattttttcaatattgtatatttttcttttgctagttctagtctagattttgtggccataaaagttgccaacacttaattacttaactagtggccatattacaacacgaaaggataaactatcatgatccatcacaaaatattgcactagtacagaaaccccctataggtgccggttgggaaccggcaataggtgccggtttcctcgccggcaccaattggtcggtaccaataacactaggttattggtgtctgtcatataaccggcacctttgtgctctccccgattaaaaaaaaaaagaggaaacctactcctagccgagccgatgctttaagtctcacagatcacaaatcaaatccatcacagatcatcatcaacaacaataaagctttcacagtctcatatatcacaactcatcatcagcaacagcaataataatccctaatccaatccatcatcaattatagatgaacaacaatccatcaaccaatcacagatgaacagcaatcactgatgaaagaactacacaattaatcaaagatgcacgaaatcactctcgctggttcttggttgtcgttgttgggatacgcgtaggctacgatagcataaatcaaaattttctatcgcgtaaaccaggaaccatgcaagtattagatcatagatcattaccactcgacgcgctgtgcagcggaagaagacgccgagaagtcgaaggaactctcgcgaagtagcgcgcgtcgatgtagaggaagtagtcgatcgcaccggctcgaccttctcctcctcgtgcgttctcctcgccgtactctcacgccgatcagctccgcaaaccagcggcacctctaccggtatccacacgtacagggacggaacgccacgcacagatgtgctagcactcgcgcgcggctagagtttagctcggggagggaagtgacggctagggtttctcacgtggtgcaatacctccgccggtcacacccctcacgaatatataggatccatcactcgggcctccaaggcccgtaggactcctattcggatccttatccgaattaagctcatattggatctctatccaatccccttattccggcccattaagcgtgcgaccctataggttcatatatactcggctgtaacccgaaaactccttttcggtccacgcgtcaacagcggcccctagcagaacgtattgacccaccgggcatacataaagatcatatcggctgaacctctagtgcatatttgtatgaacccctttgcctcacgatatcgattaagctcaaggctagatatgtgtcatcctctaatagctcaatcatttactcgaatctgttgatagattatataacttgtgattgactcctaaatcacctttggcatggccatgcacttccataatctacaacatcgaggggcccagagatatctctccataggaggggtaaatcacatcttgattattcatatcccactacatgtttcatagcatacccgaaaactacttttataattacccaattacggagtagcgtttagtagtccctaagtaagctactacacatgttgagagccatgataatctcaggtctaaggattcaacaccaacactcaatgagatcactgatgacacaacacatatggctcttgcagtgtctcatgttgggtctatccaacaacatgttcaccaacatgtgtccatattattaatttggtatctctataccatgatccatgagacatgatcatcaattaatacatgtgctgatcatataaacatatttgttccacatatgatatttgatcagggatcctttagaaatagtaacaaacaacataaagagtctcatgaaagaatcacatattcattaaccaataaggagctatctatttcaaggaacaatgtcggataaatatgtaaacatagtatgtgatataatcatctctatgattgcctctagagcatatcactaacagtcgtcaatcagccggggtccctctccacgcgaggtcgccgccggccgctaggtctctctccatgtgccgctggtgggaggccaacgaagatgaagaatcgcccgtgggccctccccgcgcgaggtcgctgctggccgctatgtccctctccgcatgccgccggtgccaggctgatggagagggagaatcgctcgtgagccctctcctcgcaaggtcgatgccagccgccgggtccctctccacgcgccacccatggggaggccgccgattgcgcgtggcggaggggaagagggaggggagggtggcggaggaggcaaggggggagggggcggaggggaggcggaggggaggcagagtaggtagaggagggtgcagcagaggagggggcccgaggtgaggcggaggggaggcagaggggtagaggagggtgcagcgagggggagggcgctgcgacagagtaggagcgagctagggatggcaatttcccccgtggggccggggacccgcaagggatccgcccctacgggggcggggacgggtggaattttcaacccgcgaggagtcggggttggggccccggccataggcggggatgggggcgggggaggacaaccacccacgggtgacccgcggagccccgagggtgtatattagactattgatactaccatattgcaagcccaaaaagcccatctaacctatcatatataaaccaaaccctaatatttccaccaccatctacccatcctcttttcctcaccacccatttacccagccgtcactctccagtttcctccaccaccagcgcttcctccggcggccaggctcgggcgatggcgtcggctgccaggcgcgagcggcggcggcggtggccaggctctggcgacggcatccaggctcgagcggcgacggccaggcgcgggcggcggcggcggccaaggcgcgtgcgacggcatcggcggccaggctccggcgacggcgtccaggctagagcggcggcggccaggcgcgggcggcggcgtcgccggccatagcgcgggcggcggcggctgccaagcgccgtcatctgcgtcggcgttgatggccatggagcttgtagcggcgggagtggcgacggcaaggggcgcggccaaccgcgtcggcgtcggcgtcgacgtcaagggcaagcatgtgcagcggcggcgccggcattcctcatctcgcgaccacctcgtcgccgtctgccatgggtggtgcgggaccccgctcacccgcgggtcccctacgggggcgaggacgggtgatgtttcccacccgaccacctctacgggaccggggccggtgggagaagtcggggagtagggcggggacgttctagcccaacccgcccccaacccgccccgttgccaaccctatggcgagcgctgcgcgtgtaaataagggccaaatgggatcgacgcgagtggataaggttggtggagatcgcgctagtggatctgtggaaataggcggccggctcggccggctcggctcgctcgtgtcggttcagtttggtaggcactggttgtttaaagaaccagcacctgtaatatattaataggtgtaagttcttttaaaaaaccagtacatatagtattggtaccggttttaacaaataaaccggcacctttaattattaattattaaaggtgtcggttctttatattttcatcatgcgaggtgcaaaatgcctataagtgtcggttttaaatgaaccgacacccataagatcgacccctatgagggttttttagtagtgttgatccaaacatgatggatgtcataaaacctgtctggaaatataggatcaataatgtgtcaataatgtaggcattaataaagtgtcaataatgatgtacgttgtaacgggaagaaaaaaacaagaatgtggagagacagacccttattcgaacaaaaaagaagaacgaggatatatacaagagagtggtcatatacggccgagtgagacggcgacagcacgctagatcgatcctagcttagccaaggagagcgagaaggggagagtaatgcgacgaaggaattaaacatgcggaataatagtcctaaattatatcacggttagtcaggaaatgatcatagaggaaacataacattgaatttgtcttgaacttttcattggtcagcaaataatttcaagtcataataaaattttctaactgaacttttcattggtttcatttagtaaaaaataattttaaatctggaagcaacattttatcattttccctgcaattataaatcgtcaggacagatggaagtagctcattctgtaaatagaaaaaacattcaatcagatctacaaaactaatctatctatttatctatctatacctatattaattgaacactttgcagaaatccccacgttagccaaaaatatctagccattgactaataaatgatattatcgtcaccatagattgtaaaatccattcctgttttactttgtgagccacgtgtaaaccaatcttaaaaacaccacgtcacaaaggagctgattttttttttagaactacaaaggatctgatataagagagtgtggatacgcgagacgcaagataaattatttgtattgctgtcgatcattaggaacatgattagatatgtttaattcacaacacaagaagagacgaagaaaatcagcaaagcatgcaacaccttgcagcaagacgattagttcttctggcacgccgttcacgtttatggaaagcacagcgatcgatcagcaatggtgttcagaatgacgttcacgaagcggcatatatacgcccgatgctcacatcaagtcacgctcgacgccgatgtcgccgagtcggctcggtcgtcttccgccgcgctgccatgtccgtgccagcgccgacgtacgccgaccgcacggacatatgtccatgcaggctgccgctgcaggcagatgcatattctttttcatcgtgagtaatttctctgtatcaccgttgaggcagatattattaataatattaatataatcattagttgtaaggttgatgttaattgatattattagactttgatccttgatgtcatttgtcacaaaaagtaataggttaactttgtgccatcatatatcacaaattaatttgtgcatgcttcatcgaaattgagttgaacaacttttttgtttagaaagtacatgattcctctaacaaatataatttagcaatctaatttgaacacttttcttttatcaaagttgatgtttaaacatggcgaaaagttattatttataatccaaaaataatatatgagagtttatgtcaaataaaccatgtcatcgaaaaaaatatcatactaaatttttctaaaatttactaattactaaatacataattaatacaaattgataaaaaaagttatatccaacttggactctccattaagtattttattaattaggaattagtaactttggtgaaaaactagaattagtaattaatccgtaagttattagtcatacaagctcttctttcaatttgagccattgtaattttaatctttgtaatgtatcgataagttgcatgggttgacggccattaaacataattcagcgcacaaactagtgagcggcatatgcatggcccacttaagctcttgggcccattcgagtggcccaggcagatgcccccagctcctgtccttttctgccactacgataaagccattcttatactctccctttaatttcacaaatcgactataagaaaaactatatgtaaaaggttttgggttgttcggtgaagaccaaggatttaaatctctggttaagaaatactacctccatattttaatgtatgacgccgttgacttttcatcacgtttgaccattcgtcttattcaaaaaatttatgtaattatcatttattttaccgtgacttgattcatcatcaaatattctttaagaatgacataaatattttcatattttcacagaaattttaaataaaacgaatggtcaaacgttggtcatacattaaaaatacggagggagtaccacttttgccgctacataatctactacgctaatagctgggcttagctggagattcggccttcagttacaggtagcaaaaacttttgttctgggctgaaattagctacgggccaaggcccatctacttctcctgtaacgcttgttcgccagcgcccacgcttttcccacacgcgtttgagcgcaagccgtccgggtggggcccacctgccagccggagcgagaggccgatgcccgtgctcccaatcgacccgcgccctttgctcgcgcatgcacgcgcacgcgccgtcttgggccgtcgccacttggaccacgcgggcctgccaagccgagccaaccaccatcttgggccacgtgcaaaggctcgattggctcggcctccctgccaaccaatcacagcacacgtgcacccttgggccagctaggcctgccctggcatccctgccagcctagcacgtgccacgcagcacacgtgcacgatggcttacgacagtacacacgactgctgtagcaaccatgcaattcctccaattttcgtcgcgaaatccggcacttgcacatccgaccatgtgaaaccgttgcgaagatctctccagaccgtgtcagtctaccgtgtgccaccctgtatccaatcttgttacttggtttcctttatcgttctggatctcaactacttcccgagtctagtcccgatccgctgttgacctaggttgaccacgaaggatcctgacgttagtcccaccttgtcatatggcttcttgaccgtgccggacctctgctgctccttgagcatggcctcggtcctcgctattgactaaggctgacttcaatcaaactgcatgcatgtaaacaaacaaccaatgtcttggcacagatattgcaacttgacccacaaaaatcagttaatgcacactcctacatttccggcactgcactagccaattttccatcacacgtgaatcaaacccacacatggtttcacagttcgagtatacacaagattgaacttgtgttcatttgtacacgattgaacttgtgttcatttgtatattggatcttttccaaaatctcatagcaccggagcggcagatttatttatgatcaattaggtgttagctaaaaaaacttgaaaaagtgaattaatatgatttctaagcaacattcatatagaaattttgaagaaaagaaacactgcttagctgtttaaaaactatgtgcgtgaaaaaaaaagagaacggaagttaggaaagtgtactaccaaaccctaggtatggtcattagatggtggtccgccatcctgagacttaaaaagaaattctgggtcccactgctatgagattgattccaacgttaggggtgacaaaccctagcttaaaaagtaattgtacaacgatataaacaatgaaatacgcaataactccatgtcatctagaaattggcaacaaaactgaccaattgagacacgattagagagaaaaagagagggagagagatcaggatattattacaagtagttacgaacaatatgagactattttctgccctcgagagcaatacactttatttgttgcctgtgatcaaagtagtctttttttttcctcaaaaaaggaaggtgaaaaatccaggcgctgctatgggaaagtttttttaagttagatttgtagtttcactccatttccatgctttattaaattcacacctatcatcaatttcaaatgtttaaaataattgagaaggtgtggcttcatgggagacaagagacacattgaatcgcatatcaatcatataaatgctaaaatatttttgatgatatagcttcatcagaggaaaacatacaatttgcctcattgatcaatcatcaatagctagaagtaattagtgtgatatggattcataagaatagaaagaaatataattacttagtgggaggcaacttaactatataatgttttgaaataatcagacaatatacatttttctccatatatacctccaaaagttaaaaaaaaagagaatatttgaccatacagtctacataagaactatatgggaatgggattgacaaagagactcctaacaatctcttgtagatgtgtggagaatgtgtatgcatcctttctcttgtcataaaagaacattatggaaatagccatgttcagaactctttgcactaccgggagtagctggtggtgttcatagcgagcgtggttcatggttctccattcatcttctatcagtgaatcgagcttggcaaaggcaacctcacttatgaccttgtgctcattcatgtagcactcaacagtgctcaccatatcgcctttgttcttcccacactatatgaatgtcaaagataaattgcaatatctcatcctccactctagtttagcagttgtacaagatataaagagttgtatcatctctttttgaaggaatcatgtacaattgcgtatagttaaatgttgataacaatgtttttagtgtactagtgtgatttttttatgatttctctatatgatgagttggacaaatattgtgatcacttaggaacaatgtcattgtgggcattgaaaatgttacatttaataagaaaatgattagttaattagattgtaccttaaaagaggcaatgtcattcatgaaacgtaatatctttgcacatgatgtcacggtactactgcttgctgcccactggaatgcttcacttgatattgcgtcaccccggccaaccgtcgtagacacacataacaattgcaccgtcgaagtctttgtagacaaagccacctgctcttcaaagcttggcttgtaattattatgtgaccattcagcttcctggagaaaataatgggacagcttttggaactgcacccaagcaaaaggaaattaattaccacaaaattagcaatacatggcaatattgttgttctgatgggccactcacaaacgcttgcacatctaacacacactcaaagatgctaagaccagcggcaactctctagcctcacaaaatcatattgaaagtgcagtcgattatccataatatttgtgggcataaggacctctagttggtgaagtcatacacacacatcttcaccatcacaccaccaatacatcccacctccattttttgcttgacttcatagaattcgtgatgtcaactaacgttgatcattatttaaaaaagagtaaatttcacagaactacatgttttgtagtccaagttgcagaaaaccacacacactttgacacttggtacttaagtacatatgttttggtagctgtagtttca

SEQ ID NO: 70808 - DNA, 38209 bp, Oryza sativa
tcacacgaaattaataggatgccacgtcctcatcctagatggaacaaccatgtcatctcacgggtaaatccattcatcgatagtgtggttttgtgaaactaaactaccaaaacatatgtacttaagtgccaagtgtcaaaatgtgtgtggttttctgcaacttgaaccataaaacatgtagttttgtgaaatttattctttaaaaaaaggctaatatgaaaaatataccattatattgtttgctatgaaactcatagtgtgaagtttatcatcatatatttattaagttatgaaaaataatagtcaaatttgaagatcaaagttggctgaaagtcaaagaaacaaataagaaagcaatcccaatatagacagatcaaaaatatatatcattgctgtacctctttcttagcataagcaacccggtacttgtcgttgattgccacttgatcctcaaactctttgaagttattcaacaattcattgtagaacttttttaggtactcaggcaggagaaatagtgcactctcatcccatctgcaaggcacacaaattgttaatatcaatcaaaattagtcgggcaagcatatataaattagtttaacaaatactaatacaaagaaaaaacctttgtatggcttcatttagcttccgacattcttggatggtggcatgggaatcatatgtgtcatccattataaccatcaatacaattatcttggtaaaaattatccgtgtgagtgctaatccttcctcgtagaacaacatttgggaccatgtgtagctctccaccaaacgatccctaagataacttagccccacatatccagtaaggtctttccaccacctaaaataaaagcacttaattaggtacaagcctagatagtatgtttaagattattattagcattgcacataccaattctggtaggatcaatatggacaatacacctttgtcagacatgtatgttcaacacattgtttacatataaattatatgtatagtgtattaagctttaataagattgagatgaatacatactactgcaatacttattttctacttggtgggtatatatcaaagagattccatactcagaaatagctttgagctccttcaagtggaccccttgcaaaatattaaaatccacctttgcaagatccaaaagaaacgaaatatgcccttcctcttgtccatactccgaaagataatgcaatgtttccactcttttgtatgtcctcggtagtggtaagtgaagggcacgcttgacttggtcagctaaagggtgtttgaggttaccacactgcatcattgattttagatggtgcctagaaaaagagatggcctcttcgagttctggttcatcgtgaacgaggaggtaagctgcattatataaacttaataaactgcttggttcatcagctatttaattgatgaacctcccatcatcatccttgaatatgttgaatgtagctgcaagataaaatatgtaatttgagactaattgattcattttagacttgtctgtgcaactaggtgactagccttctcttataacggaccagaaatttcttttgataaccacttatgactctttaatttgttgacaatagaaaatccaaacgtatatagattttccgtgtgtcatcagtaatgtagaataaaaaaaatttaagttgttgctgaagctgtatagaattttcccaacctacaattattaaatccaattcatattttgttaccaaatggctagctagtgatgagtatgcgagttatgtcagtattacttcagtccactctatagaccgatagatacctggagatacccataggccatgctccctgagcaagcgaaatcgaagagcaacctcgtaaaggctagagctagtaaattcacttgcatggatatcacttagtgtggtgcttatctcttcattgaacaggtgaccaactcctagatgttggattgaatccactaacttcatccttgcaacaacgtcacccgaagtccgaaacagtgtgcgaaccttctctctaagattatcagccctctgcctcatccattcctccgatctctgcaggctttcgattgttagcaccaaccaaatgaagcaatattagataataatgataatttgtcaaaacgcaatgcaaagcatatttcgggtggtcctcaatccaaaccaatccattttaaactaaaatctcaactcacacatttggatgggtcaagatttcatccggtttctaaccgatcgacttccttaataataatatatagagcatgcgtaagatgttaagataaattcataaaccagacagtaatagcaatataacaattatgtgtatacatgcctgaagtggttgtggtgtgtaggtgatgaagaaatccccccagactgagggcttatgattagaaacaccagattgagggctcaagcatggtgcaaggctagtggtagatctgctgcccgtgctggaaaacatttgcacgtgtactgtgtacttgggctcgatagaatgtttcaagctcagacctcagatgctagtgagcaccgtacccagccctttatataggagtagtacccccctaccaaatactacttgtcaagtggggattagtcatatttaaattctgatatgaccattagtttgactatgaatttataaatatctaaagaaagtaagcattttttaaaatacttaaatatttaaaagtttttaatgtgaattaagaaagcaggtagaattgaatggtaaaatgttatgatcggttaagaaaataaattaggtagaacaattaaacgggagatggttacgattggttgagataaaaggttagatgaaaaatagctaaattttaatataaatttgaactctacaaatagctatattttaggacagataaagtatattactatatattaaacatgaccgtacaatttctgttcagccaagtaaatacgataagagtaaatttcacaaaactacgggtattttgaccaaattatcacaaaactacagatttaaggagttgtatcataaaactacatatttagcaccaaatttatcacaaaactacagattttagattaagtatcataaaaatgcatatttaatattgaacttatcacaaaactataacttttgaagtttaaatccctagcaccattgttatcgtggagctataaacatcattactttgtgattaaattgattctaaacctatagttttgtgataatttagttagtaaatacgtagttttgtgacacttcatctttaacgtgtagttttgtgataaatttggtgttaaatgtgtagttttgtgatacaccgagttaaatctgtagttttgtgataatttggttatagtatctgtagttttgtgaaatttactcacacgataaataattttaaattattgacgatcaaaattaagttaacactaataaatgatgaccaaaaatactactttattacatttgtttacttttgggtttggacgttatatcttcgtattataaaactatatatacctgcatttgtttatcattggcctgtgtttttacatattacactaaattaaattgatgaatgattaaaagtcaactgtgtcgtacactatctctacatctttagaaatccagtcatcctccttccttccctaccatgcgcagcgcccgtgaaaatcaaaccggcccgcacctcccacaccatatttcttctgatcccgtcgcaaatgcacggtacagtaatataaaaaatggataacagattttttaaaaaaaggagggagtagaaacggaaggagtactaccatatatatctttcaaaaacgctgtatatatatattgcatttggtccaaatccctgaagccaatggtcagtcacgtgcatccagtggggagactatcgccagtgaggcggctgctatgccttcctctgtttcgttccagacatcgacgggaatgacggaaagggtgaaaaagtcatctgcctcggagcggatctcagccgttggatctaaaacggacgcgtccgatttaccgcttgccttttggaatggttccaggaagatggaacagaatctatctcacaccagtaatattaatctgaataagctccaggtcaaacaaataataatctgaataagctcagttgatcaaatcagtacacagaaagtcaaattagttcgatatgcatgcaatgattttttctacgatacttgcagtttaatatctggatagtctggtgaatgcaaaaggtttgggatgatggccgccgtcggtgcaaaagtttgtttcgattttttggaaaaggacgaacgttgaatgagagatataactagcatataattaatcaagtactaattattaaaaacttaaaatatatttatttaatttttaaagcaacttctgtatataaaatttctcgtattaaatgtatcgttcagtttgaaaagcgtactaacgaaaaatgataaagtgggtaaaccaaaacaaagtttagaatagggccttaggtttaaatttgaaattcatgaacgacggtatattttcttgcaacaccatatgtaataggtgtataaatttatgttctatttttttatacaacagacacaagtaaatttcacaaaaaaaaaatcccatacagtgtgccatgtgtgacacaaaatctcgtcttgtgaatttatttattgaactccatattttagggcaaaaagtttcataaaatccaggtcattaactatgccatctattttctttgatatatttgtgcaggatgctatatttcataaatttatatatgttattttaggagcctataaatctctggctcctgccagacaccaacttgtttgatcacctcatgacactaacatatatgggaaaacatgcagtgcataccacatatatgatgaaaacataaaaactaccattggataaaagaaatgaaagtctaatatttgttcacgtcacgtagagaaaaaattttactccaagttcaaccatgggtaacgtagataaatctcaaacgtccatttttaatcaatggtagtgaccaggttttcacaatatacgtggttagtactacatatttccaacgaaaataaacataccattaaaatatactcaacgttagatttaataaaactaatttattattatagatgttactatagtttctatagatttgatcaaatttagaagacttaacacaaaatgacttgtaatataaaatgtacggagagagtacattatatcgttgcaacacatttgggggggtggggtggggggcgcctaattttgctaagttcgtcttagaatgagaaaaaaagagtgtggagagttagaatacttatatatagcgtatcagttggcataactatatgtttaggaaacataaggttctctaaaacgataaataacagaacatatgttttttttccagttacatggaagatgctaatggatgtacacaccactgtacaaacacagcgacgaataaatcccttttaacacgtactgcctccatccaaacataaaaaaacaactgctatagtttgaatttgataagaaaataccttcgtacctacttttcacacacgaatcgagaatatttttatcccttagataccacttaccaactcacccttgcatacaagttttacatcaatgaggatctcgccttgccgccacgctcgcctcctccgccgccgcttgccacccagccgccgctcgcgcccaccccctgcaccaccctgcctcgccgccgttgctgcctcgcctctccgccgccgcgctcgcctcatctcaccactgccctttgccgtcgccatgatggacaagagagagagagtgagagagattgggaaagagagggagagagagaaactgacttgtggggtccaccaacttttttataaaagaattgttgattggactatcatgtagaccaaaaccactgcggattggatcgaggagggtaattcgtccggttttcatagttgggggtaaagaatgtccggttttcgggttcagggggtaattcggtcgaccgcgatagttgggggaggtaattcgtactttttcctttcgatcatttaatatggttaataaatattttccagttcactttataatcaagtaggataatccgtttcgataaaatggtgaataatctgaaaataacaaacaagaaataaagactcgctcgtctgcttacaaacttatgtcagaattttcctaccaaagattaatcatctgctgcctggcctgacaagccctctcatgcagaaaaacaaatgcagtgaggcggtcttaagaagcctgaagtgactgatccatccacatatcggaccacatatatatatatatctatatgaagccaagccttcaacgactcctcgaaggaggatatcagcggtgcaaccgtgcaagacaccgtacccaccgcacgccgccgacccgacctacacaatcaccgtcgataggaccaccccaaagcaccgagaaaagaccccatcagtatggatggtcaatgggccgctcggcacggcctgaaccggacacgactagggcgtggcccaaggcatgtcaggccagcacgcccggcatactcctcgtgtcgtgtcggccaagcacacaggctaaacctgtggcccaagcacggcccattaagatgctgtgccgatccgaaagcatgaccggtctatcgtgatcgttttgaaataagtctatattgcatctctcaactatttgggccgtctttctacatggttgggataagtccattttgtgttcctcattttcttaggtttgtgtcttgtatatggctggagtaaggctccgttcgtatgcgcgagtcctgatcccgggtcatgttccgtgcaccggaagcgtggtcccgcacacagtaccagaacggcggcttgtgaggcggcgttaacggatgtgagatgtggccattgcgcctcagcttttccgtcggagtcaggtgtcacgcccagaaattcactagtaatttctgaactaatttgtgcatgaaatcctcatccaaaaatcagccgaggtacacaaactgacaatttaatatatagattcatcataataataacgtacatacttacaaaagaaaagaaaaacagcagcggaattacggtctagcgaagctccggctccacagctcccacaggcagctcaactatgatataagccaaacgtcttctccttttggatcctttttcttcaactgaggttgattgattattgcaaggtgagcatataacatcctcagcaaggcacacagcaaatatgcaagtgcacaggataccaaaggatggcataatataggctcatttacaaaagcagcatttagcaaacatttgagaattgtaaaacaatagagtaattaatcatcaatattaatcaagggcgggtcagcggctcccggcgcagcggcttctctgtggctccctggcgcagcgggtgcgctgcggcgcctcgacgcagcggctgcccggtggcgcggcagctcgggattttgccctgagctcgggacctccacggcggcgaggagcagcgctggcctccctctcacccctccctctcctctcatctcctatgtgatgtgatttattctgtgatttccacctcttctctcatcttatgtttaatttattttgtgatttgcaatttccaattggattgcttcatgtgttggattattttgggatgattttgtaatgattccaattggattgggatttagtttttgtgatgatttgggattggcgccaagcacttcgcagccgcacgtcaccagcaacccgacgtgcctcctgctgcctttgtaccacggccttggggcagcagtgtcctcggcctgcgatgatttggaaattggtatcgggttgggagggggaatcgggttgggatgctattagttttcttgtggggatcaattttcgtgttgtttttggttgtctggattgattgatttggggatcttgctcagggttttttttttttactcggactcgaacgaaggaaccaaaattttgggagtgacggacgaaaacacaatgacagatacatgtgacgagtagaaaaatccaaatcttttaattagttaagatattatgttaagaaataccgcgtccttaagaaatggttttttgctagtacatagcacaattacgaaattcaatctacatacaatctattattttaaacgaaactacatgaaattgaatccatatgaaattactactgtaatgcaattcccgtttcttctcaatttttgcaaaccggagtgtgctttcttgtgtgcatctaccaattcctcccacgcatttacaccccctgcagcgcatccggcggtaatggcagccatcctcctctcgccgacagaaagtgtcggcgctccaacggcgctctgtggaaatacctaagtcctgtgaaatttcaaactgaaatcatataaaccgtatattttcttgtaacatgtgtaggtgctttggtattaattacacatgttgcaagaaaatataccattcatatgatttcaatatgaaatttagatttctagatttagacataaaattttctagcagatacatcggttcaattcacgggtcgacgatgcatgaacattaaccggtcggcaagtaggggtgggcattcggttagaccgaaaaattcagttcggtttctcggtctttttaaaaattcggtctttagaatctcaagaccgatcggtctccaacaaaactgaagaccaagaaaattggtcttcggttagttcggtttggtctcggtcatagaccgaactaaccgtgacaaaaatttatcagcaaaaaattggtacaagataaatgaattaagcaattaggccatacacaacacactgcaaattgatgtcaccactcaccagcaaatcgagcactacttagacaaaaaaaaaaagaagcaaatcaaacacgatctagaaaggaaatcggcaaatcgaacacaactggcgcacacagccacttcaacttcagcctccgggatgtagccgaccggctagatgtggagggaggaggcggcgcccggcgcggtgcaggaggcggcgccggcgcggtggagccgtgagggcaggaagcggcgctggcgcggtggaggctggaggcgccgaggcggagggtggaggcggcgagctcggtgaagggaggaggcggagggggcgccggcacggtggaggcagcaggcggcgccggcgctcggtggagggaggaggcgagctcggcgccgggcggaggtggcgagctcggtggagggaggaggcggatggggcgctgcgcggtggaggcagcaggtggcgccggcgctcggcgctgggcggaggcggcgagcttggtggagggaggaggcggagggggcgccggcgcggtgaatgtgaggagggagtacgacgcctaagggacagagggagttggggtagggattctagggtttttttactgggcttaattgggcctctaggtctattgggccaattcggtcatcttgggtatttcggttaaccgagcccaataaccgaaatacctgaaataaattcggtcttttgctagctaggactgtatagctacccgaatttttcggtctcggtcccggtcatttcggtttggtctaattctgcccacccctatcggcaagagccgaaatttggatccttgtcccacacttgcacggacaaccgcggtataacaatcttttgcgtcacaatcttgagaaaagtcttttcatatatactccatattcgagtgcataataaatatacataagacacaagttgcctgggttggatattggactataaataaagctggatgacttaattttcatcccctcctacttttcttcgaccggctggtcggccctagctttgccgacgtttccgtcgatgtctcgcaagagacgggaggcagcgacgggttgggatcccctggccaaccagtttagtttagttggattaatatggcaaaaatagcacagccatcgaataattagtttgtacggctgagatggattgcccgaatgcagatgagtattaataattagtttgtcaaactaaactaaatgatccagcagaaacccaaaaggtaaacatagatgctcatgttctttgtcattattgatttttaacttccgatcaaccttttttatgagaaaaatatctttctctcctaatggattcaactacagagtacatgaataatgtccggctgctcatttatttattctctacttgtcttctcaaatcattacaacaattatttgacatctcccatgatagaaatgaaatgtggagcagagtgtgggttgtaaactctgaagttgaaaccagcaatgcaatcagatattactgtcagaaaccaatatatagtgctaattgaaaaggctcagttgttttagatcaaatcatgctgctaaagacccctgcttgattgcggtcatttacttaggaaattctacaatacatacatgttacctcatagcctcgaagtgttgtttgataggttcttgcacatcctagtgtactgctccctttcagacctatcagcaacgatgtcttcagccactacccagtggccagtgatacccattgctccgaccgtaccagcacgggcgccgcgcgtggatgcgccaccactcgtcgctccgcagcttcctctgcccccaccacgccggctctgctcactggtttctggtcgccggcagccggctacccttcgccactgctgccacaggataaagaaatctaaaagaggaagtagctggaagcggtggagtgttaaatgccgattttttttttcggtttgatggaacaggattctctgaatctttctcctggttgtgggctaaggggaaaaaaaaacaagaaaacgctaggattgtgccacgtatacgatcggagcacgtggggagcaggcaagcccgtcgctgcctcccgtctcttgcgagacatcgacggaaacgtgggcaattacgatgagtttgaggaatttggacccaatgcagatgcttttccttttcatgtttttggtcgatctgaagatatttgttcgttcaagcatggtggtagtcgatccggtatataaaggagggtgctggagtataaaaaactaagcctgaaaccgcaattcagccagagccccagtgatatcgatagtacagtactgatcaaagaacagcattatgcaaatagtatcaaatatgggttccgccggcaagtgcgcgccaagccttgcaccaacacatataggacttggcatgatggggaagatcgctgtgagcccatccagcgttaggcctaggcctcgggccatggcttcccacgacgctattgctcctgagaagacgaccaactatgagccctcagtctggggggatttctttatcaactatagaccacaaccgctccaggtatggatgtgtatatataaacatatatatatagttgttatatattagtgcaacagttatacgtatatgctaattatatattgtctatgcatgcatgtacatgcaaatatttttatgcatatgttctgttaattagtactggatcaataggaaacttcattagtcaataccgcagctcatgcatgtctgactcgagattttaattttaataatatcaatatcggcccatatgtggatagcgccatatcgaggccatttagtggagtcctaagtttgccgccattattttatggcaaattttgctacatgacactgctattttgtggttttagcctacactgtccaaactcacttttggggaaaacactccataaacgtggtaatttgccagtggacaccacgtcgattaaaataataatttttggttgaagagaaaagatatcacgtgaaatgtcaaaaatgcccttgggcccacatgccagctcctccatctctattccaccacgagcgccgttgttcgcagagtggagcgccgacagcgctgggagtcgtgcggcaacggcagtggcggagtgtagcactgggagcgctgggagtcgtgcagcaacggctgtcccggttgcggcagcgacgccgacgataaccacgacgacgcgcggcgatggcggctgcggcaattgcagcgcggcggtgactacgccttcgccgcgtggggcgccggtggcggagggtggggacgacaaccagaaggcggtggcggagggtgaggacgacaacgaggaggccatggcagacggccccaagatcaagatcctggcgcgcggtggcggcagtggtggcggcggcggtggcagtggtggcggtggcggtggcgcttagtggtggcggcagttgcggcagctttgacggtgccggtggcgaggcggtggcgctgcgtgcaggtcatggtcgccgttggccatggcggctgcgtcggcatggtgacggcgaatgcagtggcgacgacgatgacgacggcacgaagacggacggtggtggcggccggccggaggagatcgagagagattggatagggaggagaggtcacgatggggatcggctggagatggaagagatggcatgtgggcccaagggtatttttgacatttcacacgatttctctccccacttcaaccaaaaattattattttaatcgacgtggtgtccacttgcaaattactacatttatggagtggtttcccccaaaagtgagtttgggcagtgtcttagggctaaaccacacaatagcagtgttctgtagcaaaatttgccttattttatactgcttatgtgcatgcgcactatacttttgctggttttatcaatccaaaccatgaatgctgcagagatcagaggaatggatgaggcagagagccaagaggctcaagatgaatgtccgcacactattctggacttccaatgatgtggttgtaaggatgaacttagtggatgcagtccaacgtctaggaattggtcacctcttcaaagatgagataaggcgcacactaaatgatatacaccaaagtgaatttactagctctagcctccatgaggttgctcttcggtttcgcttgcttagggagcacggcttatgggtatctccaggtatctattgttctatagagtggacttaaactaatgttgatatagcttattactttttatgctcattatccatttggtaatgaaatttgaattgcatttaataattgttggtcggaaaattctatacagctttagagacaaactttattttttaactatacattaatagtgataacacatgtagaatctttaagtttctccacgtttgatttttctattgtcaacgaaaaaatcataataggttaaagctaaggctgtgtttagatccaaagtttggatccaaacttcagtacttttccatcacatcaacctgtcatacacacacaacttttcagtcacatcatctctaatttcaaccaaaatccaaactttgcgctggactaaacacagcctaagaaagaaattttggttcttctctgtacaagagaaggctagtcacagacacatctcaaactaattagttacaaattaaatattttgtcttgcagttacattcaacaaattcaaaggtgacgatgggaggttcatgaatggaatagctgatgaaccaaggggtttattaagtttatacaatgcagcttacctccttgttcatgatgagccagaactcgaagaggcaatctctttttctaggtaccatctaaaatcaatgatgcagggcaataacctcaaacaccctttatctgaccaagtcaagcgtgcccttaacacaccattaccaaggacatccaaaagaacagagacattgcattatctttcggagtatggacaagaggaagggcatatgtcaattcttttggatcttgcaaaggtggaatttaaccttctgcagggggtccacttgaaggagctcaaagctatttctgagtacgtgtgcctctttgatatataccaaactaacaacaaaagtactacaacagtatatattcatatcaatcttaatacagcttcatacactcatacatatatatgtaaatgatgtactaaacaaacatgtctgataaatgtacaatatccggaagagctctttgcaatattaattagtaccagtaataatcttaaatatactatctaagcatgcacctaaaatgcttttattttaggtggtggagagaccttaatgaacatgtggagctaagttatcttagggatcgtgtggtggagagctatacatgttcacacatgttgttctatgaagaaggcttagcattcacacggataacttttaccaagataattgtactaattattatgatggatgatacatatgattcccatgctaccatccaggaatgcaggaagctaaatgaagccatacaaaggttttgtctttgtcttagtgtatgctgacataaactaatttatatatacttgcctgactaattccgatgtaaagttaacaatttgcctgccttgcagatggaatgagagtgccgtctctgtcctaccagagtacctaaaaaatttttaccataaattgttgaataattttaaggagtttgagaatcaagtggtggttagtgagaagtaccgggttgctcatgctaaaaaagaggtacaacagcgatataactatgttgggactgattccttatttgtttatttgattttcagccaacttaggttttcaaatttgactattatgtttcataaatttccatcaatatgtgatgataaaattgtcatgactttcacagcaacaaatatgatggcataattttcatactagacttttttttcagtaatgatcaacattagttgacaacatgaattctatgaagtcaagtaaaaaaatagaggtggaaagcatcagtggtgttgtggtgaagttttggttgcatcattccacccaccagattgatggctcaactcttcataccaatgaatattatgcaaaagcgggtgctcttttcaaaagaattttatgatgctagggagtggtcactggtctcggtctctttgagtgcatgttgggttgaatatttgcgggtgtgtgagtgtggtttggaaaatcaaagcaacaatattaccatgttttgttaaccttttgttatgaatttctttttcttgggcacagtttcaaatactgtcccattattttctccaggaagctgaatggtcacataataattacaagccaagttttgaagagcagttggctttatctacaaagacttcaacggtgcaactattatgtgtgtctactacggtcggccggggtgatgcaataacaaatgaagcattcatgtgggcagctagcagtactaccgtgacatcatgtgcaaagataatgcgtttcatgaatgacattgcttcatttgaggtacaatttaattaattaaacttgttcttattaaatgtaatttttcaatgcccagaacaacattgttcctgagtggccacagtatttgttcaagctcatcattatagagaaacggtaaattttcacacaagtaaaagaaaaacatggtgctcaacatatgactatatgctactatccatgattcccttaacaactactctataacaatgtactttataactttttacattgttaaattatgggtggaaggtgagaaattataatttatctttgacattcatacagcgtgggaagaacaaaggggaaattgcgagcaccgttgagtgctacatgaatgagcacaacatcataagtgaggtggcctttgccaaactcgattcactggtagaagatgaatggagaaccatcaaccaagcccgttgtgaacatcatcagctactcccggtagtgcaacgagttgtgaacttggctatttgtataatgttcttttatgacaagagaaaggatgcgtacacattctccacacatctacaagagattgttaggaatcttttcatcaatcccattaccatgtagttccccttttagactgtattgtcaaatattatctatttttttttctttttacttttggagggatagatgaaacaaaatctatattgtatgattttttcaaattaacttgcctcccactaattaattatatttcttccatgccatgtcacccttcttatttgtagcattccgttgattgatcaattacgcaaattgtgtttttttctctcatcttatatcatcccaattattttagcctttatatgattgatatgtgattcattgcctctcactacaagaattttgggcttctgtgacgataacagcatgtttcctgtcactacccgcctgctgtgacgaaatggctgtcatcacagaaggtgggtcactaaccagcttctgtgaccaccagaggacatcgtcattgaaatagtgatgatagttctcctgtcactgatgaatgacgagacaaattcgtcataacaaattgaaccaactaacgccacgtgtatgatgacatgtgatgttgcagatgacaaggcgagtgatgtggtagatgacgtggcaattcacattcggcccatatagcatgggcttttttattttcaattacaattggcccaaatattttttgacctagctacaaatttgcttttacatttttttcattatagtccaaagtacaattcaagcccatattatgggccagcccaattaaaaaagcaatcacagaatataaaccacaaccatttgcataatcatattataatcacattccagccataattaattttccagcccatacaaaagcaagttccagaatacagtttccaacatgttccatacaaaagcacgaaacatgaatacaaaatattccatccaccatccaactacacaagtcccagccgactatgaagttcctacaggtagtgtcaagttcctgcaccaaaaaaattccacctagcagccactactaagttttggcgtgcatcttgccagcagccaggaaaaaaattccaccaagcagccactgcactttcggcctgcatcctaccagcagccaacaactagtgccaaaaaatcctgtgttctagcaaccaacgcaaaaaaaactccagccaccaaaagtgccaacccgcaagcaaccagcagctagcaccaagttctagcagccacatacaccatacaatagcagccacatacaccaccaagttctgaagtaccaaaagcgatcacagcctcgaagttcaactacactaacacgagccatcaaattccaagctcagccacctcattcctgccatcaaaaggtgcatgttttcagttgatggtgaataaaaagtccattttgtttggacttggaggcaaacaaatgaacaaatagtgtttagagtaataatccagcaggtaaattgagtaataacaatatattgatatggctcttttccgtaaagtccaaacaaatggctcttttctagtcacaactaaatccaaacaaatggctcttttgcagctaataatccagaaaaaaatagagtatctagatcgatcaatcaaatggctcttttccagtcacaactaaacaatatctagtttcatagtaacaacaactataaacaatccagcaagtaaattgaaataggcagagtaataggcaattttgatacacaccatgaacaaaaaattcagccaccaatgaaacagtacaataggcttgatatggatgcaaaagcacaagagacaagttaaagctgtgcacctgagcatacaactagcttagggaggactgatcagaccctgtccaaatgctatcatttgtcgaaggaggccctgatgatgaagtgagggtttcccgggcatgcatatcctcctagcaatgaaagcaaggtttcagttttgcattattatataaataaaggttcattgcataaggtacttaataaaagaaggaaagaagatgtaatagttcagtacttactatagctttctttacaggttcactaaaacctttagtttgctgcaatgcaactcattgaagagatcaattacagtgggctcactgtcaattgcagtgcccatgctcttcccccttggctccacttgtctactgccaatgagggtgcctaacataaaacatttacaagtgtcaataaaaagatcctgcacttgatatgaaggcataacacatgtaaggacaaaagaaccaagaatccaagttacttgccttgttcagtagagctcaatcccattggctccagttctgtacttaaagtgaggtcgctcaatcccattgccgccacccaatatggccacccagggcaaaggccccatctgcggcgcaagaaggaagggttgaggatgatggccagctgcggcgcgccctggttagggctccacccgccgatgctcaccagtgccaccggatcttgcagtcccgaggccctcattcctgtagtcacattctgcaagacagatgaagaaaggatcagaagaaaagatcacaacattgcattagagttgcagaagcttctaactagtaactgtttttgctaggcaaatctgtgagttgagtaggattttaaggaacatatactctttgagcaagtttatggccaatttagtaaaaatctcacatcttattaacattcttaaggggatatttttgtgacagacattatattggattatagaaggaatcaaagagatgctagccatgacctttcttctcaggaggtgatgcttcccttttaccagtgacaatttctactttatgaactacaaactgaggtggagatgcagcagtagcttcccttcctacttcaactaccaactgcactaaaggatccaagctagaaaaaatttcttccttggagatatcatgatctatatacttggattgaactgagttcaaatcaatgctaccacacctaacattaacaaaaaagaaggtgtttgtttttcaagaagaatgcatgtggtaagtttggtacagagtagagatcaaaacagtaaacagcagctgtgatcggttgggcaggcataaacatcttcctaattataattagttaaccatacatttttgaaacacggtttctttctagaccaagtcaactctgacccaaactaactctttggattattttagttattaaatgtagaaaagctatattcaataggtagatgcctccctactttcccaatgaacattgttaaacccacaagtcaaacatggatcacccatattttgttaaagaaactatgcaatttaccacgcttgacctaagaagctagaccaatccttgataatactaacatgcctaaccatgctcctaatgcttaccactccaaattcaagtacgaaagctattctgttatgtaacctaaaaataatttcgaacttgagaatcatcgatatcgacactagaatacaagaagagagaagcttataaattttaagtactaattgtatgactgtcaaaaacaatcagaactatgtactgctctaattttcacaaaacaatcagaactaattactgctctaattttcacaaaggaaggatcaataggagaatggaaaaaaaatatttgctaatcactactccatttcaagactgattcacacaaaaaactgtctacgagagaggttgtgacctgcaaaactgaatcctctactcgccgtctttatctcggctacaaatcgctccagcagcagcagcaatcaagcaccaacagaataccccaataaaccaccagatccgcgaaagccagcatctcttctaccgatttcccaactcgacaagggagttgttaccctcatccagatcccgacgcgtcgctggcctgctaccctgcacccctgccccgcgccgcgtgcccccgcggcccgcgccacctgcccgccttgcgattgcaagtcgccagccgccgctggtcattgtcatcgtcgtcgtcgctgcagcactgtagccgtcgttgcagccactgtagccgtcatcgccacagccgccgccgccgtagccgctcgctccctcctacctaagcctgccgccgccgctccgtagggcggaggtgggtggatctgcgtgttgccggcgctcccactcacgccaggccgctcccgaggacggaggccattggattcatgcgccgccgtcgctcccgaggacgggaggcggcgaatccgtgtgccaccgtccttccctggctaggggagcgacgtggggaaaggcgaagatggatggaggaggagagggatgttggcggtgagggaatggatggtggcggcggcggcatatggatttagtttgggctaaggtttgggggagaggttatatgggtaggaagcaatccaacgggagtttaccaaactgtccctggtatgtcaacagtagttatgaaattgtatgaacaaaatggacatttcaccttaaatttatgagaactttaaatttaattttaggctgatttttgtgtttcaaatgcaaaaatcataaacaacaaaattgtaaaactcatcgagatctacaactactgtattggtcctttttacaaataagtttatttgaacaattcaaattttgaattttcaaaatttgataacgtcaaacaaaaattgaggttaataaatgatttaaaatggaaaagtcaccaaaaccaaagttgtagaactcattgagatgcaaaatttttattttggtcatttctccatctgactctaattaaataatttgaaatttgaaattcaaactttgagaacttcaaatagaattttttattagtgaacgacttcaactgaaaaagtcatcaacaacaaagtagtataattcatctagatctacaatttttattttggtcatttgttcatccgataaagtgattttaatattgttcacaaaatttacatatctctcttatagttttataaaccatataagagatatgtaaattttgtgaataatgtttttatcactttgtcggatgaagaaatgaccaaaataaaagttatagatattgattagttatacaactttgttgttgatgactttttcaattgaaatcattcagtatttgaaaatgttgtttgaagttgtcataatttgaaattcaaattcaaattattgaacacaaagtcatatagcaaaatgaccaaagtaaaaattatagatattaataagttatacaactttgttgttgatgactttttcattcgaaatgtcgggtcccaaaactaatgattcggaaaccgacatgtttagactgtatcaagccctggatcagtagattgatacaggttcaacaatctggctcttcattgcatacatttgaacagggctctagaggagttgttattacaaaatatatgggtatttacaaacttgtggctaactaatacagcagaagctatagaatgactcaatcctaatgttttgctatagacttaaaccatctaactaatctagacttgagaactaggttgaaatgaaactaacttatatgattgaactctcggcttcggcaagaactccaaattaattctgaaagaagggggttaaagcaagggtgagtacaacgtactcagcaagttattatattcaagtatgaatgtatgaaataatagtatttgagtagagctagatctaattgcagaaagctgagaaagtagaaggagaaagtctataatgttttgaaatgcaacaatatttaataaaatctggagttatatttctaaccaagatgccatagtgagtcccgatgctcaatatccgtgagcatggctattcgaatagtttcagagatactcatactgtagtagatgtacactttacccgcaatccatgacatgctaatattcatcagcttagtcatggcaaagcttttcagttcctaacattagtggtacctgttccatgaactatagtcctcatacgctctgaacgtaacgttatcagcagcgagaggagttctggcgttcccgaggtttttagagagaactggttgagagacccccgtcatcccaaccaggttttcacaatacacacacagcgcgcaataatcaatatatttacctacgcctcggtaaatattataatcgccctgctcggcgtaaatttgcctcctgcgcgaggacttaaagaagaaccactgtacaggggtaccacctttgctagataacatactttgctaagtctgtccccattctagaagttgcggtcgtactcgctcgttcttcacatgtacttggcaatcttatgtcggttggaacagtactagccacccggaaatcaaccatttctaccgtactgttccaatctaagttcattatattttatgcaatctaactaggcatggctaagcaaaatctagcatatatatctggtttgctatgtgttcaagttatgcatttaaaatcatgaatggctaatgcatggaataatagggatatagaatataggataataatgctcaaaggggaggaataataacttgccttgctccaacgcaaacaaatccgagataggcaacctgattatctgatcctcgaaacatcacaggttgccatccaaaagataatagactctactaagaaagacgaagaactaaattcaataaaagccataaaataacaagaaaacgataaatggttaggagggctagggtttggttgtgtgctagtcgatgctagagcataacgactaggtttggtatcttctctagccggtgtcaacaggcagcataacggctagagggataggaggtttgtgtgggtttagtggggcggaagtgttactccgacaaccgtgagtggcggtggagcggctaggatcacacagagcccgagagctaactgtgcggcgtgcaatggaggtcgaggggataatgaagctccgaccgttgtacgcatcaaggcgtggggtgccaggagcagcacttcgaccttgggtttggcctttgccaggctttataaccaacagttcgacgtcggggatagaaaaccacgaacgtccccatggaaggcataaagttccaaccggcggctttttagtggctaaaggggtaatttgggacaaaagaaaatatttgaaaaggcaaatataaattcaaacgatatttgaataaattcaaataaaattataaaatagcaaatttggtgtcaaaagatagggtttaagtttcactggaatttgatctacggtttaggagatatgagcttctaaagattgggttttgaattaaatctagaaaatacgaaaatgtactgttcatggacccagacatgtacctgctcttttccttttctctctctctccttcttctcgtcttcttcttccttcagccgatagaagggagagggagggcggttggggcgacggcgctccggtggctgactggctgcgacgtcggcgtccacgcgtgttcccgagcacgacgcacctggggagggcggtggctggcggagagagtgaaggagttggccggaacggcgacgacaggagctcgaccgtggcaacaaaaggagtggcggtggtggcttgatgtggtggctaaaagagaggggaaaggggaaaaatgggttcacctcgtcgaggcaaacacgatggcgcaagggcttggcttgtggagatgcggaagaggagatcgactgatggtggcagtggccggtcaaggcaggagagagagaagagagcttcaagctctgatgtggggagaagagggcgatctcgccggctatttataggcggcggacgtcggttcacgaaggtcggttcgccggtggtagatgaagaaggcacggcgacggtggcgtgaggaagagggacacggcgccggccctgtacgttgattggttgatgatggcggttcgtctgctgttgacgtcagcgggatgatgtgtagttgacgtcgggcggcggttccttcgcgtcgacggaaagaagacagcggtggcagagagtttgtgggcggtgttgagaggaccgaggacgacggcgcacaaatggcgcacggcggcggcgactgtggcgagggaaaagtcggctctgagagggggaggctgggccgacttgggccggtctgagaaatttggcccaaaagcgaatagaagttatttttcaattttggaagatatttgaagaaggaagtttgaatccaaattaatatttggaaggaaatttaggtggctaacttttgaaatgaatctatttttggagataactttcaaaagagatatttcctaaatatttgagtgcaataatgtggtctaaatattaaagcactcaaatgggagggaattaatataattcctcaaaatatttttgggaatgaggcaggaaaacaaggagggaaataaataggatttttagccccaaaatatatggtatggattttagagaagtatttgaggctaataggaatttggattcgtggaagagaaggataaaatatatttttttagcacaagagcaattattcacaatatctgtaataatattattcttgtgccgaagaggaaatcaagctataggaattaaattggcggctagattaaaaggaagaatttggatacttgagatttcgaaagggaactaaggataggttaacaattaactccaacaaatttggaattgcttcggtttaggttcaaggatagtgttggaggatttcttggaccatgattcataaaagtaaaaagattttcaaactaaatttgaataaaaggaattttttcaaaagaaggtttttaaattaaaacccaaaatcaagaaacaccttaatttaactaaatatatttttaaaggaaaggcacaaaagaaattaaataccagaaagagattttatgcaggttaattttaggaggtctctttaattataatatcctaggtttaggaggttaataaaaacataagaaccggtatgatgcataattagaaaatagctaattttttagtatgttacacgaaatcattagtatttgaaaatactatttgaaattgtcataatttaaaattcaaattcaaattattgaaacaaagtcatattgaaaaatgaccaaaacaaaagttatagatcttaataagttatacaactttgttgttgataattttttcatttgaattcatttactacccgaaaagttatttgatttgagaggagggaagtaaaatggacttattggcgagggaggagcaaaagggcttggccggtggcccaaagagggaggaggagggagagagaggctgtgggctaagggagggagagagtaatacttgggccgaaaaaggcccaaggacagcgagaggaattttaatttgtttttcatttattttaataggttaaataaactttgtggtattaaaattagttattgagctccgaaaattcacggaaaattttaaagaataatttagaccaacttatagccattttagtttgtttttttaagttttttcattcaatcataaaatgaaacaccataattctgtttttttattcataaaatgagactagacatgacttcaatcctaaaatcctaaaatgagagactagaattgatgtagacaagaagagttcacctaggacaaacgatttatggtctagtagcaatgtagtataacaagattttttttgtttttaaaaaatataatagttctatattttatgacgatccattattgtcatcgtgctatcgtcacagagcccatgcagagtatactgtgacgatgattatgacagatacacggtttgatcataaacagctgtcatcctgtgaacagtcgtcataaacagcctctgtttatgacagatatgtgttccgtcatcaggtaatcgtcatagaagcccagatttgttgtagcatgaagccacaccttctcatttatttcacacatctaaatggttgacgatatgtgtgaattgaacaaagcatatggagtgaaactacaaatcttatataccgattgcaaggttaaaaccctagatgttaattgggccacgtgtagggatgaaaacggatcggatacggacggaaactagctctaccatattcattttcatattttttttcggaatcggaatcggaatcggaaaccccggatacgaaaacggaatcgaatattgtcgaatacagatacggagcgaatacgaaacagaacgaatacggtgacgaatattaatcggaacataaaaaccactcaaactaagcatcacaaatcaacaatgaaatataacttgttattttttctaatagaacatatcaacatttccaaattttagtgttaataattttgctatatccaattttgtggttgagggtgacggcgtctgcaaaaatcgacctttattttctcatgcggctccttaagactagtttatcgtactcatatgaactccaaactggatgattctttttcctaaatgtttgtaaaatcatgctctattgtgttattgtgttcttactgctattattttggccatatttttcttgtgactttgttttatcaattaaaattttgaatttcaaaaaaatgacaacttcaaataatattttgaagcggtaaataatttcagctgaaaaagtcatgaacttaaaagttgtagaactcatcaagagctacaacttttattttggtcatttcttcatctaataaagcaatagtaacattgttcacaaaatttacatatctctcttataacttatgaaaccatatgtgagatatgtaaattttgtaaacaatgttactttcgctttgtcggatgaagaaatgaccaaaataaaagttatagatcttgataagttatacaactttgttattgatgactttttcagttgaaatcatttagtatttgaaaatgttgtttgaaggtgtcatattttgaaattcaaattcaaactatttaagcaaagtcacatagaaaaatgacccaaacaaaagttgttgatcttgatgcgttttacaactttgttgttgacagtttttttcatttgaaaacatttactacccaaaaaaatatttcaatttcatatattttaaaattcaaattttatatagttcaataaaactcggatggaaaaattaccaaaataaaaatggtagatgtcaatgagttctacaactttgtttttgataactttttcatatgagttcatttactatatgataaaattcgattcaaagtttttcattggattaaagaaggtgggtcccaactgtaagtgtcctcctcttccttttctttcccttcttctcttcctctttctctctctttcttatctccttctctgctctcttctcccctttcttctcgattctccatgccagaggggaaggggcgggcatggcacacggcggggtggcggcctggcaaggggcgcggcggcagggtggcggcctagcacggcggggtgccggcctggcgcggcgggagtggcacaacgcggcgggcgagacggccggcgccctccccctcccagatccagcggcggcgggctagggaggggccggtcgtggccgggagcggcagcggcggcgggcgggagctgcgcggcgcggcgtgagcggcatggcagcggcgggggatctccggaggctctgacaacaacgatgggaggggcggctctggtggcggcggcggcgagcaatggcgacggcgacaacgaggacaaggacggctgttgaggcttcgagcgacgtcgacagcgacgaggatggcgtcgccggcggtgagctagggtttcggcatttttgagatttttatttttttttcgatttttaatgtggctgatttggatttggctgttgattttgattcggatatccggcaaaaaaagtccggatagtttccaaccgcaaccgaatccgagttctgacggataccatcgctactgtattcgaatccgtttccaagaaaaactatccgaattcgtatccgaatccgaaaatatccgaaaaaaatccgaccgaagcgatccgtatccgaaaacacggtcggaattcggaaattatccgtacatccctagccacgtggcaacaaacgtcgaactcagcccatcttgccgaggaagaggcccaggcacgacccatttgttgggccaagccgacacaggtccaacaacagtcgaggggtgtcatgcggtccaggccaaaaatctctgttctatgggccggaccattgggctacgggtcttttggccaactatacaccacaggcagccgagtacgagcgaaggggagacaaggtcatactgtcgcagcaccatccctctgctgcaacagccatcgcaagtgttccatatcggccatgccagattgtcgccgctcaagtcgtctttgactcctcgtcgacgccccgttagatctacccataggcgccgctctatgtgccgatgctgcatcgtcgtttccatcctgactcggtcgccgtcgttgcaaccgctcctccgaacttctattactagtatgccactccaacggttttcaccacagcccatgggatgccctaccagatccaatgcctgggcgttgccctctacacccttggtagtggcaaaaatgtcatgcgccacaactgcaccagccagcccagctgccgcttgctaacgccaagtctgaccgcatctaccaccactgtcctgagccgtggagatgggattgaggccctctttggatggggtaaaaaatctttttattccatgtcatatgggagtattaaacatagactaattataaaactcatttcataactttggactaattcgcgagacgaatctattgagcctaattaatccatgattagcctatatgatgctacagtaatatttgctaattatggattaattaggcttaaaaaattgtctcgcgaattagcacttatttatgcaattagttttattatcaatttatgtttaatactccaaattagtgtccaaacatccaatgtgacatggactaaattttagtccctggatccaaacaccaccagaaagagcccatcaccaccgtctttgcactcacttggaacttcggcagcggcaaggtcaaggaaggcaggtgtgcgtcgcttcagctagattgagatggtgcgcaccaaaacataacccatacatagggggtgttttagatacagggggtaaagttttggcgtgtcacatcaggtattatgtagggtgtcgtatggagtgttcgggcactaaaaaaataattacagaatccgtcagtaaaccgtgagacaaatttattaagcctaattaatccgtcattagcaaatatttattgtagtactacattgtcaaatcatggagcaattaggcttaaaagattcgtctcgcaaattagtcgcaatctatgtaattagttatttttagcatatatttaatactttatgtaggtattcaaatgttcgatgtgacaggatgtaaagtattgggatgggatctaaacagggtcgtacttgggagttttatgatacactaggaaggtagcccgcgcgatgcacgggcatatgtattagtttgttaaaaaccggtctaacaaattaattttaacttaaaagtaagatgtttttcattcgactttttctttcagtgagccgagtcaaatgatgtggtgtttttttaatttgagttagaatcgcgcgtgctctctctcatgaacagaacatatacgtggagtatgtgtggctgaatcatggctggcatcattaagcaatggtggacggaatcatcttgaagtttttaagtaggttaagattaagattagatctaatgattgaaaatattgaaaaggcagtggttagattttttttaatataatttctgtgaattttacacatgatgataattacacgtgattataattacatgttggtttaggggcattggtatgattgccacgtgatgattttaggggcatttaaaggatctaaatttaatatttgtttaatatggggcttaaaaatttgatcttaaacatttatattagaagtttgagctatgtatatggatctcgaattatgtatttaattataaatgacacaataattcaaaaaaataagaaaaaatgtaacttgatatttatgatcatttagaaatctgattattagtttttgatagattgagtgttaacttaaaaagtagcaattagcttaagaaataggagagaagaggagagttaggagggtggagggagaactcaactacgacgtaggtgcgcacatatggaggtggcggtgaggatgcatgtattagattttctttttagatgaagatctaatggttaagattaataggtccatcaatttttaaaagaataatcgctaaacatttattagaatttttacgatttttttattaatctattagctagaaaattaaaagaaggaaggaaggaaagaaggagggatgtacgtaccgtgggaggagccccgggaggaaggaggcagtggagatgggttttggatttttttaaagatagatctaatggtgtataatattaggtccatcgtattaagtgaaaatcgagggcaagatgttttttttcctcataatttttatgatttctctaatttattaaagcgtcatgtgaccagttaggagtgtttataggaagtttaatgggctttagctaaataataggaaggggaagaggagaggagaaccctgagcttttcggagagggaagggtcgatcgatttaaataaaaccgatgatcatatgcatttttcccctaaaaaataggttttttttaaaaaaaaaattatatgtgaaatgtgaagacatagaggtgttgtaatggacacctcatagatgatgatacgatatatgttgtcaatttttatataacgtttcattgctgcttagttatcacggaaaggatatggattcatgtctaaaaatatatttatcatatatcaagaaaggcctatatggatcaaactaaaaactgaatatatttaaaaatataatcatttagctatctattatttatatataatcatttagactatctgacgattggccaccagctatgcctgtaacaaaggaactcacatcccgtaactatatctcaaacagctttttttttacccattagatatgagataattgcagatgacccatcggatgcctatttctatataaaaacatagtaaatagagtgaatatatgacttagctcattgattaatttaattaaaaaatacaatcattcaagcgtattgtaaaatcaatgtatatattgtccgtaaaaaaatattagtgcttgaacgttgcacagacagctcgatgctccatgcaaggaaagatataaccatttacaataataagttatagtgcatatctcataataactaccttaattagaaaaagaagaaaaaataaagagaaaatgaggggagagggattttattttgatatgatgttttaaattaccggtgactattctaaatgaaaatcaacagtttgattttttttttctcataatttctataacttcttttttttccctttactttatcgcttttatcacataagtctgtgcttatgtttttcttctcgtccgatgaacagtaggtaattaagcttcatcgtttttctttcaaatgtacataacgtactgaatacttttttttttcccttttccggcccacaggaggaaatcattaccttttttaaataatacattcaatctaatggtttaaaatacagggtccaccaatttaagtgaaaatcgatgatgagattaaacagtgcaatgtaaacagtgcaatgtggcgatctagagatgtttgtaggagcgtcacgtgacggcttcagagcgtttgtagggagtttattaaacttttagtatataatagatagatagatatgccgtaaaacctagggttctctaaaatccactcaataagacgtgcattagccaaatgtttgtgtccaaatctcactaagaactgaatacaaaactaccagcgcaagaatagatttcaaatcaaaaaattggattcaaaatttatgcagtaaattaataagcgaacgactagccgattactagtttttactggtttctttatagttgaaagcaccaagctatatatctcaaaggggaatgagtcgcatgatccaaattccaaaatagcaaggatcgttgtatgcaactggttaaaaaaacacaccgctggatactattgaaccaatcaggaggctcacatgatctacgagagaatccatttgaagcaatgaagaggcttaccagaacacccctgttatttttaactctatgtttggttaattaatcaggtgatcaaataaagaataaaaatgaagctttgaccttgaattcatacgaattcttttcctggacgtgcacatacgaacgataagtcctacatatatatttactgcgcattgagattaaaaatatatctatatttacatgtattttctaatgttctcaaattaccctatgtaggataccaagtgtttgaaatttatccaaatattcataaagtactatttgctcccatcaatctcatatgtcactacttccaattacatctcaactccaaccaaccctgactaaacgagtaatataagtctttttcttttctcaaccttaatctttattaacaacttataaaaatccttatatttaaggacgaaatacagttctcacataaaaccggccccaaaattatcaacttcaatcgtccactcgtatacgtagaaccaagtcgctagtctttttctggaaatgtaaaacaatactgttctctcacaaggtccaaccgacctttcttaaatgaagggcccagatttgcgctaattcacagatggctcctctgcagcagcaagaactagagctggggtgtgtttagtccacgctaaaattaaaaatttggttgaaattaaaactatgtgacggaaaagttagaagtttatgtgtgtaggaaagtttttgatgtgatggaaaagttggaattttgaagaaaaattttagaactaaactcggccctaatgcagagtttccgcttctactaccttcaacttcaagtcattaacaaatccacaactgggccacttaagcagtaatttaaatcctcatcccgacatatgattgatttcccaccggccaaaaccactgcacgcgccgatgcaatcagaatcaatttctattaacattgacctctcgcagctcgcgcatgctcatctcgtcaactaatgatgaatgaatcgtgaattctctctctctataaatggctactaattcgatcatcccaaggcaataatccacagacagcaaaggatgatgcaagccaagaagccaagatcaccattgatgatgctcatcgccaagaagccgctgctgctgcttcttcttctgctcgttctcctggtgttggagccaagatcatcagcagaagctaacctcgtcggcgtcaatggcggagagacggatgagaggcggcttgagagcttggtttacgacgagctgcccttctcccagctcggcttgggattccctaccaccgtcgtcgccggtggctccgaggtacgttaattacgtacttaattagcgcaaattcaattgctgtaagaaagaaaaatcactcaaatgagaggttaaatttttttttggggaaaatgagaggttaaattaggttccaattgactgaaaatgcagcaaagttttttttaattgttcgagcaaagggatttcttcgggtttttgtgctcttagatgacattggtgagcgcgcccatgcacgacacaatggcatgttcagggagtttccccgcacgcactacgatttctttaggaatctttcgcatctcaaataatctagatttttacatggattctgaagattgaaaacctaacattttgagattcttattggatagttattcgataggataatagttgcttcgcagaatctcaagcaatccaaatgggacctatatatacatacatataacggctcaattttccgttatacaaatacgtttgtgattaaaaaaattagtttaaaccaaaatgggctcgcaagttgtcttttgagaaatttcaaaccctgtttgtcgctaccaaactctaagggctctggtgatctgttgcgcgaatatcatcctaaaattttgccgaatatttgacacagaatgatgtggaggaagttgtgcaagcatggtacatggacgacgacgacaacgcggaggaagaccagaggcttcctcatcgccgccagcctgatgatcttcttcctctcgccaaattgcttggtatatatatttatctacatatttatcgagcttttttttaaaaaaggttaattttgtttagcctcgtaagcttgttaattaatttctttccagtggcgccgatatccatgcgatgtttaccactagtgtgtatgtatgtgtgtacacacaaagatgacgagtttttaattagtttttttgcaatttgcagacctcggactcgttgcaatgcgattagatgcagataaccatgagcacgatgagaaccttaagataatgcgtgaacagagaggctacttgcacatggttagtcttcttgctattaggtcaatctttacttttaaaaaaagatgcatatgcatgcttaaattagtttttgtttctgctttcaaaatatacttgctattaggtcaatatttacttaaaaaaagatgcatgcatgactaaattaggttttcttttttgtctgctttcaaaatatactcctcatatagacataaatattagatgtttacgataggaactggtcaaactattgaaactgttcatctattttattttaaataagtttatcaaatctacttctgctccagaatataaaaatttttagagtttgatacggttattaagaaaataggtagaattatatggggagaggttgtgattggttgagaagtggaggtatgtggaaaaaatgaatggtggagggttgtaattggttgggagagaatattgatgaagaaatagttatatcttagattaaattctaaatgctagaaattgttatattttaggacggatggagtaataagtttatggtggtattgtgatagcccttttcaagataaatatatacatgtcattttttttgttactaagtattagagaagttggtggtgtaacttttaaaatttagatcaaatcttgttgtaaatgtcaaatatttatgagagggagtagaagctttgaaatgattaccttgttgttacatatctatactatctatatagttgataccaactaactcctaaaacttaacatctaaatgtgcaacattatcagccactagcaattactccctctattttttaatatataatgccaatgatttttttaaatacgtttgatcatccatcttattcaataattgtatgtaattatgatttattctattgtgacatgatttataaccgaatgttctttaagtatgacttaaaatagttttatatttgtacaaaaattttgaataagatgaatggtaaaacgttgatttttcacatattaaaaaatggagatattattatctagagtattttaaataccatgcaagcatggcatcttatttataattttgttgtatttttagaacttgatatacaagcaatgtcaaatcattattttcatattatttaaatgtatacatctatcatttatataatgtataacatgcattcatctacatatcacatagcaaatcacggggtatcaactagtatatactaataagtaaatccacgtcctatcacttaattttttggcatatccatatgccattcattattatttatatgaaagaaaaataataataatgtggtttacctctttcggaaggcatcatagggggtgtttagatccaagggtgtaaagttttggcgtgtcatatcgggtattatatagggtatcgtatggggtgttcgggcactaataaaaaactaattacataatccatcagtaaaccacgagacaaatttattaagcctaattaatccatcattaacaaatgtttactgtagcaccacattgtcaaatcatggagcaattaggcttaaaagatttgtctcgcaaattagtcgcaatctgtgcaattagttttttagcctatatttaatacttcatgcaggtgtttaaacgtttgatatgacaggtgtaaaattttgggtgggatctaaacacccacatagtttctctttgcagcaaagctgtgattaatttgggccagctctagttagatctcaatggccatggattgtaatcctacttatggctaataatgatcaatcgattatccaatctaaaaaatcgaacttaagtatatgcattttttgcattttcgtaggacatcgttgaattgaccccagagaaaatgccaaattatgaggtgatgatcaagagattcttcgaagaacatctccacacagatgaagaagttcgctattgtcttgatggtagtggtatgtgcgaacaatttactttaccttgattttttgttataacgaaacctttcatctcaaaaaacaaagaaattttttatttcactatattgctgattttgaattttggaattaatgaaggttacttcgatgtgagagatgagaatgacaagtgggtccgggtttcagtgaggaaaggggcactcatcgttgtgccagccggcatctatcaccgcttcacacttgataccaacaactacataaaggtaattaaagggcatagaattttcaattaatggaaccaagaaaatgtaatctgattggtttctggtttatttctacaagattttatcagatttaacttttgaaggtagttgtgctaactgcatcacattagctccgaaaatagccaaagcgatgacaaatatctctactattggattcataaagagcgaatatatagttggtcagcaaattccccttggtccttaacaacaattttatcctaaccatgatcatgacatggtaccctttcaaatatttgtagtcattttcttttgtttctgagtgggtatcaaaagaattccttgcagttcagtaatcctttcgtgattaattaactgacagatggggcctgggggcctcttgtttgggtttttacagaccatgcgtttattttcaggtgggccagattggacggcttacaatcgtcctcatgatcatctgcctgaaaggtactctatttcactatgcagggataaatttcggggttaatctaagctaattaacctgttccctccctctgttttttttttcttcaggaagaagtatctagaagcgctgcataacaggaccccgagatttggacaactgcatcgaattcgctcaaaaatggagtaatttttattttgaaaatagcattaatatatacccatctttcctcatcattaataaattttagattttctgcatccgtcaactgatgttgcgaagtgattaagatggtggtgttagatagggtgcaatgggccaatgtttgatctcttgatcaagcaacgacaagatatatatggatcatgtatgtatttttttttaaaaaaaatgtatcatgtatgtagaacaattgctccaatgcaagtgtttgcactactgtagacctcctcatgtataacatttcaaaacaatctatctataatgggtatgtcaactgatacacattccattgatcaaaggaacccttatctatatatagcggctcagaattacgaacccttagatttcaggatttgtcaattgacgttatacacagatatactcttgttagtaacggctatacaatggcctattcatacctgccgttatagatgagaggtaataggtgacgtcgaaacctcatctataacggctaggtattagcaaccgttacagattattataactgatacccttaaaaaaatacaagtacttgagcatacctgccacgattgtaatggccatcacggcaccatcgcccttgttccactaccacttgtcactagatttgtaccctctaattaagcatagagcggcggattcacatattccctccgtttcacaatgtaagtcattctagcattttccacattcatatatctatctagattcattaacataaatatgaatgtggaaaatgctagaatgaatatatctatcgagatttattaacatcaatataaatgtagaaaatgctagaatgacttacattgtgaaacggaggaagtagttctt

SEQ ID NO: 70809 - DNA, 17407 bp, Oryza sativa
  unsure (1)..(17407): unsure at all n locations
cagatgtcgaagaccatcggaaccatagtcatccagtacgcctggtccctggtgcagagtgtggacagacccaacggcgcacgagcctgggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgtgtgctggtccacctcagggcggccgatcgcaatcctctcagctgcccagatagaaagaaagagagggcaccaaccaaaggtcgcgctgggatccgtcttcgtgcaagactcacaaagtgcacggtacagagccgccaacaacgcggaaccccagctccactgaggcacctcgcctaccgcgacgtcggcgatgctcctggcgtagtgcacgagtcccttgtcgaccgcgtgcccgtgaccgccacagaacatcacccagccaaaaagctagagcaagtacgcctccaaacatcggctgtaggagtactcgtcggcctccgcctgtagttgctcaacctgcaagcagtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccatggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacgaaggagtcgtgaaccgtgagtagctcaccgcacgtccgtgcccggaacgtcccaagctgagccccctgcaccgcagtaaggtgagactggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattaccaggtagaaaacatgtatgcttggtaacgactgacactgtccaataatccttccatttccccttatacgtgtgcactctccagggacaaccatctttttccttaacacaccgaacttcatattgcgaccggttcgacttggcaaccctaaactctctatgaagtgacactgcaaaatgttttaccgcctccttcatatcttctgctctactataaatcgctccctgaataacctcattttctttgtactcccatctcacactatcctcttcagagacgattagcccagaaaaatcctcactagcccattctgctggattaatatccgtctcatcatctgacgaatcaccttcctctacacgctcgttgtcagaatcctccctctccatttcatccacaatagcaccgacagtctccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagagggtacactcctctcagccggtctatcaattcccctttctgatacaataaaatctgacagatctaccccagttggcccgtaaccgacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaaattttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcgacaaggggccgcctgcaaaatagctggccccgactggcttttttgcattcgggccccttgccgccccaccagagggcggcaagggttttcctgcaaaaaaccctccctccgttaccgcccgttcctcccccgtttgccacgtcagcttgccgctccagaggtgggcggcagggtctatttttgtaatttttttggccgatagattatttctgtaaatatttttttaaaaaaatctaaaaccgaaaaaaattccagcccgcagcaaggctgaaattacgtcgtgggctagctaccttggaccaggccttggaatcataattcacctgaaaaggtacaccgaaggtccctgaacttgtcagagttaaaaacatcctcaaaccgcaaaaccaaatatccggcgtcctcgcacgccgcctccgcccttcgccacgaactcgcccgccactgctctgctccgccggccgtcgcgcgctcgcctgccgcctccgttggcgattgcttagccccgctcaccgccacttgttgctactcccctgcggcaaagagaagaaaaaaaaagaagagaaaaatgaaaggggaaagacgggatgctccgcgtcgccggccaccggacctcctctcccgccacaccgcatcgatctcctccccacccatcggctggcctgcaagagaagagtgagaaagagagatgaggaagggaaagaagaggggaaagagagagatggcgtggcatcctgacatgtggggtctacatgggtcccacgctgactcagccatcacgtcggacaaaaaccggggtcaaaaccaccgaaggatctattgttaccggttttgattagttaagggacaccggatatctggttttgcggtttgaggacgttttttttacctcgatgacaagttcagggaccttcggtgtacttttcctaattcacccatggtttccaatccctttcggcccaatataaggggtgagcttctgtgtcagtagaatagttagcgcacactttttccgttttatcgtataccaatctcagtccgactccccagcgctcaggcgcacccacgcgtgccttatgacgtccgtgccgctaattacataattagcaaaaattaccatcattagcattattttctagaaaacacatatacacataatctctatctctactattataaaaattaaaaatatttttgccagtactttggtacgtcatccattaatgagtcaattttaatttcgttcgcttttggaaatacatatctatatttgagttgggttttaaattcgttcgcttttgaaaatacaggaggggtcatgtaagaaatctctttcaataaaacttacatgctaacttgaaatgatcggacttctatttacagctcatgattttctagaaaaatatatatccaagcgaattctcacggtgacactattataaagattggagatgtttttgctagtactttggtacgtcatccgtgtataagtcgtgtttttggtacatcattcatatatgagtcggtttttaagttcgtttgtgttgacagaaaacacgtggcctaggagatctgcttaactccagtgcaggtccaaagctccccttcggatgttgttagcgtgccagttgatttgatcatgtaatcaacaagaaatagaagcaaagaaaccgtggttaaatctataaatgatagccgatcggctagatgccgatgacatatcatttatctttgagctgatgtcatctgtgtatcgatcggcagttatgaataagtaaagaagaactaaatctactcgatcggttgtagatattaacgatatatactcttatatcgatgtatacttaaatcaagtgattgggatagatcggtcaccatgccgagacagtataaatcacttagatcgaaatatatatcaataacaggactatatatgtttgtagcatagccgatcagatagatctagcatgtatcggctaatactccgatactactctatatcaagatattaaagcaagtataatatatcgagcaaaagcctaacattcttagacacatcaatatcttaatataaagggcagatttaacatatcattgaagcatatagaacaaatatagttaaatcagatacgatcggctgaaactccgatgctattctaatcggcaactagaaggcaggctagagatcgatattctaagcatgactcaataggtcaaactcaactgatacagcattaagtatgaaaagaagaacgatatctagacaatcaagccgctagaagtttcagagaatggtagatatctcatatactctagatcaacatcaagatctaacctaatcggctgccctctgcgtacagatattagccgatagtagattaggtggcgatattgctagagattatgtaagatatatgataactcgacgaattatataaataagattagagtatcataaagatggaagcactaatcctaagaacacaatccgtcataacgaattttacctcttgttgaagatcgaaatcgatgcagctcaacccgaaagcaagaactcgtcgaaacaaaactaaagcaaaagggtggcgatgcgtcgaaattatattgaacgtgtgtgttgttaattacatagggctcagggtctatttatacctgagaattacaatatatgcccataccggacacgactattatctctaataaactctaagataccaaaagtctttgcggcagacttttgcccacatttatctataaggaatttacataagatatcctaattaatagatataattgtcttcccaggactctatccgtgcgtggcaatcatcttgaagtacattaacttgaacccgatgtcgcgtacaagtcatattgtcgggatcggctacatcggcttacccagcccgactcagacccagccgatcttatcgtagccgatctagattccagccgattcctgctctgttttcaaactcgatctccgcttccgactttgcttcgatctaatcttctttcctgacacagatgttaccaaatttggttgttaacacatgccccccaagtccgggatatttgataatgttccggatttgccatgtaccgactccgagcaagtttcgcactccgccgcttttgaccgtcattccagcactttaaatactaactgttacccccgagaaatctcacgccgtgacttccgttttcaccactcaagcgaaacctcttctctctcttctccagcgattcccccggtgcaaaggcgatttctaggcaacttcctcctcgacgagatctccgcccgcaccaatgtcatcttccgctagcccatctggtgcgccatcagccgaatacgctgaggtaagttctcttcggctaaatccccttccttagcagcagatcgattttctcctacctcatattgctttccttctcttggttgcctcggatttgtagcatctttcccaccaagtcgcaattcccagtctgacgcatgaaaaccactactttttcggcccaatcggcaatcctgaccccgccgagttcattattggtaaaaccaacaggatccccttcaaattaaccaacccagatctatgtcactggaagaatactttcaagtcctggccgtctctagagaaagttccaccagaaaagagctggactacatggttcaaacgttgaaagttccaccagaaaagagctggactacatggttcaaacgtgtatcagccagcaagagggtccactgggatgaaatcggaatcggccaagcacttgaccttactatagccaactcggccaaagatgaacccctgatggcagctgcttcttacttctggtcaaacactattaatgcctttttattcaatcaagggccgatgaccccaactcttatagatatcagcatgatcacgggtctagatgtcacctcatcggccaaccctatgagcttgaacacaaagaaccaatatgacttcaagaccaaaagcataggaggttggtcaggctatgtagcggcatatatgggtcagggctcggtcactcctcgggaacatgtggcctttttgttaatgtggctagaaaaatttcttttctatggatcaagttgcggccccacaaccaactggcaatttctagctgaagctctagaaacaaagagacaatttcccttaggcaaaattctcctcggctatctataccagatgttgaacaatgcatcggctaagatagccgtcggttcagtagttggagcaggtggaccctagtggctgctacaaacctggttaaacctgatagttatgaaggttgtcaatcggccatccgtatcagaagctgagttcccaagactagagccgattgtaggggatgatggagaagagcgtactcatcggagatgcacatcatacggagaatacgcttctacaccaactgatgccggggcaaaactatcggttgaactgcttaaagattggttctgcagcttctatgaaggctttcaaaaagatgctcgagtttggttcctttatgaagattctgcagaacttgagcacccactagacttcagattcgaagacatcaaccacgaaatataccaatcgtccagggagattttcttagctgcaatcagcccatgcatccttcctgttggcattcatcaaggaagaaacatccaagcttcttacgaattctatcatccaatgagctcagctagacaacttggaatgggccaactcccaatcggcttattctttgccgacaagatccaatgccgaggagaaatttcatcgaccttgatgatgcatcagctactcaaccttcaaggaccccctctgggcagtattgacaacatagaactttgacagatggtggggtgaatggaagctgcatctattccaccaaccagcttcaatgtatatgacagacctcttctcagatgttgtccctcaagtaagtctttaactccagttgatttaaatagctgtttggccgattaatctcaactaatcctcttgatttgcagacaacagaatcctctcctccccgtcaaagcaacagtggtaaggatatccaatatgccccaggtttaattcctaacggaggtgggctatctcctccggttattggatatgatgcccccaagacctcagctcttcttcaagggcttatcagagaaccagccgatgccgacaaaaagaggaaaaccagatcgtcggctgtaaacatcgtagccccaactaagaagaagaagacaaagaaaaccaagccagccgatgatctgcctaccctagattcatccattgaacaagctctggatgaagagataattgaagacaaagttgatcaggctgcagccgaggtaagcgatactgaaagaacaccatcagcttcgcccaaggaaacccctgcaactccttctgctccggttcacttttcaagggtaaatatatctctttaatccctttcataattattttgtcctatagccgatcattcccaagtcttataattgcagaaaaagaagactacggtgaagaagaaatcggctgcaacaacgtctaaaccagctccaccagtaagatagttttaactttcattagttaatttttagccaattctggctgacacttatttcctttcagccttcccctcctccttctcctcctgtacaacaaacatcaagtgaccagaccccttcagctgtggggagtcatcacgtcgaggaagaagaacaaccagctgctcctgctatcccagtaagtttctttttgtctcaacaagcattcagatcggctatgactgtttctaactgcttctaaattgttgctgcaggtattagccgatcttttctcttttgacatcagagactatcttgatgaaggagaagaagataccacaagcaaaaccttagcccctttatctgatgatgtgaagaaaactctaggaagtatcttggatcggctagaagcatcatcgctagatagcctggtgattgattgtggctcaatcagggctcagctacatgagattcaggctctaatcccagatgagttagtcgatatcctcaccccagccgtttaacttgagcaacaccaattcaaactggaaaaagccaaattaagactggccgaacggcgagagcgcaaggatattgaggccactatccaagctaatcgacaacttgtgcatgaagagaaattcaagcttgatcaactatctgaaggcccaatcaagtctaatattgatcgactcgaggctcacaagattgaacacttagcacaacttgaagaatgcaacgctgagctggacatggaacacaaaaaactagccgatctcccaaagtctattgaaaaacagaaagcaagactcaaatcggctatcaagcatgttgctgatctgaccaagtctctgaaagttatccctggaaccgacgctcaggatgcccaagccatagaagaagtagagcagattaggcagaaggctatatcggccatccagcgatacttatctcaataatttttgtgtaataaaacttagaatttttgtaatcggctaatactttactgtcttaacaatcctttgtgcccattaatatgactttgaaatttttgcactgcattttgatatatatgtgccccccagttttacaatgtcaagagcattgataaaattatataacaactaagggcgatataacaatatcggccattgtacatcggcaaatcacaactgattacaccatgaaaaacaactaagggcgatataaccatatcggccatctcaaggcgatgtaaacacatcggctgtcatgcatcggcaacacgagccgatcatgcgttaacccaaacacttgggtaatatttcttcaaatatttgccattgagcgctcgcccatagacttcgccatcaagcccttgcaacatatatgctcccttagacacaaccttataaatctggaacggtccttctcaattcggcgaccatttgccgaatttactatcacgagtaccaatcggcaaaatcaacttccatacaagttcaccttccgaaaaatctttaggtaccactttcttattataatgccaagcaacacgttccttatccttggtaacctttgtaagggctcgcaattgcgactgaaccagatcctccctctcatcggccataaggttgtaatactcatcggctgttaaatcattttgtaactccgttcgtcgagagccgattctaacctcccatggtaaaacagcctcatgcccataaacaagtttgtaaggaggaacttgaatcgatccatgacaagccatcctataagaccacaatgcttcggccaaccgagtatgccattgccgaggataatcagaaattttccgcttaatcaatttgatcaaacttttattagatgcctcggcttgcccattagcttgtgcataataaggtgaagaattcaacaacttgatgcccacactatcggcaaactgaacaaactcatcggacacaaagattgaatcttgatccgtagtaatagtttgaggaagaccaaatcggtagattatatgctcctgaacaaatggaatagcatacccagaatcaactttcttcaaaggaatcgcctctacccacttggtaaaataatcagttgccaccaatataaatttatgtcctttactcgatggtgggtttgtcataccgatcatatcaattccccaacctctgaacggccatggcttaataataggattcatagccgacgctggtgctcgctgaattgctccgaacttctgacaatcctgacaccccttataatatctgaaacaatcctccagcattgtcagccaaaagtatcctgtacaccgaagcaaccacttcatcttgtgagctgattgatgagtaccacagatcccctcatgaacttcgccgattgcaaccttagcctgatcggcactcaagcacttaagtaatactccatcaatcgtccgataataaagctcgtcatccaacagtgtatactttaatgccttatatcttaatttcctagaagccgactgagatggattactcaaatactggtgcacatcgtacctccaatcatcggctgacatcgctgcaatttcaactttaacatctttgatcattggcttataccacgacgccccttgagctaaatcattagcttcaagattttgttctcgagatacatgctttaaagtaaccagccgaaactctttcattagttccaagcacttctcattataaaccatcaacgtatcgttcttgcattcatattctcatgccaattgactgattaccagcaaagaatcccccatgatttcaatggtatcaacttcaacttccttgagtaattgcaaccccttgagcaccgcttcatactcagcttgattattggtcgcatatggtttaatagtataagcaaactcgaaacatgcccccctaggggaaattataactaagccgatgccacaaccatgagtacataccgatccgtcaaagaataaagtccatggcactacctgaaccgagccgattgaatcatcacgatgctctacaataaaatcggctatagcttgtcccttaatcactttcggtgattcatactgaatatcaaactcagtcaaggaaaatatccacttcccaactcttccctttaatattggagccgatagcatgtacctgactacgtcggctttgcatataacagtacactcattagataatagataatgcctcaaccttgtacacgaaaaatacagacacaagcataacttctccacaggagaataccgagtctcagcatccaagagccgtcgactgagataaaatacaactcgttccttcccttctaattcttgaatcaaaaccgagccaattgacttctcaccagccgataaatataacctaaatggtattcctttctgtggaggaatcaaaacaggaggagagctgagatactccttaatattatccaaagccttttgctgctctaacccccaaataaactgctgatcggcttttaacctcaataagggtgtaaaaggttccaaccttccggacaaattagaaataaaccttctaacaaaatttatcttgccgatcatctcttgtagctctgtcttattttccggggctgaatcttcttgattgcattaacgctcctttgggttacctcgatccccctttcatgaacaagaaatcccaaaaactggccgggcgacacaccaaaagcacattttgtcggattcatcttcaagccatatttcctggttctctcgaaaactttccttaattcggctatgtggtccttcacttctttagatttgacaaccacatcgtcaatataaacttcaaccagccagccgattaaatcatgatatatataattcatggctctttgatatgttgctccagcactctttaaaccaaaagtcatgacgacccattcaaataagccgattgcaccagggcatctaaaagccgtcttatggatatcttcatcagccataaagatctgattatatcctgcgttcccatccataaaactcaaaattttgttccctgatgcggcatcaactagccaatcggccactggcattggatatttgtcctttggtgtagctttattcagatctcgaaaatcaatgcacaccctgaccttgccattctttttaataactggaactatgctagaaacccattcagcatatcggtagggacgaataaaaccggcatcatacagccgtttgatcttagctttaacaggttcaagcatatcagctttacatctcctcggaggttgctggcgtggtctaacccctggcttgataggtagccgatgttcaacaatcgatcggctgagtccgggcatctcataatactcccaaacgaagcaatctctaaactcttttaggagctctatcagcttggttctaaactctggaaacaaatttttgctaataaatgtcggccttggccaatcgcctggacctatgtctatttcttccaactcatcggccgacataaaaccttgatcttgcttgtcatcgagatcatcaactgtatccttagcgtagacatttgaaccctccacgacgccctcaaagtaatagcttgggttctccatcttcgattggctatatatcagaatcggacacttttagaaaatctccatcccagacttttccagataaacaatcaaggccatccatctcctaaagggctaaatcggcactggcaacattaactgacctgtcggctggcacgatctctatcttgttgccttgccattgaatcaagcattgatgcataatcgaaggaatgcaacaattggcgtgaatccaatcccttccaagcaacaagctgtacgaactcttcccatcgatgacaaaaaacgtagtaggaatagtattgctgccgactgtcagctccacatttagaacacctctggtttctgatggattaccaccaaagtctttgagcaccatatttgtcttgatgagatcctcggcgctcctacccaacttcctgaacgtagcgtaaggcatcaaattcaccgcggtcccaccattgaccatcatcttagacatcggcttcccattgacgtagctgtttacatacaatggtttaaggtgccgattctccgtcccctcgggtttctcaaatactgtctgttctggtgatagaaccaacttagccgatccctcttccacttcatcgacatcggcctgatcgatcccgaattcagctggcaatgtaaaaaccatgttaattggtgccgctataacactcttcccttttgccaacctcttcgcctcatcggctgcagcatcattggctacaggaacctaattcttaacacgccactcctgtcttggctttggtttcctcagccgatggttgatttcctcttcaacctcctgaaaacgctccctgtttctcaatctctggacccttcttttctgattcttcatgaaaataccagaaggacaccattgattcttcctgattacctcatcctcttggccacaatcttgattcatcggacccaatctctgatgaacaggaagtcttacctgccttagccgattacctctactatatgaccggctcgagctctcgatgatatcactgcacctagggcagttttcaatggatggcaacctcatcccttcgttccagcagaatctgaagaactcacaaccccaatgaggatcaaaaccatcgtcgtattcttcataatgcttctcctgctgcttgtcatacttcctctgatacttgttgataatcctagccgaattcacttgaaaaccctttgcacggaccctatcggctgcttgaccagctgtgtgcaccatattaacaggaaaaggattaccatcgaccttcatcggctttttggaatcgtcaaacctaatcttgcccccctcaatggcaacctggatttgctgtctaaaaaccttgcaatcgttagtagaatgagatctagaattatgccatttgcaatatctcttcttgcctaattcctcagccgatgggatcgtatgaccagcaggaagctgaatttgcttttctcggagtagtaaatcaaaaatcttgtcaaccttggtgaaaacaaaatcgtacttttcctcttttccaagactttttacccattggcatggtatgacctttttgctcctcacccattcggctgcagctatttcagaatcatcttcctcgtcatccgatccatacatgtatggacaaacatgattaactttcttagagcttctcctgacttccgccgacctatgctcatgcaaggttatcttctgtatcagatgcgataagctatcaaagtcttcggacgagaatttctctctgattggaggaatcataccctgaaaggccaaatcggctaactgagcatcagtcaaactcaagctaaagcatttgttcctcatctccctgaacctctgaatatactcgtgcacgggttcatcatgccgctgcttgatcgctgtcaagtcggacaacttcatctcatgaaccccactgtagaaatagctgtgaaattgcttctccaaatcgacccaactattgatcgacccatatggcaaagaagaaaaccaagtaaaagctgatccagacagagataaccggaataacctaactttcaaagcgtctacagccgatgcttcaccgcattgagcaaggaatcggctgatgtgctcataagtcgacacgccctcttgtcccaaaaacttggagaaatccggaactttaaaccgattagggagagggactctttcaaaccactcaagataaggctgccgatacaagcttccagtctcttttggtttaagcccaaattgttctctcattacatcggcaatcacgtcggcccacggtcgttgctgagctgctccttgtggctgttgttgcctagactcgaactgaccatactgagatgcggactggggctgaccaatccccctagctgatattgggcttgcgaggaaggaggctgatattgatagctcaagttacccccttggtaattatgaagattcggctggatgttgcgcaccaagtgctcaggaaccatctgaggcatcactgtaccgtccggctgtgcatggtgaaccaaatgttctgggatgacctgattcacaaactgatgtacatgctgaccaccaggtactgcgaacccggccgatgcattcaccgaccccgggtgctaaatcggctgaacgacctgctgtcttaacggagtctgttggatcggctgctgaggctgctgtcttggtggcgtctgctgaatcggctgcagaggctgctgccttggtggtgtttgctgagctggttgtacgacctgttgttggatcgattgtacaaccggctggattggtggtgtctgctgaatcggctgctgctgcactggatcaacgataggtggaggtggcagaaacatggcagcgacttgatcttgggttagccgattcgtagcctgcccgccatgctgtggctgatcccttgttaacaaccgagggttcaccggctgtcctggcgtcatagctagtgtagcaggcaaaggagtcgacgctggagccgtcggctgagttgtgggtgcaacggagggaactgcttgaacagatggctgaacatcggtgatcaaagatcgataatttggtaagacgcctccttgcaagtaaattgggcctgcagcctgatgctcagctatcgaaccatcggctattgtcttcatcatgttataccccggactgattgatcaaagcatgatgcacagcgtaatcaacccgatcttggaagttattgaaaaaatcttgtgctagttcattattctggtcaagatttcctccttgtggctcctgggcgccatcaccttgaacgccatgaactccttgagaattgtcgccttgatcgctcggtgagccgtcggtaccacctttagtactcggctgagccgagccgtctggagcttgtttcacttctccatctttagaataaccggtcccaggactatcagcaaccacttttattttatacttctgaacaagtgtccccttacgggtctgcataaatgagttcaggaactgatcccgtgcctgctgcagggttgcttcaaactccgccttctgctcaggcgtgaatttctctggatcgatcggcatgacgttgtcatcaatgatgtcagtcaatccctgcttcaacgccttgcctttaacggaacctgngctagatggtggtggtggctgtttctcggccatgaggaagaactgacgtctgacttcttacacgtcccaccaggcatgccaaaagcgtgttgacagaaaacacgtggcctaggagatctgcttaactccaatgcaggtccaaagctcgccttcggatgttgttagtgtgccagtttatttgatcctataatcaacaagaaatagaagcaaagaaaccgtggttaaatctataaatgatagctgatcggctagatgccgatgacatatcatttatctttgagccgatgtcatatgtgtatcgatcggcagtcatgaataagtaaagaagaactaaatctactcgatcggctgtagatattaaagatatatactccttatatcgatgtatacttaaatcaagtgattgggatagatcggtcaccatgccgagacagtataaatcacttagattgaaatatatatcaataacaggactatatatgtttatagcatagccgatcagatagatctagcatgtatcggctaatactccgatactactctatatcaagatattaaagcaagtataatatatcgagcaaaagcctaacattcttagacacaacaatatcttaatataaagggcagatttaacatatcattgaagcatatagaacaaatatagttaaatcagatacgatcggctgaaactccgatgctattcaaatcggcaactagaaggcaggctagagatcggtattctaag

SEQ ID NO: 70810 - DNA, 541 bp, Oryza sativa
ttcgcctggaagctaaatcacagcttgtccttgagtgaggcccagcgccgtcactcgcctccactccgccggaagcagatgcaacgtgagagcacggttgtctgccgatgacgtgaccggtgtcagaccagtcacaaaccggtcattcttgtccaccacgcgtcagtttagcataccacacgtctgcccttcttcatacaatgacttccttgccatggttgcgatgaagcctggaatggatctgaccgggactgacgtgccaactccaggagttaccacgccggctccggctagggacgagagccaggaagctctcatcattccgacgggacggggcgaggcgtgtgacaggccgcctgttgccacctaacccgcgatctgaccggtcggtgaccggtcacacaccgtgactggtcacggaccggataagcgtgcgctgcgccgcattaaatgcggcgtggcgcgctcgtccaacctgctataaatgcgggtaggtgagccccgctgtgctcacctaacccacacacgtggcgcccaaacc

SEQ ID NO: 70811 - DNA, 581 bp, Oryza sativa
taagtaaatgcctcatgtttccttgagcttgggtttgctgaactgaactgaactgaacggaagatccatttaagctaggacggtgtgatcgatcgttgagttgatgaacttggtctatggctagctggcttaagcgtggccttccaatcagtttgtattctcgtgattttctttttatgttctctatcagggcaagtaggttctgtagtttctctagtgttacagctgttggtttctctttcttaggtgtatacatgatgctgaatatgactaccttttatttgcagcgtgtactactgccggactgccaaagtacgcttgctgctagccatttcggtagcttttgtggtttctacttaactatcgtgtttggcaatacaacaccttggaccaaaggatgcttgaaagatagactggataattaagactggatgccaaagtacgcttgctgctagccatttcggtagcttttgtggtttctacttaactatcgtgtttggcaatacaacaccttggaccaaaggatgcttgaaagatagactggataattaagaactatattggactgtacattcggctat

SEQ ID NO: 70812 - DNA, 35492 bp, Oryza sativa
tcaagatctaacctaatcggctgccctctgcgtacagatattagccgatagtagattaggtggcgatattgctagagattatgtaagatatatgataactcgatgaattatataaataagattagagtatcataaagatggaagcactaatcctaagaacacaatccatcataacgaattttacctattgttgaagatcgaaatcgatgcagctcaatccgacagcaagaacacgttgaaacaaaactaaagcaaaagggtggcgatgcgccgaaattgtattgaacgtgtgtgttgttaattacatagggctcggggtctatttatacccgagaattacaagatatgcccataccggacacgactattatctctaacaaactctaagataccataagtcattgcggcagacttttgcccatatttatctataaggaatttacataagatatcctaattaatagatacaattgccttcccaggactctatccgtgcgtggcaatcatcttgaagtacattaacttgaacccgatgtcgcgtacaagtcatattgtcgggatcggctacatcggcttacccagcccgactcagacccagccgatcttatagtagccgatctggattccagccgattcctgctctgttttcaaactcgatctccgcttccgactttgcttcgatctaatcttctttcctgacacagatgttaccaaatttggtcgttaatagtttgcttttggaaatgaacttgagatgatcaaactcctaattgcagctcatgatttctagatagaaaaatattgtcgacggggtatacccgtagacaggatatcgagggtactggggtacgctggtacgaggatctatgtaatacgacatcaaggaaacaagagacaaagattatactggttcaggccccttagcaggtaatagccctaatccagttgatatgggattatatggaaagaaccacagattacaaagggagtagtagaactcggcggtaccgacgagatcgtagtcaagttgattcgactagatcaccctgcgacttggcccctgtagtctccaacttcgtaggctatggtcgttgtgtaggctctgagattcgatgccttaagttccctcggggggtcccttttatatcgcaggtcaaacggtctccaagtaggactcggagacaccggaccctgcacgatatagtaacgacccagtcctatacgagtagtaacctttccattggcagacttcgtgatggatttccttaacgtgttcagagaatgttcgtatatgcaccgatatactgtattgccgtatagcatgcattcaagggtagagggtataccttatccgtaaccctgacagtagcccccgacttcaacttaaatgaactcatgtaaccaatcgcgacttctaatgtcggaattgttgtcgttctcgactgatcgatctcggtgtgagggccgtagagacaaagagcgttcgacaacaccatgtgaagtccaacggttatgagtgaatttaaattgaagtccaagaaaccgcctcgcgcaacggacccagaaatttccaacggccacctctcttctttccttggaattcgcaccgtcggtagtgcgcctatttaagggagttttgggaatacattttggagtccgtcgtttgtgagaaacttcctgcctccaaaccttcttcatcttctccgctcccacacaaaccctaggttcgcctgccccggcttcttctccggcgatctcccgcggcaatggatctcgacaagtccacctccagccgcgcgtccttgaagaaattgcaagaggaaggcgctctccccggtcgcgggaccatggagagggaaacgggaggtactgaacctgaacccgtcctgggccacatggttgtggttgaggactacattctttgtggttttcttcccccgccttccgagttttttcttctcatcttgaacttctatggtctttctctgcttcatttgaaccccaactccatagccttccttagcattttctctcatctctgcgaggcctacattggggtagagccgtttctcgacctcttccgcttttactatgagttgcgctggacggaacctaaaaaggtgtctggatgtgtcggtttccgacttcgggatggcctgaagtcgcgatacatccccttccagtgcccctcatctcgcagcaaatggcgtgggaggtggttctatcttcagatagaagatttggatccagtcttcattgttcctgaggagcaaccagacaagatttcatcttggaccgccaaacctgccttgaccccatccctccaatctttcatcgatatcattgatgacctctgagtacaggggttgtcgggatatgaagtcgctgccgacttcattgttagacggctccagccgctccaggctcgagcccatccaacctttgactactctgggccggaggacgcgacccgggtttctcctcggggtatttttcttgtattttgggttcctctctttttatgctcattcttcctgacttgtccaaacttggttctcgatctgcaggtctgagcggcgcaaccgtggaacaccgtgttgcctaggtgatgattagcggtcccacgacggcgagcaacgtccccaccacaaaggtgatgtcaagatgaaccccgcacctgctccttggctgttgagcgcgccatcgaacgacattgtacagcactacacccgccgcgccaggcgccatgcccgctgctcctgtgtccgcgtccgcgtctgctcctggctcctcctcatgctcgtcttgctcgtcgtgcgctcacggccttcgcctccgtcgtctacctcgtgttcaagcccaggcagttggactacacgctccagggcgcgaaccttctcatcggcctctcggcgttgcgccaccgctgcgcctccaggtcggccagctgctgcgccgcctcttcgccgcctcctgcctgtccgcgccgttccacgccgaccgcccccgcccaccgtcagccgcaccgccgtgcgcgccgaccgcgccgtcccctgccttccccgcaccgccatgcgccatgccatgctgcgccgcctcggccgcctccatggccgggcggcacttgtcttctccatctcagccatcgccagcgccgcctcctccgcgtgccacgcctcctccagctgccgcccatccccgtcgtccacgcttgtcagcttgtggatgagagagagagaggagaagaggaagagggaagatgacaggtggacccccagcatttttttaataagaaaatgctgactggattgtcactcgtacgccacgtaggcaaaaccgctctggattgggtcgagggggtaatttgtccggtattgaaagttaagggtgaacgatgtctggtttttgggtttaggggggtaattcggacgaccacgatagttcaggggggtaattcgtactttttcctttctctttcgacaacaatgacaatactcacagagtagggcgtagcggcaatatagaggaacaattcttcattaggttggggagcaacaagtacagggggatttgacaagtagcgcttgagtgcgatgaacgccttttcggcttcttgtgcccatacaaatttgtcttgcttttttagcagtgcgaagaaaggttgtcctcgttctcccatcctagagacgaacctacttagcaccgccatacatccggttagcttctgtacgttcttgagccttgtgggcgacttcatgttctcgattgccttgatcttctcgggatttgcttctatttctctgccagagacgaggaatccgagcagtttgcccgacggtaccccgaacgtgcacttctcaggattgtgcatgaggcgatatcgtctgaggttgtcgaaggtttcccgtagatcgtcaatcaatgaatcgcatgtcttggttttgacaacgatgtcattgacgtaggcctcaacatagttacccaactgatcgctaagtgccccttggaccgtgcgctggaaagtgttccctgcggttatgagtccaaacggcattttgacgtagcagaatacaccgaacggtgtgatgaatgctgtcttcttatcacagcctgaatttccgtttcaggatttataaattatttaataaattattaatcgaatttatattaactgttcattaatttacaagtgaagttaaatgtgggaaataaaatttccttaatttaaagcatggatggatttaatttatattaaattctccatgattaattatactctctgaaattttctcggaattttcggagctcaattcctaatgttaataatacaaagaacagtttagcaattatttaaataataaattaatcagtaaatgatctggatattattatattaaatactttgagtgtccatgtatattcaagatttttcttggaattgtttgagcattgaaagtatttttaacaattgaaagatcatctcattggttaatttatttggaaaagtaataaaagtcctcctcctcagcttgggccgaatccagcccattgcctccccttctctctcccttcctctcagcccgcatagaagtctgcttttcgtccctgtcgctacagtgctccttcttctacctccagacagagcccgagctctccagcccgtgcacagtgccgccgcctcctcccaccaatccggccacatcgttgctcctttctccaaattagttgtgggaatggaatcctctcaatctcctcttccttttccccaagaaatccccaaaagtttatatggaaatccttttcaatttcgcggctcaacctttcctttttccggcgaagatctaaactttcccgagtttttcctgtcgttgtgggctcgatcccggccttccatggctataaataggaccccctagtcctcctctttcgtttgcccctctcccgtggtctcccgtgccccgtagcctctccgccgccgcctccgtcgtcgccgccggtcgccgtcaccaccgttaggtgcgcgggagggtggagaagctcggccgctccctccccgctgtcgccggtcaccggagccccgtcgccgccgtcgaccgaagccgcgccgccgctagacctcgtcgccggccgtcgtcgttcgtcgtttggttcgagggtgagtaccgttgggttcgtctcatcgtcctctacgtgttcatgtcctccaaagtcgcagccgaccatccaatctccggcgaggtcgccatcttggtccggccattgatgaggtcatcatgacgtcatcatcatttttctttttcctgtttttctaatagattaaatcttcggaaattcataactaaatcatcgtaactcggttttgagtggttcaagttgctaaattcatctaaaatcatgatctacatgttaaaaatatccacatgtactgtttatgcttgtttttgtactgtttatttggtttctattagtctttttcttcgttttgcgtgttagcttgtcgtttccgtcgttgcgaaggttcgtgagtgcgttgggagtgttcagaagattaattgaagaccgattattgcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagttatgattgcttagccatacttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcacgacgcatggtagacatgatgttgaggctgtgtcttgtgggtacagtggtatacctctggccagagtaaaactattcgaatagccgtgcccgcggttatgggcgggttgagcaatgtttttcgtgattagtctcacgcctctcacaataattattgatgttatacctggtaataatttgcttagctcctggtttggagttagatctgtacagtcgggtatggttgttcaggatggttgggcctgtgcagcatgtgtgtgctgttcagtgttgattaaaatttctgattaattactccactgttttacttctcttaaatgttttgctaaatgctacttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggacgaggattttatgcacaaattagttcggaaattattagtgaatttccgggcgtgacacttctcctcatcctctttcgccatgctgatttggtggtagccagagtaagcaccaaggaagcttaacagctcacaaccagctgttgagtccaccagttggtctattcgagaaagagggaagtgatccttggggcacgccttgttgaggtcggtgaagtcgacgcacatcctccactttccgttggccttccgcaccttgactaggttggctagccactttgatggtgtacctctctgatgaaaccagccttaagaagtttatcgagctcttcccgtatggtctgcttccaatctggtgcaaatctccgcagtttttgctttactggcttggcatcgggtcgcaccataagtttgtgctcaatcacctccctagggaccccggcatgtcggacggctgccaagcgaatacgtccgcattgtcgcggaggaaggtgatgagcgcgagttcctatttctcgttcagtgatgccccgatcttgaccgtcttgtcggggttggcactggagagtgggacgattttgattgcgccgtctggtttcggcgtcttagttgttttgatcactttcttgggtggctcggctgtggcgggtgggctgggagtgtgctcgaccatgttgaggctccacttgtcgtattggactgccagctttgcgttcccttggatagtgattgttcccttcggcatgggcatcttgagtacctgatacgcgtagtgcgatgcggccatgaacttcgtgagtgccgttcttccaatgatggcgttgtatgctgtgtcgaactcagcaacatcaaatgttatctactccgttcggaagttgcttgcttggccgaaagtcaccgggagcgtaatcttgcccaatggcttggacgaggattgaggggtgattccatggaagggttgatcggtaggtgtcaactcgcttcgtggaattcccattgcgtccaaagtgctggcgaagagaagattgatggagctaccgccatcgacgatgactcgcgctactttgatattccgaatagtgggctcgaccacgatcggatatcgtcctggtataacagcagccttggggtggtcttcatctgagaattcgatcttctgttcaaaccacttcatcttgggtgcagccccctgccatatcgaacaaacctcacgctccacttttttgtattctcgctttgaagagtacgctgtggaacctccgaagatgtgtgagacatgaagatcggaatctgagtacacggagtccgagtcctgagtagttgtctcagttgccttctcgactacacgtactcgcttgctcttctccaaagccagctgcctttccaacgattttttgaagatgaggcactcctccagagaatgtctgtccgacttgtgtatggggcaccatattctctttgtatcactgccctgtgggtctgggtgtttgggcgggcgctcgtattcagatgcaaggacttctgcttgagctttcctcttcccactcttgccgcttttcttcttgcttgattcgggtgcgtccttggctggcttcttctctcctcccgcctttggtttgtcgtttttgcgtctcagcgcgtcgtctgcgtgggcacatcgatcgacaacctcgaacagccttcgagtagtagtgattcgccttgttgccaactcctaggtagtatagcaatctctaacacctgttttgaaagcgcggatcacaaaagcatcggtgataccgggatcgtatttctgcactcattaaagcgccggacatagtccctcaaagattcaccctgattctgtgttaacgcgtgtaaatcgtcttcgatcgcgtggcgcttgtaagttccctggaagttcgcgacgaattgttgccacaaatctgcccatgaagagatcgagtaaggtgggaggtgcatcagccacgaacgtgcagaacctttcaacgccgttggcaaatagtttgctaacgcgttgtcgtctgccccaacagcatatactaccgtggagtagacttggaggaattcctcagggtcagtacttccatcgtacttctctattgctccgggtcggaatctttcgggccatcggacatcacgtagagaacggttgaaagctctacacccagcgctgggggcagcgggttgtcggcgatcgtgtgtcctccgtggacgtctatcggatgacgtagacgaagatgatgatgatgatgacgatgatggctcactcggctccggcgtgcgattccgagggcgacgttcaggttctcgagaattctgtcgtcgtccaccattgttgtcctggcgccggtcaccattatcatcttcttcatgtcgatgtccccgaccattatcttctggtgtccgctgttcgcggttatcgcgatcgcggcggttatgacgatcacggtgatgttggtcctcgttcgagcggcctcctcgctcctcgttctcgcgatgtcgtgaggaaacacgatgtcgggaacgattctcattgtctcgcgcgcattgtgcttctcggcggccgttcagatggttgcggagatcgccggtgccacgaggtggaggggtagctcgtgcaggcgacgtccgctgctccggtggttcaccgtcggcaccgccaaccgtcggtcgttccggttgtgctctggtagcagcctcctcgaatgtgttactgagattggccaccgattcccgtagtcattccgttcatcgcgcgaggtcatcgttaagcacggggtcatagggagcttctctcaatattgcattgacggtgccgagatgttgggctggcgtggccgtctggttctccgcctctgcattagcctgtgtagacgtgctagttccatcgatggaaaatacgtcgcgtggtgtactggaagatgatgagccatagtcttcaagcaagtgaaggactgatggttcgcggggatcgatatcgattactccaacgaaactatccgaagtcaacgtcgctccttgttccttgtctgtctcctcgagagaggttcctgactgttggaccttgggaagcgtcgtcttcatggcgcggagaaagaccttgcagcttgagaagtcgtgattcttcgtcttgtgaataggacaatagacatcacaagttggagaagtacgttggattccacgctatttgcaagtatggatttcggcttgtgcgttgagaaaaacccagcaagcttgcaagttgtgcttcctggacttgtgaataggacaccaggacttggtgacctcggaagttgtcctcgtcggctcgcagtccttgtcagaaggacaaggcttggtcgcgctaggaatcttctcggggtcatatgacgtcgatgttccgttctccgccacggcgggaggatccttcgacatgggaccgtccgggtttgtagccatggcgttctcgtttccggttattaatggaccagccgagattggcaccgtggtgtaaaccgggaaaacgatttcgccgacttgagtccacaccagcattgttgaagtagggattctttggatggggccggtgttggctctgttgttgacgaagctcgatgtcatagtagtagaatcttgagcaccaagttcccctacctggcgcgccactgtcgacgggggatacccgtagaccggatatagagggtactggggtacgctggtacgaggatctatgtaatgcgacatcaaggaaacaagagacaaagattatactggttcaggccccttagcaggtaatagccctaatccagttgatatgggattatatggaaagaactcggcggtaccgacgagatcgtagtcaagttgattcgactagatcacccagcgacttggcccctgtaatctccgacttcgtaagctatggtcgttgtgtaggctctgagatttgatgccttaagttcccccggggggtcccttttatatcgcaggtcaaacggtctccaagtaggactcggagacaccggaccctgcacgacatagtaacgacccagtcctatacaggtagtaacctttccattggcagacttcgtgatggatttccttaacgtgttcagagaatgtccgtatatgcaccgatatactgtattgccgtatagcatacatccaagggtagagggtataccttatccgtaaccctgacaaatatatatccaagcgaattcttaaagtgaatttcatctcaactaaactgtatagcaataataaaattaaaatagccttcacccgttgcaacgcacgggcattttttctagtttatttaaaaatatgtagtaaaaggatttcaaaaattgagtaaaaagtttaaatttgaattgaaatatttgaattttgatgtatgaaatttttccatttgagatgaaaattttgaattgtgtgctaaaagtttctttaaatttgagtttgatgttatagaaaatactcctccgtccctaaatataagaaaaatgcatatgttgtagaggaacaaaatttgctaatatacttatttttttaataatttatgtatatatacatatatcaaacggaattacaaaaatatactcgtcccctgtcccgtggagcgcgacgatcccataactccaaaacacgggaccgacggtaccgcggaaaggatatgcaggaccgcgacggtcccgcaggttcaaaatgcaaaggcaaccagcgatttttaacgttgtgtagcactgtttttaaactgttcttactgttttgacactgttcacgcgacggtcccgtaggctcaacgcggtccatgaacagtgtctaaacagtgttgaacagtagcaaacagtcacgaaacaatatcaaacggtgctgatgcagtaaataaatcgttggctgcctcgctccggcgttttgaaaccgtgcgaccgtcgcggtcccacgcgaacgttgcgggaccgttgtgcccctgcgtttccgtcccacggaacggatatatttttttgtaaatctatctcatccaggtatataaacataaattattaaaaatataagtatatttgtaattttttttcgtgttgtagaggttaaaaaaacgcacgccacttaacctcctggcgcgtctgcggtaattaggattctcgaatataagttggctccacacctcttcaaagaagcggcccagtcacgtgtccgatacccagggacctatcgcaatcgtttggattggcctactgtactgggttaaggagtcttctgatctttgtgcacgtccccatactctaattttaccatgaaggaaacctaattacacccaataaataatataccatttaccattattgcaattctctgaatataagagaagtcccgaaacaaatttggtgggaaaagaagaccgaattattccaagctcccaacagtatgttgcgacgaacaccgcagcgcaggcacgcaaaagagactacagcagcaaaacgcgacagctaaaacggcagtaacactaacagcagattgacttcattaacagcaggttgacatcgagctcaagcgtagctttcggcgatgtcggcgaggcaccgcgccagctcgtcgggcctcgagagcatcacgaggtggtccgccgcatcgatctccttcacctcatccaccgggctgttcccgatcatccaccgctggaacccctccggtatggcgaggtcctggtttacgaccacgtacaccttccgcaccgagccgtagcgcccctcggtgaacggctgctgcttttgcaggtcctccacgaacatcgagctcaccctcagcagagatcccgcgagagtgacgtcctgcagccggacaaaacgattgattagttttgtcatccagtatacgctaatacgctatgcaggctcgaaaagtcgaaatgaaataattgcacgtgcttgtttctattataaaaccagtcccaaaaatcgacatcggtagctaaatgcggaaaaaaacgccatagaagatccaaacatgatgacgacaccgagacacaatatttggtaacggagttcagctgtggcctacatctctgggtactgattacgggtgctcctccccgatccagcgtatcagagttacaatgactcacagccggacgccgccggcagccgctctctctccctatgctaagtcgctatacagttacaacaggtacgtccttctatttacgagagatcctaatatagaatccgactaatactttaattctaatacctattacaacttcaagttctaaactgtaaccgactacatacacaaattcgacacaaactctaggagcatatacaacttttttttcctagaggatatataaaacttgtttgtgataagaagcgactagctggtgcttggccgagtccggtagtgaatggacaatgatggatcatagactggtctatcaaatctttatctttacctttatctttacctattataaaaatttaagatgtttttgccgtagatttcgtacgtcgtcgcagtagtgcacgttttatttatccggccgactcctcttttatccgactccgtctccttatagcatacgtacgatttttttatccgactccgtccccgcaccaatcagtgaaaacaaaataaaaataaagatgaggcacacgcaagttgctagcttcaggtaatatctgtcgttccttttttttatatagaatccaagtaaatcaagtattgctttactcggatagaaaaatcagaatcataggctgagtaaatcaagcctattctttacattacatctttatctttacatattataaaaatttaaggtgttttagccaaaaaattttgtatgtcgcccccaaattggaaacagcgcaaaaaagcaaaaaaaatcagatcggagatggaaaaaaaaatcggatcagagatggaaaagaaaaggggagcagccaagcaccccccccccaaccctcgctttgcttctccaaatcccaaatcatcgcatcgcaatccaacacaaaaacaaaatcccaatcggaatcatcacaaaatatcaacgagataaaatatcaacacaaaaagatgaggagaggagagggaaggtcgagccagaggcgccgctgctccttgccgaaccaccacctcgccgcctcgctgttgtggaggtgccgagctcgggaggatcctgagccgccgctgccactagggagccgtcgacgcgtcgttgcgccgtcgttgagccggggatccgccgcaccgccgctgcgccggagatcaaccgcgccgccggaagccgtctacccgccggatcttgagaggagcggggcggcggcggcacccagacgaggaggaaagggagcgccggtggaggtgagggagagcgccgatgggggagaggaagcggcgccactgcgccacacggtggggagaggagagacaaggggagggtgggaggcgcgttggcccgtagtagggggagaagggaggagttagggttagggttttataaatttggaaccgatccgagccgtccatcaaatgaacggcttagattgatcccaagttgggtcgtctcatgggccgcatgcgcgcgatccgcacaggaaggaataagtttactttagatcctttatctttacatcgagtttaaatcacatccctaaaccacaaatattttaagtattttctattttcagaaatagcattagtaccattttagttgcttaaaattgctgaaaaattatgaatgtttttctgacttccatcctcgggccgtagcacagttgggctgcgggcgcttcaccggctgtgtgcgcgaatgaactttctttctttctatctttcgttttataggaatatattttcttcaagggctcataacacggaaaactggaccctaatcagctaatatcttataattgttataattttagtttacccattgcaacgcaccggtattttttctagcaattaataaaaaacaaagaagacgataggtatgtgccaacaaaaataatttcagcttgcagtacacatgctaccaatgaatctgaattgtcgtgtttttttatggctctgcaattttttcttttatagtacagtccatggcacgagtaccattttgctggtgtagacattttgggtgtgtttagatggtagagaatttgggaagttgagagaaatttgatagtttggagaaaaaggtgatagtttatgtgtgtagaaaagtttctgatgtgatgtgatgtgatggaaagttgggaatttgggtgtaactaaacaaggcctttgactagctaagcgatatgcactagccgttcctatcgttctctaagagaaaaatgtggcctgagggctacatgtagctagctgatactatcatgctacatgctgatttgattcaaggatccaccaaacaatcatcaatccctttctggtcccctcttggctaaggctatattcttaggagcttgttcccaacttactattctcgtttttcacgtgcacgctttttaatctgttaaatgatgtttttttacaaaaatttctatacgaaagttgcttaaaataatcatattgatccattttttaaaaaaattagcaattacttaattaatcacgtgctaatggataattccgttttccgtgcatactgtttgggtcgggaaccggctggattgaacacagcctaagagcaagtacaatagcaggctataagccagctataacaatatatcgagaagaaaagggaagagagaggagaaagcgggctacagatttgtagcaagctgcaacacggactcaagacgttgcgtgtgtatgagaggtgggaccggatattaatggtgtagtatatttttgtatgtaactattatatgaatggactattagattagctatgaataatttgaagctaacatttggctatactattaaacttgctctaagaaagttttatactccgtaattcaaaaatataagatataaccacccttaatccaaaaaccaagaaacaattattatcacctcattatttgaatcatcctaataaatacaatgcatgcacccagtagaatatatgcatgcacatctaagaaaaataggtgtgtcttatattttggaataatgggagtagcagagacaaccatgagcttatagttaatataatagttaatatgtcctccctccagttgtaaatattgttgacgtattgggatagaaccaaactatgcaactttttgacattttagtctctgcctattcataaaggacctacttgctcctacatgcatgcatcctattactccatagtgctacatctctcgaacctggcatgcacagaagcttagtgacaggttcataccacctactccaattagcacaccgccacatttaatatgggtaataaatcatttcttggtacgtgggattatgtttaaatcgtcaataaaattagaacaagagggagtatagtagataaactataagattgtctttatatttttatctcttctctctttctctcacttatcctatcttactataaagttatcctccactaactctttaagcttaacatgcaaagatgccacatcatcatccactaacaagatgccacatcatcatccactaattaataagatgccacatcatcatctactaacaatcatcacatttaaacatcatgcaaacatgctatatctttataatttttataatttaagagcttttcaaatacaaatatgttaaattatcatctaacataattcacataatatttcaatgtatatctttattatgttttatgatatcctatatacttatatagttcatcctcactttactttattagtgtttaaatgattaatctatggtccaaattatctttctctttttttcctctaactaagtcatatcacatcaattgtttttagcctttagataattaatctacggtccaaactattttcctacttttcttctttcatataaagtcataccaccttactttttatgtttgaatcaccattctacatactatttaaatttaaataatcataaactacattaatttacttaatctgatgttatctagctatcttacacgttatttttttattattatcatactaaattttcacaacaatgcgcggggtttcacctagtatatttaatgcatttgtcttagagtatgcgaatagctagctcttatatgagaaccaaatacttttattttttttatttatttctcactctttcacataagtttataattagtttatagctacatgcaaaaaaaaataatcctcatccttcccatttccaaagtttctcgaggcattaaaatccacctccatagacgtggtgaaaacaagcgcgtacttacctctggcgagcacagctgcatcagcctttcttgggcgatctgcggcccgaacaacatggaagtggggagcttgccctctgcatcctgcggcttaaactccgtgtccatccagtccagccacttcccctcgatgaactttgagagagcaaagcaagacttgagagtaaaattcatgacaaaacagaagtggatcgatcacagtttgagggtcaattctacatctacaaatgctaggtaaaaagctgtattatttggggagtttctgacaactgaaaattctataagaagctacagctggttgaatctccccaaacaagccctgagctagcatttcgagagcccctcggctgatcagcaaatcttagcaggagaaataaattaagcagctatttgataggcaaaaaaaaaaagaatggactcaccttttcgagcacgtgcgacggccgggacgtgtggtccggcatgaaggcgcagaggaacacggcggcggcgatcttgtccgggaacagctcggcggccagcgcgacgttgatgccgccgaggctgtggccgacgaggaccaccttctcccctggagggagggagccgaggaggcccagcagcggcgcggtgtagtcgcggaacgtcggcacctcgcgcagcggccgcgggtcgacgcccgacgcgccgaggtccggcgcggtgacgcggtacccggccgaccggagccgcgtcgccaccttgaaataggtccagccgccgatgcacgcgccgtggaccaggacgaggtgcttgcaagctaccttgccgtccgccatgggtggtacaggaggtgtatcacgtatggttacgtagtccagcctcccgcgagtcgacggggcgacctctacgatcggcctaggaatatatagaccccccatggggtcatatactgccgaaagttcaaactggtggtatgaaaatgagattttacaacctctcattcaaatttcagattagggaatagggatggtagtgggatgacccatatgcacgggtaataattgactcgctttagttcattcaataattggcgcactttagttcatttaaagtggagtatatatataaaattttacttcctcaaattatttcagctcattaagattaattttaaaaaagcttatgataaagttaaatggtcttttggacaacaaacgttgagaatgaaaggcttttctcctaaatggtgtgagtggatagcttcttttattcaatgtggtcatgttggtataaaagttaatgatcaaattggtaacaattttcaaatttacaaaagtcataggcaaggggatcttttatctccaattttttttaatatagtagctgatatgtttgctttattaattaagagggctaaagaggcgggacttttgaatggggtaattcctcaacttgttgatgatggtttgtctgtcttgcaatatgcagatggtaccatcatctttttggagcatgacttgcaacaggcaaagaatatgaaattgattttatctgtatttgaaaagttgtctggcttaaaaataaattttcacaagagtgaattattttgttttggtcaggcaaaggagtgttaaaatcaatattctaatatctttggttgtaagttaagttcttttcctgttaaatatataggaactccaatacattttaggaagctttcaaatgaagagtggaaagtttctgaagaaagaattgagaaaaagcttagtagttcgaaaggcaatcatctgtcagttggtggtagattggttttgattaattctgtatttttgagtttagccatgtttatggtatctttttttacataccaaaaggggttcttcaaaaagttgattattatagatcgcggttcttttggcaaggggataatcataagaaaagtacaggctcactaggtgggatattatttgccaacccgagcaccaagggggagggggggtctttggatacataatttggaaattcagaataaatattttttaagtaaatggttgtttaagttaattaatgaggaagggggttggcaagacttaataaagagaaagtatctttataataagtctataacccaagttgacaagaaacaagaattggtctggacttatgaaagtcaaaagtactttcttaaatacgggttcttggattgtcaatgatgggaaacaaattagattttggaaaaataaatggctaggcaacttggctttcaaggataaatatctatctttatatgctattgtccgaaggaaatcgtcttctattgccactgtcatggaatctgttccgcttaatgtttctttcaaaagagctttagttggtcagaatcttgttaattggtatgagttgtgtgcttctattgtacatgtccagttgaatatttcttctaatagctttagatgaaattatcatcagaattgtaagttctcggtaaggtcaatgtacctagctttaattaataatggatatatcgagaggaataagtatgtttggaagcttaagatgccacttaagattaagatcttcatgtggtacgtgcttaaaggggttgtgttaactaaggataatttggcgaggcggaattggaatgacagcttgaggtgttgtttttgtatgaagaatgagtctattcaacatctatttatggattgtcattttgcaaagttcatatggagagtaattcagttctcttttggttttaaccttcctactagtatatctcatattttttatgggtggcttttcggggtagataagaaaaagagtaaactaatacttgttggagcttctgccatttattttgcaatatggttgagtagaaatgatatgatatttgataaatcaccatcaatttcctatatacaggtaattttcagggtaactcattggctccggttttgggcacaattacaaaggtgtgatgaagatggagactatctgaaagttgcatgtcgcaagttggagaccacagttatgcaactttttgccaattatggatggagattcataaatagactacaatgaatgtgttatccttattttagattgggtttttctttatcctgtttggtgtgttctatttgtttggaactacactcttttctggagtgctactatgtaataattggttgtagctctttttgagtaaaggccaggatattatattccattatctaaaaaaatttcaccagctcatttagtttgagttattttcagcaactcaaatttatagcttccttgttttctgttagcacgtttcctgaaatgctacaaactgtgtttcatacaaaaagtttctatataaatatttcttttaaaaaaaatcaaataaacctatttttaaagtttataataatttgtcatggttatagatactacatacctaatagtagttgattaaactcgacagagcccaccacataccatgtcttatatggaaacaaacctcgtatatagaaggagttgcggataaggaaggacaagaagagttctacatgaaaacgacacagactactcagatcgtatccatatttatctccctagttttacttggacaagggaacctatgggtataaatacaagctcctagggtataaatacaagccccctagaaggagagatgacacacccaccatagacgccacaaagccaccagccaatacaaaccaacacactaccagatatcgacatcagagattagcatagacaaacccaatccaatgcatgcggaggctgataagagggatctagcactatctctgatctcaacgagttcatgctcaaggaggaagactaccctgtcatcgactacgagttggttatctagccgccaagtcgacgacagctagatagtttatccagatgaataaagagcaacaccggcttcagccaacgggatgcagggctattacctgtcaaataaggggcccgaacatgtataaaaatccctgtctccatctcttttacctcaatctcgcatataccttggtaccaacaatccccataccatccaaacaccctagtcgcaataccaaacgtcgacataattaatattcaattaattatatgctattgacttctctaatttcacgtgctgacaaaaaattccaccaaattggaacatgtctttaaccccttaaactatttatttactcattttacactctgaactattgaaaacaattcatattactcttaattctatttctctattttgttttccctatataagtcgcattttacatcaaaatttggcacgatgatgatagatgtattgcacttacgcttgaatatttttttttatgatttcctttatgactgtttacattggtggaagcgcttaaaattgattgaaacatcataaaagttcaaacaaacattgatgagaaaattttaaagtatttttgaactttgataatggtgtcatgtatgtagaaacatgtagattaaatacatcttatataaataaaaaatataaatgttattacagagtaatatgaatcatttttaataatttaggggtaaaataagacaaataaataatttatgggattttaccagtgttaagtgatcaccgaggaaacaaaataatatttttagaattaaatgaaagagtatttaggctacaacgcctgctgctccaggcttctcacaacggagacctgagccacccgcttgaccattctctccagtgccccatcttgcagtatgccgacgacagtctcatcatcttgccggcagagcaacaacaacttgtggttcttaaagctatccttggtcctttctctgaagccaccgggctaaaaattaacttccacaaaagcaccttcctccccattaacgttcagcatgacgaggcagttcagttggcggggattcttggttgcccctagcttccttcccccaaccttacttaggcctccctctctctggtaccaagttttgtcttgcggactttcaacctctcatcactaggattgacaagcagcttgccggttggcgcggtcaccttctatcttccgatggtcggcttgcactcatcaattcggtgctctcagccctcccatcatacatgatgggggccatccttcttcctaaaagagtgattgccgctattgacaagcgccgaagggccttcttctggatgggggaagaaaactgtcacagcggcaattgcaaaattgcatgggacaaagtttgctctccgaaagaaaaaggtggtgctgggataaaaaatctcgagatagaacagatgtcttctctagaaatttctcctcaaaatgcacaagggtgattctgtgccgtggatcgactgctttcacgatcactatggatggtccgccttgcgtgacctaggcgatctttcgtggcttgacacgatcatctggaaggacatcatcacgggccttacacactttcgcagtgtttcgaaatccatcattggagatggtcggtccacttccttctggtttgataattggattggcggtgacgccctctttcaactattccctgccttgttctcacatgcaactcgccctaacatttctgtcgcggaagccctagccactcctgaattgctccttcatcttcggccccgaatgtcgacgatggccacacacgaattggccaatatccaagccctggtatgccacctagtctagacccagagacgaaaggcagatgcaccttgtccacaaatcgccccctcacagcaaaaacaacctacgacttaagcttcttagggttaccagatgaccctttcgctaagcccatttgggacaaccaagctcaagtcaaatgcaagatcttcctttggactacacacaagaggcgcatcttcaccaatgagagacgagctcaacgtggattagcagcatccgcacgttgtccattttgctcctctgatgaagatgtggagcatctcttcctacgctgtgccgaagtggcaacaatctggcacacctttgacctggacgaacaacagatcgcctccctgccgcagcttgaaggtgtctgggacatccctccacccggacaacccgccactccacgagtctggcgcactatcatgcttgccgtcatgtggaatatttggaaaggacgcaacaacaaggtcttcaattccgttgacgaacccgccacgttagttctccggtgttgtgctagcgacattgatctttggtcccacagatgtaaaaatgccgagagcaaacaacagctccgcaactgggcctcatacctctctgtaattaactcttaatttaattatccccctctcatcccctgtaacccctctcctgcaaatctttcttcatttcaataaaagttcaggctggtgccttaaacacccgctgtagtttccctcaaaaaatgtatttaggctaactattagcgtacatcgtctttgggcccatccctgcttcaaattgatggtatgaaaatgaatttttaaaacgtcttgtatgcgaacttattatctatcctactttcctacataagaaacttatcatccataccacaatggtatggctcacctcattttcgtgggtccgctataaaagacattgttttattactagaagctaaaacaatactttgtgctttaccaacggaaccagagccaacccccaacccaaggatatgagcttcacaagaatcacaaccgaaaaaaacttactaaatggatgaaaatcgtatctacctttaatttgtgctccaacattatcaatattatttaaagagagattaaacataagaatcttccctatcacacatcaagggactcataacgttctgatcctttgcactcaaaagactagctcgattagtgagaaatgtcgctaccattaagtcgtgctccccatcatgaaaatcaaatgtgaagttaaacaaaaatattatgatgtagtacgacaataagtaggtcccactattggtgctttacatcttggatattttttatcttgatattctaggtaggcctcgatatacatatgatgcaagtcaaagagataataaaaagaaagaaaaagtgttgcatagggtaggagaaaagatgtaacgttcatttttccttctttttcatgtgctcaataaatttgccaacggtcttccctggcctggcaaaggataaggaaagaaaaggataatcctggcgaacagaaagggattgctttccagaatcaatctatctatacctaataaaaaaatacgtaaggcttccagttgttattttcgtccgtcgccccgatatggttgccaaaatccgttttaatccgcttaataagtcaggtcggacattttccaatctactcccaaacctcggttgatatagaatatgtatcctctcatgtaaccaccaataacaagtagcaggttgcccacttggttagtggagaaaatcttgaacctacccaccagtgtttgaattccaccatcctctcctttttacacctattattactttgcctctccttgctcggaataagtctactatgcctcccaacatctcaaatccactttgcctctccttgctcggaataagtctactatgcctcccacatctcaaatcctagactagattgcttggataagtctactatgcgtcccaacatctcaaaacctagattgctcggaataagtctacttgcctcccatttgaaaattaaacatatatttttttttattttgtcatccatctcaaatcctactcggaataagtctactttgcctctcactgtttaatttgaaaattaaacataattattttttttctttttgtcatctaaaaaacacgacatattagagtctacaccatctatttgcacctctttcttcaacagatatttagtgatttactttgcctctactagctagattgctcggaaataagtctacttgcctcccacatctcaaatactacttagaataagtctactttgcctcccacttttaaatttgaaaattaaacataattattttttcttttcatcatccgcaaaacacgacatattagagttcgcgccatctatttgcacctctttcttcaacagatatttagtgattctgaaaacttataatgaaccagttttaaatttgaaaattaaacataattatttttttcttttcatcatctgcaaaacacgacatattagagtccgcaccatctatcgtccacgcatgagccgtgaaaatgattcgtctccacgcaagtccatgttcaattttagaaattatatcaagcacttgccatgcatccgatggctgaaaaatcaaaagttttgcatttctttcttcaatagatatttagtgattctgaaatcttataatgaaccattttttaatttgaaaattaaacatattttttcttttcgtcatctgcaaaacacgacatattagagtcctcaccatctatcgtccacgcatgagccgtgaaaacgattcatctccacgcaagtccatgtttgattttagaaattatatcaggcgcttgccatgcaagagttgagagaaagcgcgtgttataaaaatatgagtatatcaatatgcagtagtgtttcttatcagtcttgattatcattaacccaatgaataatttatctattttggaacattattatatatatgttaactgtgtatttatagcatttaacctttcattatacctgtagcgaagcacgggcattttgctagttaacttattaaaggaatagaaaaagaagcctccacgttcgctctcatggcctagaaattctcacattaatcgaagaaaaagaaaaaacagagtctatataggaatctacctatactacttaaaagttcaaaatatttccatcgtcgtaaaaaagaaaaaaaataagtcggactcaacaagcgagaaaaaagattctctcgtcagtaaaaataggaaaaaaatatttcgtagtaaaaacaacgtccgactcattaaaacagaaaaaaaaatctcgcccataaaatacatccgattccttaaaaaaggaaaaaaatatcgccagtaatgtaaacgaaaaaaaagtccaactcccgtagaaaggaaaaaaaacttctggcatccgactcccgtaaataaagggaaaaaacatgtcctactcaaaatcgagaaaaaaacacatatattataaaaaaaatcccgtttataaaagaaaccgatttgaaaaaactaaccgactagataaaaaactgaaaaaacacagattataaaaaaaacccgtttataaaataaaccggttcgaaaaaaaccacccgactagataaaaaaccgctccgaaataaaccatcagaaaaaacattgctaaaaaaaagatcgaaaaaaccatctgaattcacacgagaaaaaaccgccatatataaaaaatactaccccgaaaaaactgtctgacccaacgtgagaaaaatcccgcgtttataaaaaaattccgattcagtactgtgcaatgcgaaaaaaactgtctaatttcagaaaaaaaaaatccgatttcatgaaataagattcgtattgtttgtattgtccatcgtctaccatgtcgttttggtttttccatagcgtcgtcgaatgttcggacgtgcggatctaaaacaagtcttgcttaggcttggttttctcggaacaagatcaaattgatcgaggctttgggtcggataggattctcgatttttccatcatctacatggtttgtgttccacgattatattctcctgtattggagactctacatgtctctgtatgcaattaattgcatacatactactggtaagtatagctaatattcttgatagcttatcatataaaaataaaaataataaataaacatatttttaatttttattaagaagagtgcactgaggctctatttgtccgaaataaaccatcagaaaaaacattgctaaaaaaagatagaaaaaaccatccgaattcacacgagaaaaaaccgccatatataaaaaatactaccccgaaaaaactgacccaacgtgagaaaaatcccgcgtttataaaaaaattctgattcagtactgcgcaatgcgaaaaaaactgtctaatttcagaaaaaatccgatttcatgaaataagatttgtattgtttgtattgtccatcgtctaccatgtcgttttggtttttccatagcgttgtcgaatgttcggacgtgcggatctaaaacaagtcttgcttaggcttggttttcttggaacaagatcaaattgatcgaggctttgggtcggataggattctcgatttttccatcatctacatggtttgtgttccacaattatattctcctgtatttgagactctacatgtctctgtatgcaattatcagactactggtaagtatagctaatattcttgatagcttatcatataaaaataaaaataataaataaacatatttttaattgttattaagagaagagtgcactgaggctctatttgtttagacttgacaatacgagacaatgcaggatttgattgatcctactattattgcaagaatgagattgaaagattattttagattatatgtgtacaaccacgtaaataatccaatttgtttgggtaaaacatgcattgttaagtttgtcatagtcaagattggatcattatattaaagatgtttcaatttttcttataatatgacttagcaacaatgatcgatacgattattataattgacataattatggaatatagctgaaattcggaattaaaaataaggaatataggaagaaaagactagagtccatactggcataccatagaactaatggaaactcggaactagaaaaataagaaaactaaaaagtagaggttagagtccatatagtaatacaatttagctggaattcggaattagaaaaataacaaaactaaaagtagaggttagagaccatataaaaatacaatttaactgaaattcgaaattaaagataaggaatataggaagataagactatagtccataccggtatacaatataactaatggaaatttgggattagaaaaataagaaaattaaaagtagaggttagagtccatataaaaatacactttagaaataacgaaaattcaaaattttaaaaaataaggaatatggaatgaagtatatagagtccatataaaaatataatttaaaaataattaaattcgcaattagaaaaaataaatactgaaagataagtttagagtccaaatacaatttagacataatagaaactaggaattaaaataaggaatattggaagaagagtatagagtcatataggaatttataattaactaaaatttgaaataaaattaataaaattaaaagtagagtttagagcacatgtagaaacacattttacaaataaataaataaataaattataataaaaaggaatattggaacaatagtccataaagaaataatattgaaacatgagtccatataggaatacaatctataaataatattaacataagtttagagtccataaagaaataaaattagaaataataaaaattcagaattaaaataataagaaatattagaaaaagagtctagagtccatataaaaatacaatttataaagaacggaaattcggaattaaaaataagaaatattggaagatgagtataggaatataatttagaaataactaaaattttgaattttgaataagaaatataggaataaaatttataaataatagaaattcatgattaaaaaaataaagaatgttggaagaggattttagagtacatatagaaatataatttagaaataactaaaattcgctattaaaaataattaataactgtcatttatatacaatacattacgaatattacacattggttagtttgatcaagttagtacaaaatttaaaattatgttgtcattttaatatatttgataataaaatatgaaatatgctattatatgagagaaaatataagaatgctagccgcgcaatttacgcgggccaccatgctagttgaatattagagagtcacccacaaggccacaagaggtacacctgctactggttccgtggcgtcgtggcactacaatcgtataataccatccacaaagtcgctcgcccaaccgtttatcagtagtagtgtctctgggggacataggacaagaataaaatttgcgaataacttattttttcaataatttacgtttatatacttgcatggaaaggttttgcaaaaatatacccgttccacgacggtcccgcatttccaaaacgctggaccgacggtcccgcgggatggccatgcagtaccgcaattgtcccatagctccaaaacgcggaaccgttgcggtcccagctccaaaacacaccaccgtgctaatcagcgattttgacattgttttgcactgttcatgagtcagtcccgcggatccaacgtgcggaaccggcccatcaacagtgccaaacagtgtccaaaaaagtaaataaatttgcttgctacacagtggcgcgttttggagccgcgagctacgggaccgtcacggtggcgcgcggctatcccgcaggaccgtcacggtcccacgtttctatcccacgggacgggtatatttttgcaactctttcccatgcatttatataaatgtaaataattggtaaaatagatatattcgtaaatttttttcggacaggatagtgcaatatatctgacaagtaatctgaatgggaaaaatcacaatttaaaagtgtcctcctaagatcctgcgggttgctgggcgaaagcccaaaaatcgtgagaatcatttgattacaataagttcctcatcttgaggccgagtatgaatttcgtttttgaactgcaacaccaaatataacatgtctctctctgaacttgcataatatttatattcggtttcggcaaacgtgacgctaagtcagcgtggaactcatgtggacctcacgtgtcagcgaccagcttgctccttctatctcctcatcttccaccttgccctcgcatcaccagctctccctaggcgggcaagcggcagggacaagggcggtgcgcatcaccgagctggactagctgctacactgaaagggacgacaggcggcagactagaaggaggcgggcttgtgtagtagaccaccttacgccccccccccccccacacacacacacatctctagcgtcgtggtcgatgggtgggatgggtgacgggattctgctgcgatgcccgacaatcgcgcgggagcaccaccgtgccaactgcgacaacaccggattgagatcaaatgcagtagctactaggactgcacggtaactactgcacacaatctgagccctctatgtcaaaatctaacggccaaaacggatttggcacagtaaaatcagaacagtacctttccacagtaaatcactacagtgttttgctacagtgctcggatatatctggaacgtccattttaaatcatgcgatgctagtttgactgcttattttgcagtcccactggctactgcacctgaatcggatccgacaacacccggttaggaggagtccacgccaccgtccgagctccaccgctagctatacaggggtactcggctccaagctccactttccaatcgctgccgtcggcttcttggctctgagcaacaccctccggctgccgctcccatctgtagttctttttcctttctttgatcttgatttttcattagggctaaatttgattgatataaaaatttgccttgccagtagtttcaataatttggtaacttcagtagcactcggagcttatttagagtggagccaatattttgagaatttttacggtataatataccggtagtacatactatatattgtcattataaacaattcaagggtgtaaattgatttatctactcacttaaatcaaatgttgtaaaaaatttaagggggtaaaatggtctttctatgtgctagataatctctcctactctagttatctagcatgggttaatatgtttatgtgcttgatggattggtctgaacaagagatttaattgtgtcatctattcaaccatatctagtcagtaatacgatgacacacagacaattaatattactatagcaatggagatataacacgaaatagctaaagatcattttctattttgtggcaaattcccaacgtatccttatttatactgacaacatatactagcagtattgtacctaaaagttctcatattttggtaacactaccttaccaaatttcaccaaattttggtagtatcaaaacaaacttatattttgatactaccaacatttaatagtagaggacaaaaacattccatctacccttaaagctgaaaattttcagaaaaacttatccgagtaacatatttgaagacgagcatgtagtaaactttgcttttgtcacgaggggcacccggcaacttaggatctggattatctgcacttatctccgtagctacagtaatatgagcacagcatggtgtaaacagtacatggtcactgtagcagaagtggcagcatgctcggcagcaaaccagcagttcaccttgcgcgttgatcagcggaagtactgtagcagttcgtctcaagctttgatctgaaatatgcatggcagagaatcccattccggcaagttaacatctcaagactaaattaggaggagcggttcaatggtccgcaaaagaatatttatctcttcatgtgtaaaacctcatttgtacagtcaaaatcccaaagctacaataggtaacttcgttgttgcagcgacaatgcttttatccaattttccctgccattttgttccaccgccgtcgtccatccaattgctgttcatgtgtttatttacacttcaagtattcaccaatcacctcatgccacttaaaaactctctaacatacggcctacatatttttgtacaaacatctaaatcatggtgatataattaagcagtgatgtaacactgctagtatagaaaccaaccgtccatttcttgatctttacaaacatcagaaacactatgaaaagtgataaactgtgcggtcagatggcatcactggccatcagcctgacctcctgtcatcctccccattgagagtgtgaagtagagcaagatcaacgtgcccacactagacctgcgaatcaaacaagatatgttaagggcttgaggtcatgtagtggatcacatcttataagcaagaagcccagaaccaaggtgaggtcttggatatgtttacaaagcaatcatttaatcttctttttaaagacagtatgcataataagatatctatcccataagagctctatttctcaagtcaattcaagatcacgccataagttgagaaaagaaaataatatgacaacattgattaattgtggttcaacattgatgcattgcatcatttgggttgtcaccgtgtactacggattgcagattttcgtgtacatagtctgtttataagaataactggcccgcacaacactgtcatttaaaaacaaacagataacaaattgagagcttaaaggcttaagaaatatagagtttagtctattacagctagaaatgttgacaaaatatgttaaacctgacaaataacagaaccctgacaaattaattctacgggctaggaaaattgttcatctgaagacaagctgaggtcgattggtacacaaagctagactgaaacagacacatcttaccaaactgcaagctattaagaacttttcaccaaatggaaaactaggcaggtacacagctcctaaccgctggccatgacactgacaaggcaacaaaataaagcgcacacggttggtctggaagggacccctattggtgttttaatcatatcttggcagcttcaagaatagctacaaagggcctatctagatgaaaggggaaaatgaccatattatgaaaaatatctctacatagggcacctagttcaaatgaaagacccaaggaattaattcctcggaaactcttataggatgatgcacttaaattcgttagaattttagatgataagaaacatccaatcaaatttatggaaaattttctttggacctatgatattgatgccgatcatagcatgcaatacccatgattttctctgtatatagtcaatcatctttgttacgtattattgtgtttctactttctaattcacataagatgcaatgtatccctgtaattttctattaacaacacagctgatgaaggctactgccttttatccttaatggaaaatcaaactcacagtgctgcgaaggcaaaaaggatcttcctcgggtcacgccaccctgggacccgtctgcctgttcgtcggcgctttgccccaccagctgttggtgttgaagggtggaactgctcctttgggctaccatcaacgtgcacaggcaccacctgcttctcatacacggccaacacacctgtgcatatacaatattgagttgtgcatacgtatctgagtacattgaggagataggacaagatgatatgtgttgcattactacgttttcaacacaataaacttatgatgatttctagcacatgcagtgctactatatttcagaagaactgcaactggaggcttctacagtaacagagctctgagctctgcagtagtgctgcacagatatggtgggttaattttttctctatgaatttttagcttttttttttgggagactgttgggccagtgtggttcatcaggtcatttatgtttgtatttctgacctatatccaagtattttgccctatggataacaatgtcaaactcataattaaacctggtttccactccttaatttattgcatagagatgttgtcgtcatgaatcatctagatgcaaggattgatccctctgacctttaaatttttatgctagccaattggtcgcaccctcttaagcaaattcacatgaaatggtagatgggaagcaggatttggggatcatttgcatcgggttgcaaaccctatgcaattggcaacgtgaccccttataaagttgtaccaagtattagcaatggtacagccagagatttggtgtactagttaatagtagtacagtgtggtgcctggcccatggcccatggggatagccaagtttcatgatagtcaagttggtggcaggtaacgttgggagtttgttcccaaggattgatgagaatgcagctatctcacgcaaagcatctgacacgacacacgattttaaggtatgcattcgaggatcccacgcaagctgacgcatgcgtggagcagtggacaaactgaatccagcacagggccatccgggcgataaattcagaacaccaaactaattattatgaacggaaattagagattacgagtataatttctaactgatactaccccggtagtggtaaaagggggaagaaattggactctgagatgttcctggaatcagaatttcagaatgagcgcagcatggtgatgaactgacctgtggtagaaggattggcgtctccgctcctctcccgctcgaggcccttcccagcgaaggaggactccatcttcttctacgatcgcacaaacaaggtcagaagaactaagattaccacacgcgaacaaaccgaattccagtcaagcgaggacgcttacgggctccgcttctgccccggccgtctccgcctcgcccccgatgtcgaccgccacgaactccggcgcggcgccccggtccgcttcccggcggacgaggtccatggccatacgcgtgccgaccgacgacgctacctcctcctccacgagactcagctgctgctgccgccacccaagggaaaaggcacgaactcacatatatcaggcacacacgggtggcagagtacggcaccgctgagtccgcgacccgcgtggaggagtcgagtcgtcccccgagacttgaaccggtcgctgctcttgactccaagcggctcccccgcagacgacggggcgaagcggcgtgggagacggggcgccgcggcggcggcgtggagctcggcgaggtgggggaagaggaagtgcgagggcggcttgggcttgggatttaagaacgcggcggggagacgaaacgaaacggccggacgatggaggatggggagggggggaccgctgccgctcaccaaaatcgggcgggcgaggcggcacgggaggtgtgagcgtgacacgtacacgtggcggctacgtgtgtgggtgtcgcgcgcgcggaaccggacaagaaaattac

SEQ ID NO: 70813 - DNA, 7176 bp, Oryza sativa
atgccatccttccacgaactctgcttcttgaagcacacttgtgatcatatttgtttatttggacctgcaaaagcaaacaatattagcaactatgcaaaagttactccaatctgaattcagcaagcaaggtgtcaaattgcaaaggtaatttaaatggttagtataataccctgacactcttattaggttgggtctttgctctaattatccatgggcaaccaattgcatggcatttccctctaaacctttctttgtcagacttttcagtctctagttcaaactcatgaacaatggcatattgcttcactgccattctgaactcatccatagaagggtaaaatgtccccactgacatatctgggtcatccctgtcccaatccaacacatcaatgggtacttcatcgtccactacaatggctgcatctaacatgtcttgctgaatctcggttggaataataggaattgcagtttcttccatagctgctgcagcagctgctgctctctgatctgctgctttgaagcccatggcctcaaaaacttgatcctcatccaacaataaattaacatcacaatcttgctcaggttcaacaagtatagccaacttactccaatctacaacagcattagcctcttctgcattttgtggatggctagaggtatcacccgtcccttcttcatgaccaggagaagaaacttcagcactaatcatagcagagagaacttgagcacttgactgatcaattggatctgcagttaccacaccagagacaccttgaatagctgaatcaactggatttgcaatgccttcaataggttcatatccctttttataaataacttcaacaccaaactctaccagcttatcatccaacatagaattcatccactggccaaattcttcattggttgtcaacttacattcagtgccaatttcagtgtccaaaccccaaactctaatttcttggcttggcccccagattatcttgctagccatttcatcatgaaatttatccaaattatacccactgctaatatcaacccaccaatcatagtcttgctctgacattggtagcattccatactctagattcgcaacatacttagcaaccctaacaagaaatctaagcgcattgccaggatcaatcctgacataaacagattcataaaaaaaatggagttagaacacatctaactccatgcatgcaacacaatacaagcagggagggcaagagagaaaatgaacttaccaagaaggacaaactgagggcttcatcgccgccggaggacgatggcgacgatgccctaccaggtcacgatgtgctgttggggaagaacaaatgccgggatgatgccggagctgcggatctgacaaatgcgtcgacggcggactgcgggtggagaacgtcaggaccggcgtggggcggtgagccggcgggccgggcggcgcgtcgacggcccggggccgacgctgggcgagcaggggccgatggcgcgggacgggcgtcgatgtcgcgcgccgggccggcgtcgacggcgcggggccgacgcggggcgggcaggggtcaacggcgcgtcgcccgtcgatggtggctggcggtcgaacggaatcgggagagagaggatcccctgatttagggtttcagatgcaggggtatactagtcatttcatgtgcccattccacgctagcaagcccatgtggcggtgtacaatgcgaaaagtggcaaaaaattagaaaagcttctctctccaatggcatatagttaactgcaaacctaaaaggggtatttgaacaattggcaaacgtaaaagtggcaaatagttaaattccccatttgattctggaattgaagtttcttctttgccgggatcacatacagactgtttttgtccttagaggcagatgcagcagttattggttggcccagatttggggagtgaacccttgccagttgagccagctgaaccctggaaggctgaatattggcattttctgctaaaggcaatccatccaggtgctgaggtatattttgctgctgtactactgcactcttgcccttggcttgttctacatccttctgcatagtattgggttggatgcttttttgactaaaaaggctcgggcccacaagagcaaatctgccatcttgcaaagcactattcacctgtcctatcatattgactttggagcctccttcttgtgaagaacaagttctagcaccaggacttgcaaaatgctgccgaaatttagcaaccagagaatttttgttttccttctctatatccaccattgctgctggaggcaaataggaaagctgtgtaatccattttccatatctatcatctaactgcacttggtcatcagctttctattgtattataattctttgcttaatgggacaagtctgagaattgtgaaacatgagaccacagaaggtgcaaatgcgatgaattctctcataatgaacaaaaaccttgagaggttctctgatgtcaatatcaagattcactatagcttgaactggcttagagacatccatcttaactctaacactcatgaacctaggatctttcttgagattctcttccacaatggggttagcagcagagggttcaccaatttccttaaccactttcctagcagtatcttctgtcctaagagccattgggattccataaaatctaactgtgaccatgatggatttaaaggtgtaagcagaaagaggtttgagtttttcattagctgtagcccattccatcaagaaagtgtcactcccaaaagaccaaggttgtttattccaaacccaagaaagatcttcccaagtacgaaaatgagccataaacaaattggaatccacttgagagatgtccaaaaaacaacttccccataccttttgcagtgcttttttgagaggctgcagaggtatatccctgatctgtccaccagagtatccaaccttcagcagcatgttgtgatttgcctccatttgagcaacttcaggagaatacttgagccgaacagtggcttccttcggcggagtgagacacaattcttgtaaggacgcagcaatatggggaaggggatgatgaggacataactagctcggatataaccatgactaccttatgtattaatcaaataaaggtgcatatattctacattagatttacttgttatatatttgaacaaacgttgctacacaatgagtttcgtgtgtttttgttcgcagaggtacttgcttgggcgaaagaaaagagtccgagcgtaaggaaagcatagatgattgaagaagttgattgaggaccaaaccaagaccttctccaagttttctttcatctcaccacgtcacttttggtccatagaagacaagagataaagatctacacatttggattcggattcgggcctcctgacagcatcatcttcaaacggacctagccggtgatctagaaggaactttggggcccataagttcttgttggaaagcttatggagtctactttcagatggttttggtcccatattaaaattcctaccgatctgccgggaatctgcaaaacaagccaagtttctcaaccagtccaaatctgatttgggttttgggccttgtaattgtgtcgtgggcttagcccaagggggtgtgcgccctagggcaaccctaggatgtccctaatcacatttattcagtagccgtcatcgtttagagttgggttttgcttagattattctgtcaagaacaatttcgccactagatcggtttgtggaaccccaaattcgagtgattaatcattcatatgcaatttggttgcaatctatcttgttcttgcttgtgttctttgattcgcatgcagggattagccttctcggcgaggtcaaccgggttttggcacggttgataaccagaggagatgtggtgctgcgattgcggggctcagtagcgtgttcgttcagaagccggatcgagttgtgtcgcgactccgcccaaatcgattgtttatcaatacctatcggaagatcgagacctacatccctcatcagttggtatcagagcgccgttgcccattaggtaatttatcttcctataaccagaaaattgccacacaaaaatatttattctttacctagacaatttgagccgtttcattgttctattagattttgctttgttgaattcgagtgctggtttagttttaaatttaatttttagttttgagtattgcatctgttcatcacttaggtctagggttcatcactcaagagtgtgagttgtacgtcagttttaggtccagtttttcatctcgtcggttgttgccgggaccttgaaaaattgaattgtctcgtcgtcgggtttccctttttgtgatttggtgaaatttttatcaaacggttttggagtggttatactgagcgcgcgttactgtgtgcatgaggggagtactgtgcgcgtgaggagagactccgggtcagatcagatctatccatgactgtccgtattttcctctttatagaattgttaagtagtggatttgagatatttttataaaaatggaaccaacatgatatgagcaatccatttttgagatgatccaattttagttttgcactttgcgtttgagtccctgtaatattcatatttacatttgagtccctattcgaggtcagtggtcagtttctgttgaaaaaaaaacataagaaaaaaaagaaaagggcagaaagctgcaaagaaaaagaaagaaaaaaggcgcaccaaaaaaaagaaaaaaaaggtagaaaggtgcttagaaaaaagccgcaccaagaaaaaagaaagagaaaaaaagaaaaatcattcatcctttgagtatgttttgagagtgcagagttgtgcattgattcgtatcaagtccttagtgtggtcgggtgcttgcttgagctagagttgagtctaggctaggccagcacattgactagtactttgaactattattcaactttgcattttctgattagcacaattgcattcctttgctactatatattgtgcctcccaagttccacatatatacttctggtcagcaccgctttgatccttgtaatcgccacatcacgtctttcaaggtgtcacgaaccagccaccggttgtaccgtccttagcattgctggtaagacacttgtaagagcttggtaaggtgctccatttggccgagttgttgaggggcaccactacaccgcgtagcagattattagggataaccttcattgtttgctgttgtctttgtgtttgcaatgacaggtatgagtggcgctcaaaatcagcgataccaacaaggtgcacgtgctaacagtacttgggtgcaacaagtgctaagttctcaaatggagaaagcagagcaatggcagtatcacgaattatttgaaacaaagtttgtggttaaggatagagcatgtcgtactataatcgatagtgagagttgtaataacttggtgagttcatatttagttgagaaacttgagttgcttacacaaccgcatcctcatccatattacatcaaatggttcaactcttgtggtaagttcaagataaatagaattgtgagaataaacttttcgattggaaattaccatgatactaccaattttgatcttgtccctatgcaagcatgttctttgttgttaggtcaaccatgggtatatgataataatggatcgcataattttgttgctaatacatacacatttagacataatggtcggaaaatgaaattggtacccatgagttttactaaaattttagaagataatcttgaaaggatgaagaatggaatcgaggaaattttcaaagatagtattgaaaggacgaaaaatagaatcgatgatattttcagagataccaggaaagatactaatattgcgatgccttcaactaagtctgagttattacaaaatgaacgtattgttgtgcctattgctttggatactaatattttgcaggcatctgagaacaaccaaggtaatgaggaagagaaaaaagacgaagaggaagatgagaaacaaggtaatgataatagtgctacagctattcaaggtatgcatagttatgatgtgccaactatgtccactacttatgctacgttagagcaacccatagtggaaacaattgctgaaatacctttgtcacaaaacaatttgtttgatgtttcttgtgataaagaagagttgtgcgatgcttcacttatatccatgccacaactagtgaatgaacatgttagttctatagtagagccactatgtgttgaatttaaacatgttattcacattgctagcgagaatgaagagcttaaattgctatcttctttaaatacttggagatatattcaatttgatgatctttgtccactcaactgtttagagaagaaattatttgctagatttgaattgccatgcccttctgatgtgatttttcatattattggcaattatgatagtaaaggagaatataatgtgcatcgagtatatatttgttcgaatttgactatacctccttttcatgatgaaatgtgttgtctagaggaccgcatgcatataagttattttctatctagttcctctagttgtataaatgagttacaggttggtttgcaagaaggggagtgttgtggttttttgactacaaagattttaggatccaatcatatggccatcaagaaatgttccgcacaggatgctgtgatagacaaagataagtgcaatacgctccatgacaaggtgaaactgaggacggattccaatcaagaaggggaggatgatgaggacataactagctcggatataaccatgactaccttatgtattaatcaaataaaggtacatatattctatattagatttacttgttatatatttgaataaacgttgctacacaatgagtttcatgtgtttttgttcgcagaggtgcttgcttgggcgaaagaaaagagaccgagcgtaaggaaagcatagatgattgaagaagttgattggggaccaaaccaagaccttctccaagttttctttcatctcaccacgtcacttttggtccatagaagacaagagataaaggatctacacatttggattcggaattcagcctcctgacagcatcatctttaaacggacctagccgctgatctaaaaggaactttggggcccataagttctt

SEQ ID NO: 70814 - DNA, 1007 bp, Oryza sativa
agtacgagattcgagtcaatccgcggaagacacctcctacttatttcgaacgaagattgacacgacttttctaaggaaaatcgctagcgccgatgtgaaattgaaagctgctgagttaagcacctccgacctagttactttcccgattgctagcccctggaagagtagtgacaataagcttactaagagcctctcacggaactccttaagaagagaatgaaaattcccccctcacttctcctcccttcctcgtcatcatcctccattctcgaagccagacccatacagcgatgagggtccctcttctcgtccaagctctcccgcgcgcaggcctccccgccgccgcggccgccgcacgccgccgcgggcggcggcggagacgcccacacgccctcgtcgcacggccaccgccaccgccgcttccccaaggagaacgtcgacccgtccccctccccgggcccgtacgaccaccactccgcttaccgctccccgtcgggcaagcagcagcagcagcagcccctcgccgccaagaaccgcagcctcccgccgcggcccccgctcaagcgcaagctcctcgacgtctccgccgcctcccccgcgcccgagggcgcgcccagcggcggcggcggcggcgattctggcgtccaggtaggctagggtttcggattgggtggagccgagagggaccttggctggatctggttttgatggttgtggttttgccgtggcaggttgtggtgagggtgcgtccgccgagccgcgcggaggaggaggatgagggggccgggaaggaggtgtgcgtacggaagaccggccctggctccgtcgagatacatgggcaggggttcaccttcgattcggtcgctgatgaggcctccacgcaggtaggaggagggtatacgattttagttccaattttagtgtgttcagatttacacgtttgcagttgtgtggggtacacaactcaaattcgcgctgtttcaaacgattgtcaacaaaggggcgcg

SEQ ID NO: 70815 - DNA, 925 bp, Oryza sativa
  unsure (1)..(925): unsure at all n locations
aaataatgtactaccaattattttgcctttcatgatttgcattgtttttttatctggttctcgttacttatcttaaacctgtgcagtatcaactaaaatttaagtaacctgaaaaattagaacaatgataattgagttgatgtcactatttcatcaaaactaagaacaatattttcctttgctgcagaagcgggctgagttagcagagcaggagatgaacaaggcctttgcagaaatcgacaacttgaaaagggatcatgaccaagaagttcttgtgctaaaccagcggctcgctgaatccaaactgcccagcaatgttgtacagtcacctgagcctagtgagaccggccccgctagatacgacacaggtgggagcttcggcgatgagcaatggcgagaggagttcaagcccttccagtcggtcgaggtctccaaaagcagtgatcccagctcatggttttatgggtacgacaaatgcaacatttgatgaggcattctggagccatttatattgatttatttttggattctttcacctagaaaggtataatatgttgtacaccttgccattgaggaaaagaattttcccaacgttggctttgccatggcccatataccaaaccgcagcattcctcgctggctagtgcctgcctgccctatcaacaagactttcacaggttgtatgttgtgtcgcaaactgaaaacctgaaggtgtatgtttagatggattgatgatgcatgtaaaaatggcggacttattntttgggcagttggagagttgatgagtcaaaacttacaatttaaaattattaaaattatttttttttttttacagttaaaatataaggatttggaagataaatttacttccaagtgtaattaggaaattatgtttaattttcttctcttaaattttcggtttttg

SEQ ID NO: 70816 - DNA, 656 bp, Oryza sativa
tgccctccggacgtggtgagccaccaaagtctccatgcatttaaagggggaatgacagggatgtcccccgtgtcaggcgggggacggcgctgggccccacccaaggacgcacagccaccttgcttccggttgaaggcacgaatggcggtctaatcgaggcagggggggttcctctcccctggaggagtaggtatggacggtgcatgtggtatccccttgaactataaaaggaggacctcgcccaccgaaaaaagtgacgactctcagatagttttgagttcgagaggaagaacggctagggtcccctccagagctcaagacatcctgtaaaagttgatcataatcccatgcacaggagtagggtattacgctcgatagcggcccgaacctgtataatcctttgtcttccacacagccccgagagcgatttagtaggtaaacgccaagccgaagtaggcccttgatcatcgcgctgtatcccccggtcgaactcacaaaggggggggggggtctcacgaccacccgctagagagggaagctcctcgacagaacccatcactggaatggaaagcgaccttaaaaaaatggggcccagttgcaaccatagaaaattggttatagaaaccgaagaactaataataaccccaaacattcaa

SEQ ID NO: 70817 - DNA, 686 bp, Oryza sativa
ccatttttttaagatgactttccattccagtgatgggttctgtcgaggagcaaccctctctagcgggtggtcgtgagacccccccccccctttgtgagttcgaccgggggatacagcgcgatgatcaagggcctacttcggcttggcgtttaactactaaatcgctctcggggctgtgtggaagacaaaggattatacaggttcgggccgctatcgagcgtaataccctactcctgtgcatgggattatgatcaacttttacaggatgtcttgagctctggaggggaccctagccgttcttcctctcgaactcaaaactatctgagagtcgtcacttttttcggtgggcgagggcctccttttatagttcaaggggataccacatgcaccgtgcatacctactcctccaggggagaggaacccaccctgccttgattagaccgccattctggcctttaaccggaagcaaagtgggtgtgcggtctttggtggggcccatgggcgtcccccgcctgaaacggggacattcctggcattcccctttaaagcatggagactttggtggctcaccacgtccgggggcacccctggcagattactgacaggaccgggcggacctgccccatttcgcctgacacaaggcgggacgtggggcgctttgcgccctcccaaaacctgggaccggg

SEQ ID NO: 70818 - DNA, 21850 bp, Oryza sativa
ccccttattagtcgtgccaaatttcaaccaagcattatctgtgtctttaaggcccctaaaaatccgctgaatagctttccagtgttctttacaaggattagccatgtatctactaaccaaactcatagcatgagataaatctagacgggagcaaaccatggcatacatcaaagaaccaacaacactagaatatggaactctagacatgtattctacatcctcatcagtactagcacattgtaaagctgataatttaaaatgaggtgcaatatgagtactaacaggctttgtatcatgcatgttaaaacgctgaagaaccttcttaatgtagctttgctgactaagaaataaccaaccggaatttctgtctctagtgatttccatacctagaattttcttagcagcatcaagatccttcatatcaaactcactactcaactgtttcttcaatgtagtgatttgttccttgctcttggcagcaatcagcatatcatcaacatataacagcaagtatataggtgacacattaacaaatttaatatacacacagctatcaaattcagatctcttgaagccatgtgacaacataaatgaatcaaaccttttataccattgacgaggagactgtttcaaaccatacaaagatcttttcaacttgcaaacataatcctccttaccaggcactatgaacccttctggctggtccatgtatatctcctcctcaagctctccatgtaaaaatgctgtcttcacatctaactgctcaagctcaagatcatgcatagcaacaatactgaagaatgtgcgaattgaactatgctttacaactagagagaacacatcattataatcaacaccagcaatttgactaaaaccttttgctactaaacttgccttaaacctcggagggtcgctagaagataaaccctcctttctcttgaagatctatttacaatgaacaggcttcttctgttttggcaagtgcacaagctcccatgtgtcattcttctcaagagactgcatctcctcctgcatagctgagatccacttctcacggtctccagaaacaacaacttcagtgtatgtggctagctcaagagtattctccacctgttcagcacaaataaaagcataataaaccatatcacattcctcaataaggcggactggagctccacaactcctctttgttctgcgatgtgcaataggttcatcttgtggctgcaaaacaggaggtgagtgctgaacagtatcattaacatcattaccaacaatttcagttttctgatcatccacgtgctccacctgcacgctaacatattgctgctcctcatcaaaaccacctggtatgacatctgtgggcaagctgtcattaaacataacagattcattgaaaacaacactcctgctcatgaatgtcttattagtttcaggattccataacttatatccttttactcctgaaccataaccaagaaacagacacttaatagctctaggctctaattttccattattaacatgagcataagcagtgcatccaaaaactctcaactgtgaataattagcaggcataccagaccatacctcaatgggagttttcttattaagtgagatagaaggcgacctgttgatcaagtagcaggcggttttagcagcctctgcccaaaaacgtttgttcatgcgggcgttggacagcatacaacgagccttggagatgatggttctgttcatgcgctcagccacaccattctgctgtggagtgtacgggatggtgtgatgcataacgatgccttccttcctacaataatcatcaaaagcatccgaacaaaatccaccaccattgtcagtgcgaagtacttttacctccttttcagtttgcctttttatcatgactttccactctttaaaagcagcaaatgtatcatctttatgtttcaggaaataaggccacacttttctagagtaatcatcaataatggtaagcatataacgagcaccaccaagagatggcttacgggaaggcccccacaaatcagcatgtacataatcaagtatacctttggtgcgatgaactaaggtattgaattttaccctcttgtgcttaccaaaaacacagtgctcacagaacttcatgttaccttgagtgcagccatccagcaggttctttttcatcaattctgccataccaagttcactcatatgtccaagacgcatatgccacatgttagtcttactaggttcatctttagaaacaacagcagcagtaacataaccatgtaatgtacttcctctaaggacatataagtttgcagaattcatatcaccaatcatataaacgagagaacctttcgatacctttacaactccacctgacccggagtatttgtatcttttggcatcaagtgtgctgagagagataaaatttctcgccatccttggtatgtgtctcacatctttcagcgtgcgtgtcatgccatcgtgtgtcttgatctgaacggagccaatgcccacgatctcacgtgggttatcatctcccatgcgcacaacatctccattctgcacagacttgtaagaactaaaccaatctctgttaatgcagatatgaaacgaacatgtagtatcaagtatccattcatcatgactagaaacacaaacaacaaaaacgacaagacaatctcctgaatcagagttatcagcactggtaacaacagaggccttaccatcagatttccttttctccttattctgcagcttccaacattcttcaatgaagtgatttttctttttgcaatacttacagaactttttacctctagacttagaacggcctctactctggttcttgtcacgatcattgctgtcgttgtaggttctctgctcagatctgcctctgacctgcaatgcttcgcccttagaggacgatgcatcagactgaaccatacctttcatcttctccctgttttggagcgcctcatagacttccgctagggttagttcactacggcttaaaagtatggtgtcacgaaaatttgcatatgaactaggcagtgagcataacagtaaaagacctaaatcttcatcatcaaactgtacctccatcgacactaggtcggcaacgatctccttgaagaccgatatgtggttcaatatagaaccactctcctgcaacttgtgcgagaacaacttcatcttgatatgcatcttactgattagatctttagacatgcagatcgattccagtttgagccaaagttctgcagcagtgttttccggcaacacttcttgcaaaatatcattagatagatgaagttggatcagcgacagagccttacgatctttccgcttctcctcagcagttcattcagtcgatttcttctccccgaagctttccagcgcctcatcaagatcccaagtttgcaccagaacagcccgcatcttgacttgccacagcgagaatcacgtcttgtagtctagcagcggtacatcatacttcatcgacgccatcgcgaaaccctaatgtgagaacaagctctgataccacttgttaggaaacgataagcgaacaaacgataaagaacaatagatcaatcacagaagacacgagatttaacgtgaaaaaccctcccaaaacaggagagaaaaaaccacgggcgccagccaacaaaatatcttcactatatctggggtgaggttacatcaccgcacggcggcttacaagaggtatatatatggtggaaccctacgcttcggcccaagccttccggcgacgggcctccgctccgctacggcagaagctggcctttattaagtgcaaatgaatttggatcacaactcaacactagctaccaacacaacacttttcattcaactgcttcccttaacttggagtattattgtttttcccattttatgatttttgcaattttctagtgggaattttgcaataacaattcaaaacggtgggtaaatttgcaaacgccccacagatataatacataatgcaaaggcttctcgtaagaattggacattaccaatatccatttggtggttcagatgcctgaaatggatggctatgaagcaacaatgcgcatccgcaaggaagaaagccggtatggaatttgcactccaatcatcgcattgacctctcattccatggaggacgatcttcagaaggcaattcatgccgggatgaatctacacatgacaaatccaatagaaaggaggacaatagttgaagctgttcatggtgtctgcaaaagacaataaccggtgttgcacaacacatcatatatatgtggcaatgagaaggatgagacaaatcacatcagcctaattgatgcagtatgtaggatgtaattacagattttatctttaagtgaaccttaatctcgaagcaaacttgaatggcctgggtcggcgtcgaacacatgatgaccgataaacagtgccggctagaaaagaacaggaaaaagcggagaagagaggggaagggcactctggtaaatttgcagattgcctgcattgaatttggattcaatattttgaactcctcttaagctcgatccataaatttgaaaattcaactaattaaatgaatattgatttttcaaatttattttaaaaaggaacttccataattttacaagatttgtgtaagagtgaattgcgtttatggccatatttgattactaaaatttcacttttgagcaccctttagctcttaatttttttcactttggacgatgctattttgccattgtttatactttgggccaccaaaatacttctcgagcacatcaattaccttaagcacatcggcatccgtatatcaacaatcttcccaacttacgtgtaaactattatttactattattgtacattagtccaaaatacaataaaggtagttttacctagtccaaagcaaaaatatttgttaaagggtgattcaaagtaaaactttagtaataaaaggtagatcaaagtgcaattaattgtttgaataatttatttgatttctccttaaatatgcacacttcagtttataattaaatcgaagtttaattcttgtaattgaataatatttattgaactggaagtttaattttagtttccacttgacttgcattcttctcaattcatttgaggctctcaaactaaacttcaaattgttttggttcttttgcaatcaaacagtcaaaaaatagtggcatggtgcaaaatgttttaataagtttgaaattcaatgtgttttcattattacctttctttaagtttgaatggggtacgattaataatttaattgctcaatctaacaaaatgcagtattcacattccaatcaaatcttaggtacataatctagtcaaataaccaatctgcaatagataactaagctaactgaacataacctaacttcttagaggtaagaggttgccgctgttctcataaaaggaaaaaaaaagttcggtccaataggccgcctagctaccatgacaaccgttgttgttcgtgggcctgactggctcatatccatcatgctctacatgggccttttcctttttgtgatatagtgatatctctgtgcgaaatacaaatgtgaaatgtttagaactaattttacttgatttccagtttgacccaagaactattgtctattactactgctgtctaggacactttcacagtttcactagcataccatcaaccaatgcatgctgttttcatatgtgatatgttatgagctgttttctgatctttccgagcatgtttgtagcccaaaatcccttccaacagtcttgctaacctgacattcttaaatattcaccttcgacaggcaaactgaattaactgtatgatatgcaaagctgaaatgtggtgacgaacttctgatggtcgccatttaactctggagagttaaaaattgtattgcttacactacataccatggcaaccttttttttttcctccgacttaacgtcccatttaactcctcagacattgcaaggtcaaattaccattctcaccccccccccccaaaaaaaaaactctactaaacataaggtaaaatgggcaaaactgttgcaaactttcccaaattaaatttggaaatatactattttttttctcagaaatatcctgtatgcacttaccgtggtctcgcacgatgatgacgccgggacttgcgaggctgcagacccctgtcgctaatcagtgattaattatcctaattagcgattaattaaatacaattaattaattgttctaatcaaaatatttaatcactaattattattaattaatcgctaatcatttgatttctaaaatgttgtcgatgttttgccatgtgagaccgctcagtcgtcgttacgcgagaccaccagcgttgtcacgctctcgttattctcgtgcaacggttcagtgatattgacggcatatttgtgttaaaaaaaattacatccaggttttttttaagaaaaaaataatgaacaatatatttttatgtacagtctacatgtttcacaaaactgtactacatgataagcaaattttaactgaactgcagatacacgccggtcttatcccttgggtccccaaatggtccagcagaacactccatcagcaacctccaattaaaatgtgacatccaaattttgtttccatcttacacaagatgccaagtcatacagtagagtagaaagaagactacaaaagcaagaaatgcagaagaacatgccctgcgaattgcaaattggtaagctctctgcttgctcgatctctggttggccctacactgccacacttggccaaatttcagcgtatgatgagttgatgccaaacatgttcgtgcaattttgtgtgaaatgattgtctgtttgtctctgaacatagcaacaaaaagaggctcgcgcaagcgcattgatttgcttggagcctgcctctgcatgtgatctatcagtgttccagatctctgagcttaggattagccatgcctagaagcaaacattgttggcactattagtctggtatgtacaaatgtttatatctcattattactttttagaaaaaaaaatgtatggccctaagggcccagcccaacacaaataattcaattcctatgaagatcgaatctattcttgtcaaaaccacgcaattttcattactatgttttgaacgaggaatttacgcatttatcagaatgaaaaatcatcagtatcggtttggtttatttatacatatggagctaatgtgatttgctatataaacaggtacaataattaggctgtgttcggtatttggagttaggaattctccctaaacatacgaaacgaggtggtccattagtgcgtgattaattaaatattagctattttttttaaaaaaggatcaatatgatttttcaaagcaactttcttatagaaattttttttgcaaaaaaaatatataatatttagtagtttgggaagtgtgcgcgcaaaaaacgagatagatgggttgggaaagctagcaaacaaacttatgttcggatgccccttttcccaacccctctccctcgtttccacgcgcacgcttttcaaactgctaaacgacgcttttcaaactgctaaacggtgtgttttttacaaaaagtttttatatgaaagttgcttaaagaatcaaattaatctatttttttaaaaaatagcaaatacttaattaatcacgtgctaatgtaccgctccgttttccgtgcatactgcgcttgttctcatccggctgtagcgaacacacccttagccttacgaatacactgagctattccttggaggaaaataaaaacctatgagctggaaaagaaagcaaaaatgtacccacgaattacctactaaaaagaagaagcatcgcacaccgacgatcattgtttgcactggtccacatgtcagctgctgcacacacagagattttgcctaccaagagaagcaaaaatgctcgcacgacatgaagcattctggtggcagaattcccaaaaaatttcacaatttgaccctttgcaaaaaaaaattttacaaataaaccatcaccaaaacttatttcaaaaataacccttggcgctgaacttagacacctcagcgccaaatagcgtggcgctgaatatacgttggcacgctgacttagtctcccatccgcggtggcacggcattcagcgccagttgacatggcgctaaggtgtctatattcagcgccaggtgatttggcgctgaccaaaagagtcatttttaaaataagttttggcagcggtttatttgtaaaaattttttttgcaaagggtcaaattgtgaaaatttcagcagaattccggtacaaagtcgcggggaagttatcatgaccacacagactgtacgggggagctagcgtatggttgatgcccaatcttgagcaggacacacccatgcagagagagggagagagagagagagcggccgtactccctccgtaaaagaaaagaaagataaaccttaagttttcgtatctaatgttttattgtccgtcttatatgaatttttttataactagtattttcattgttgttagatgataaaacatgattaatactttatgcgtgacttgtctttttaatttttttcatatttttttcaaataaaacagacgatcaaacgtttgacacggaaacccgaatttggttttttttaacggagcgagtacgttgaaacgagacgccatgttttggaccagaaatcatcatcgatcgctgcgctccctccctccctctctccagctgattcctccgcaatacacggaggcgcccacgtttggcctctggctgcttcaacacagctacgcggaatggagtggaccatgagcagctgcagttcaagttctctccctatcccacagccagcatgattttgataaatgaatacaaccaggaacaacaaactaaaaactactactctagaaataggatgattttgataatccggtcttgattagtgtacggtacgtttaaatttaaaagttcagcgcttatttttattggagtataattaaagtgaattattcatcttttctcatcaatttatcctcaccagtttagacttttaggttaaattgatcattgtatgcaactaaatatgatatcagaattaaaggtctagagtttgaatcatgtctagtgtgcaattaaataaaaattgatgtccacttctattccacgctaaagacttgagggagcctcgcgtgagggggagtgttggaatataaagggaattggccgtatttcctcattagcttagttttttgggttgaaatgatcggtttatgcaattttgtcaatcagacttcaataaaactttaaggctgttgaatgtttttttcttatatataatataatagataccaagtcatattttttcaagaaagtaatggttaaaaaagaatgtgcaaaagagagtactatgttttttttaacgatccagtacaaaattatgctaattttattggtgcccacgaatattatgcacacaggtgtgtttatagtgagatcaaggatgcaccgctagtttttttttgtctcttatggcgtccacaatatggaattttttgtctcttatggcgtccacaatatggaaatacagagggtcttaaacctcccaagtagtctttatacattgtacaagctagtggtccttataggagtcttttggatgagctatccttatgattaaggcctggccatatgaaataaaaagcttatcattcatctctctctcgtggaactctcctctctccctcaccaatctgttgcttgccgccaccgggaaagagaggatggcatccgcggaggaggctgccaaagttccacccacgagcatcgtctccccagccaccaaaggaccaccttagagtgccaccgcagtccacagttgtggtcgtggattcgcgccagccgccaccgcagccacaacctccctaagaggttgtaatcaggggaaaaacataccaccaccaccacatgttagcaattccaaacatacccctagacaaaagaactagcaccaagccagccgccactatccgtgactgaatgccgctagtcttgcaaacgccctggcgaacactagctccaaaacagaagatcgtcaacgggctcccggtcatcctcacggagaaagcttggggagggagaggacaagagagaagaacacccacttgtccctcacgccaacctggtgacgacaactgacaaaacgccaaaaaccaaattgagagaagcctgtgacggcgggaagatgagatctcaaagacgatgccttcaaggagcatgatgctcaagacgccaccgtcatccgtccaggaggtatgatgctcaagacaccaccgtcatccgtccaaaggactaggttttctcccggagaatctcccaaggaggaagagggtgtcagcttgacagcgccccaaaggggtgaaacgctgctagatgccgacactgccagcctagagaactccaagcaaggcgttcgcctacagttcactctattcaacatatcatcaacaacctaacacaaagccacccaagcggtctccgatagcacgcagtcttgctgcgtcagctatcttgcgtcggtcaaccaccttcggcaccttcggttgtgccctgctagccccaccgtccagctcctcgtggcatcagcgaccgcctcactctgtagcctcctagtcatggcctcgcgcgccgtcggtgtgcgtgccactagcatcacgcaccgccggcctccacctcgcacaccattagcctactccttgcttgcttgttgcgctggccacccataggcgtcgcagcccaggccacgccctcgcacgctgcgccaccgccatcatgttgtctttcatgttgccacgccaccccttatcgcagtgcagccctggtttctactctcctcctcaccgccgcttaaacttgtcggctggggcaccagaacgatctggcagtgaggggactaggtctagccccaatgatgccaaatctagccaccgatgactgtcacttaaagctctccctccggtcttagccaccactggagaaaccgtttgtaatcccggttgggaacccctgtagtcccggttttccaaccggggctacgaatctgggactaaagatgcccatctttagttccgggtgaaataatcgggagtaaagttgtatctttagtcccagttgatgttaccaaccgggaataacgagagggtagcggcagttccggttggtccacttttcttttttttttgattgtttctttgctacttgccagagttaatccctgtattttctcccaaatcgagtgtcatgtatatccccaaatcaaaccccaaatcctcaaatcattgtaacatcctaaataattcacatcacaaatcctaagttacttttacacacaaatcaaatacatcacaaatcctaaaaaattacacaaaaatcaaatacatcacagattatacatctcagatccatgcaataaatcacaaattctaaacaaagagattatacatctcggtgaatcataaattatcaaaaaaaaagaaaggctggcgcgttgccacccgccacggccaccgcttgccacggccagcgcctgccgcctgcggccccgtgcacggccccgccgggtgttgccccactgcctgccaccgcgcgcgaccccgtcggctgccggatgggaggggaggagggggaggagaggggaggggaggaggatgaaggggaggaaggggaggaggaggaggaggagtaaggggacctgaggggtaggaggagaggggaatgatccgatcttatctaaatatctcggtgaggaggaaagtcttgtctgatacttaaccgatcagatatgggagagaaatatttactcccagttggtgttaccaatcgggattaaagatctaaataatctttacttcgggttggtactatcaaccaggaaaaaagtggtgatctttagtcccggttggtagttattaaccaggactaaagattctcggcccctgacaagcctctgacaaattttttaaccgagactaaaaacaatctttaatcccggttcttattagaaccgagactattgtgaaaattagtcgacccagcaaagattatttcttcaatagtggcagagccctaggccgacatgaccatgagaggaggaaaagagcccctccggtggccgctcagtggcggggtagaggggaggaggggaaaggggtggggacagtgctcgcctagtcgccacctgtactgccctgcggccgtgcgacatgagcatattactatttgagtattggaatttaaaatatccaagaaacacacagtaacatcccacatgattaacatgcatgcaaagatgatgtaccgatggccgtttgcaccaatatctctgaaaacatcattgatgctgcaccctggtcgcggagctatcagcctatcactacatagaccatccagttggaattgcgtacaagggacggcaaattggattatcaggcatgccaagtgcagatgctggttaaagtgtgctgaaaggggtgaaaaaatcgaatatctcaatcgatcagttggtgagtagggccgggcgccgttgctgacttgccgtgatacagaaatattcctgctttacttttttccgaagggaaagaaagccaagaatcaaatggccaaatgaaccagcttgctataacaccctatatctcgtttgaagcctataattgttatggtgttggcccatatatataatgcagttgtcatgcaatggtggtgatttagtacaacattggaaatttaagaggatgatcagggtctctgcttataaatcaaaggatgattatatgataatctaaagcgttaagtcaccattcaaaaatgattatatgaccactactagaaaaacgatttttcatggcgttggtctatgattttcgctggcagaaaaatgccaaaaccacaagcaaggtcgtaatgagggaggtggggggcaccgaccgccagcgaaaatagatcttcgctggcagccacgttataccagccgccagcaaagatatgttcattttcactggcggtcacttaggtgcgccaccaactaaaatagataatttttgctggcgcttgggttatatagtccggtagggaagatacaattatttttgctggcggcccacttaagtaaccgccagcaaaaaccgattttcgctggcggtagaaggaccaccatctattaaaaaaattccacacaccgcccatgctccttatccacccacctttccagaataaaaatatctccacctctcctcttccccctccagatctagatcctctccaacaccctcatctcttctcctcctcccctccatagatccacggcgttggcgtcctctcctcctaggcggcggcggtggcggctccgttagctgtgcacggcggcgacggaaggtggtcgtcagggggcgtggcgacagcgactgcaacaggatgtgggggcgcggcgacagcgacgggaggagctatcgtgggggcacaacgacgacaggggcgcggcaagcttcttcttctccccctccccctccccctcccaaagtcttgctggtggctgggctttctagatcggggcttggtacggcagaaggagctcggtggcggtgatgctcggcgacggggctcacacatccggtgttgcgtggtcggcgacggcgacgacgtcctccttcctctctactgttaatgatgtttttctctttttttttcatgttcaaaatgcttgtatgatgtgttcacttccatgttaattgaatctagtgaactctggatgaggatttgaatcgatgctcgaaaatttggatgtggatttgaatctgtacatgctgcgaaaatatgatatattttcttttttttttggcaaaaagagattttggggattaattttttttatggaaaatcattttgactggcggcccacataatgaagccgccagcgaagactattttttgctagcagagcacataaggcagccgccatcgaagactattttcgctagcggcccacatatggcagccgccagtgaagacgattttcgctagcggttgtctttagctggccgccagcgaaaagttatctcctcttgcagtttagtgccgtcagcgaagatgctacattttcactggcctttgctttgtggtggcgctaaatgtcgccagcgaagacccaaaatagccaccacgaaatatggtttttgtagtagtggacaatataaaccgttaaagcaccttttttttaagtgtgttacgttcgtcttaacaagttaccatgcataccaaaagtcatgcgttctctacaagggattaacaataatagaaaaaaatatatcctccagttgatgcatatgttttattaattactccctccatttcaggtagtaacaggggtggagctaaagtcattaggggttccaggaacccggtgaaaaaaatatgtaactaaactttacctattttcaccatgtgtgcaccatcctcaatataaatttaggcacccgtatcaacttaaactcgatataaagtagagtaaattaaacaagtggcaccccctccatttcgtttagctccgcccctgtgcactaaacatgaagatgtgatttgatatttttatgacaaactttttttgaggaaaactacggcgggtttgaacaccagtctgaactttattcatttggttaaaaaaaagaactttacaaagggggaggtacagagggacggggggaagaaactaaaaattagaggttaattacagaaagatttagcgcccaagagtgaagttgttgtttgcctacaacgtcgttacatcggtttgaccacaattcgatatcgttggcgcagcgacgaagaactatcgagttggtttcgtcaatggagttgaagatcttcttgttgcggcgctatttgtcccgcgcaatgattaaaaactacgattatcccgtgcaactttgtgtatgctagataaaagtataattggatttggtatatatatacaacttctatcatattttattcatagatacaaatgtcttttctatataatatttttatatgtacaacgatttcatgtataactcttagcttctgttttcatgtatatacaccatgccattgaatattctcgacattttggtttttcttatcgcattttcctttcgtatcatatactgcacttcagattctctttttgaaatcaatattcactccctgaaagaaccttcctgaaatatcagtcaaaagaagatgtgcaatgcaggaagtctgatgaattcttctctgcatccactacatgccaacgacacctcactgcctcatcagattcttcctaatctgaactgcttcttctaatcataaaagataaaaagaaaagatcacatgatatatggatcgagatcagggacacagaatcaatatgcatcatgcaatgcaagaatatacatctcaataattggacatgcaagccggcctagctgtagctaggagatccatccaatgcatccatgcaaatccagccgtttaccatgtcgcccctgccacgatctcggccgctaatttcgcgccggagacagtagagaatttcttggggctctaaaaccctgcctctctagaagcacagctaaatgttattcttattccaacgatgcacatagatgatccatatatataccacatatatatatgattaattagattatcaccaagatcagattcgtctttcgatgcttccatggtactatttgattcagaaatagcaatttgcaatacaaaatgtgtggctacgctggctgtacatgttagcctacatacgagaatctgaaagtacatacatgatcagaacataaacattaattactactgctgctaattaatttggttggacttagcagtactgaattttcacacctgtggtactgtgtgagaatagacccagagatcatctgttgtaatgtggatgaacaatatagctacaacctacaaggaaaataagtttacaacagtgtttgaatgcgctttgctgtagcaaattcagtgcagcaacaatgaccaattctaaggcacatcgaaaatattgaggccttcaatattagatctatactaacattcaatctcaatctttacagctaacaaagtgaaattaatgaacattgatcactaactaagtattaaccaaacctagcaactctcgtgagtctgcaggatgatgaagtttgtagatctgtcgtgtacacagtgtgtatactgtatatccagcatgacacgacgaagcagttacgtataattaagcgagatcgacaaaaaatgcagacatgacgcaataacgcatatcccaattaaatatacgcgcacacgcatcagttaaaattaatttaatgcccatcagaaagcaactgcatcatgtgcacactaattaagattcgaaattaatctgcatatatatcactaattgatatgaattgaaatttgagatcgactggcacgtgcgtgccaatgccaattaatggtcctttgcttaattatattagctgtgtacgtacgtacgcacgcactgtacgtataactgtgtattgcccatccagatttttaatttgtcgttcagttttgtgcgaatctcgtggtgtctgtatatgtttgtcgaggtgtcgacactactctgacaaataacagtgtttagcttcagcttgttcctggtccttcccgtgttgtgtgtttggattaattggtaaacagtgatacgcaattatgcattgcgattcaaatccaacggaaacagagtgtttagtggtacgcatcgaaggtagattgatccaaatgtaccgctaattgaaattcttggaagagttcaagggggtcgtagtcgtgcatgtcactgatgacaggcacaccgtacccaatgtttttgtaacttgttcacaaaaatacattggatgataacatagtttatattaaaatatgacgagtaatttgcttttcttgacgagtacatgttcatttgaacaacgattgatcaaaccattatttaaaaaaaccaaaaacaaatcatgaataaaacttttatatttatgttactagcggtttcaaagctaatgctagaaagtggactagcataaatttaattttggttactactgataagctaacaaacggacaaaggcagtggcgttcctagagtatactatctggggttctaggcaaggtttaatttctcgttttcggtgtttctatcgggcggtgccgatatagcgaaatttcagaaatttcaatccgaaatttctaaaatttgaatattaccaaaattcatgaaaaaataaaaaaattgaaaattttgatcaaaataatattgtatcggaggggtcagagaaatttcagtccgaaatgtcaaaccctggtcctaggatctcggctagaattttaatatttagttgttttaacctatatgaactatattattaggtaattaaaaattattgtattatatgtgttatgatatgtatagaatcgccggtaaattttgtcctaggttggccactagacaaaggctaagaactaccaaaataatttacatcagagatatggtagtacagtaaaatcattcaaatatgacatttctttgtaatatttaaaggtcgatacataaaacctctagtcaagagtagagcagctagggctgaagccctattcctaactcaaaataaaaataaatattgcaactgcactatagaattttaaaacttaaaacataaaaaataaaattatgtaaattatactaattgagcttttgtcttggaaacgtaacgtacgttctggttccgtcactgcgtgagcaaattaaatacagtgaatgcaataaggaggacaaaaaaaacgtgtccgtggcaacgtcacgtgtgtagagcaaaacatacatacatggccgttcttttccctttttcccgtaatcccgtgtagcacccgtgcacggctgcatcatcatgcatgcatatccggtggccgggtttgccatataattccccctcccctgcgcgcacgccgcgtggcccacggctcgacggatatcgcggcctcgatcggcagggccacgcgagcgcaacggtggcgcgaggagggcggcgtacgtcctcctcctcgcctcccgctccgccgccccctgcgtggtagcgcgaagcggacggataacgatcggtaaccgcgcgcgcgagcgccccgcggccgcccatgtgacccggccgacgacgtctcacgatcgatcgagtgagtagtagcgcgcgtgcgcgtgtgtgctgtaggcaaatactatcgctgaacggaacgaacgatagacaagaaaatctgagatatccatccaactcgggtacagcgaacacacggtcgatcgtttctctgcccgccctctttcccgtgtgtaggccacatgcagtagttggggttgggcgtccgtccaatcgtccatgcgtacacgtacgcccgggagaaatgcatatgcacagaagtgattgtacataaatggccatctcatcttgtcacacacatgtatatatacgattcttcttttgagaaacatgcattcttatagcctaggtgcttaattatgttgaaatcggactccattttccttaggagggggaggtgcttgtattagaaaagacagacgattaattctctcagcaactctgtattaattaattagcacacactactagaaagggattttactagacagccaaaagagattttcgtatgcgggtctttggctcgtctgcgcccagatgtatgcgaaaattattattttttcatgcaggtagcgcaaccgcatgtgaacgggacagtcaccttagccaaccgcacgagaaaatagtttcggcaaaaaaaaaacaaatccaaaaaagaaataggctaaaaccctagccattgaagtagtcctctctattagtgactcgctcccaccgccatcacagccgatcgttgtcgtcgttgccgccgttgcggggaggatcgccggatcaattgggggggggggggtggggggtgaggagggccgccgcaatttattaattatttgtttatttcaattgtagcaagtcacactttcttacttgatgggtctacatgtcatacacttattttttttaagctaaacattatcatatctgtggccaacaactttacgtggcatatgccaccctaatgacaaattgagttggggtaatatcaggcaagaaccaaacataccctaattaattaccgcgccgccccttgtgcgcaagtagtgcttgctacgattggaacaaatccttgtgcgcatggtgtttgtgctaccccactacagtatatgttagggttagctgcctgttgtgcgagtgtggccgctgccctgtccctgtccctgcgcgatcgatatgatgcagctatgcagctgcaggttgctcgatcgattcgatttcttcctttttctctgcatgctctgcacttccgcaggcccgggatgcatgcagtttcgctgcaaaccgatagagcagcatgggcgtgcacccacgtcgtatatatgtatattcatcattgtttgtttcttcatagatcgaccaattcatagccaaaggttcaatattaattgtgaaaagccaaaataatttcttttaaggggtggttcaaaatcaccgaaatttcagatcaatattttagcccctccccgaaaaattttaaatttgcaaagataggtgtggacaggggcgaatccaggataaatgattgtcggggtcattactaaccagggtctatgttttcaaccaaaacggattgaaaacaacgcaatttcgatgttccaacttgggacaaaagtagattttgagtgaaatttagaatagtttttcaagaattcaaatttgaaattgtaaaattaaaccaaattaataaaaaaacatcaaattttggtaaaaaaaagccatattgctatatttggaatctaattttaaatcgaattggtgaaccctgatacaatctgggtgtgttcagacctagctacgggatctgaacccttccctcccagcacgcaaaatagagtgagattaccatatgattaattaagcattattagcttataaaaaacttgaaagacaatagattaatatggtttttaaaacaatttcctatagaaattatttttctagggaatttgaaaagttacgagccgttggccttatgcatggtctcaaatctcaaaaactcaaagtatatgcatattcggctcacgtataatcataaatgctaggtaattttctatttgctgttgctagtatcgtttctagttgtcaattggaatttaacacaacaatcaataattaatgtcaccggggtctaatatttgttttcaccggggtcatagctggtaaaataaagaggatacgagaggttaaaataaaatcatcggggtctactgaccccggtaattgattgtaccttcgtccctgggtggggacgtacgtgcatgcgttttatccagctgtggggattttacagactcatgtatgatagtgttggggcaacgtatatatcaattaatcaatatatatggctaaacagattgagtgaacgatcgattgtttttaatttccgggttgacctaggtccatcttgtttataacccagaaacagtactccagctccaacaacaacctggccaaatctaattgatttttggatgcatgcatacagggaccgcacctaagatatttataattataatagctggtaattaatcgatggatggaaatcgaatccttgcattgcatcgtgttgaatgtggtgcactagtatgagtatgacactactttgcaaggtggcttcggtgtagctttgctttgggctatgaggtgtggatggttccaaaaagtaggccctgcacttctattcaaaaaaaaagtaggccctgcactgttttgatcggatccttttcctacaatattttttaaaaaaataaaaagccttgattggcattactttttatgagaaaagctaaaatgtgatcttaagaataattttagatatgtactttctgttatatatcttatccatcatgaaaataagactaaacaataaaacaaacaaagtggagaagcagaaggttataaacataatttaaaacaaagactaacatttgaaataatatagtacttttttttaaaaaaaataccacaccaaacagactcttattgcttgtagcgggcttctgcttgtttcagcgccagcttgtaaacctatgcattttaaaccttttgttgagactgatcggcaccatttctttcaaaccgactctagctagctagttgagtgtgtatgtaatggcatgctgcctacggtttcctgtaggggttatttgactatgagattttaaaaaaaacaattgttattaaagaaattatttttaataacacataatttccctctagatttggagccatcagtatctcccatatctccgattcaatattcccttttagtcttcaaaacacaagtttccttttaaaagaacatttttctagttcatttttcaagcagaaattcactacacactgtccacttccatcacaatgggcaacacaaataaaaaaaaagattgtagtatggaccgtttgccgttgcaactcatatcatgtagcctttttggcgccgaaaggctgcgttcactaagcggatagatcttctgtgaatcattctcttgtcagcagatagattgctgctgcggcctgcaaacgcctgaatgcatgcttattgcaggaaacataaag

SEQ ID NO: 70819 - DNA, 39405 bp, Oryza sativa
agaactccagaggactaacaactgaaaacttaaaggagctcagcctattcctgcctgcgggtggaaccttcttgtttcctcaagcagtgacgaggtcacaaaactccaagcctagggcgccctttgctctcactagtatcttctagtgctgcaaaagggaaatcacacgatagattatcgtgagcggcgacccaatcaatttatcacgaaaaatcatgtcattcctagttagccagagttgccagctcacagctgccaaaaacatccaactcagagtattatgagaattgtcattaggtttcaacattgatgcaaaaaagtgatcaaaggatgaaggaacaaagttccagctaaacccatctctagcaaaacaccatataaaagatgccatgggacaagtaaaaatgacatgttgagcattttcagtgacaccacaaagctcacaagcctctaaaccttcccagtttttttgtcacaattgttcagtggtttggatccgatctttcattgctagctagagaaagtgtttttgcttaagaggaatcggtagtctccacagcatattcattttggggtcaagtatacctctaaaatttaacaactgatataacgatttcgaggtatagactccattctttccatgaacccatttgagcacatcagcctcgtcggtgcaagcaatctcttgtgttagttcagataactccactcagtcagctctacattaccaaaaagtcttctgaaagtaaggcattctaacccctcttgagccacctctttcacaattattctttgttggttgcaaatttcatagagccccaggaacctaattctcggggggcaattacctatccaaacgtcatcccagaacaagatatggtccccttttcctagagcccattctcccccaagaacaaaccactttatgatatttagtaatcctctccagaattgggagatccctacctctgaaccatagaaaaagcctctatctctcatatacttgtttcttaaaagatcaagacacaaactcttttcttttgattcaagtttaaagatccatttggccaggagggctatattgaaagctctagtttcagtgaaacccaggccaccaaactctttagggaaagctaaattcctccatcttatcatgtgatactttcttttagaacttaggcctgcccaatagaatttgcctctaattgagtccattttctggtgaatcccttcaggcagtaaatataagcccattgcataagtagggatagaagagagacaagagttgataagaacagctctaccactatagtacaaggaacatgttttccaaaaaccgagtttcttgaccaacttctgtggtaagaagtctaggtctgcattcagcaacttgtttgggctaataggaagtccaaggtacatcataggaaactctcctaggggacagttaagcatatttgcaacactctctctgataatttattttcatcccagaaagctcttcaaaacaataaaggaggaactttgttatcacaatctctctgtcaatgaaaggaataaagatcacagtgtcgtatgcatattgcaggtgtgttaggccttcagggatgagatggggaatgagcccaaacagaaggttagcagcttttgcatccttaaagatcttcgcaagggcatcacttactaaattaaacagcaggggagagaggggtcaccctgtctaagccctctgtaagtccggaagaattcacttctttcaccattgatattaacacacactcgtcgtcgctctcttcatcatcttcagcgccatcggcttcatctgctagcaaaagttagggatttgttccatctcgtcttttttaagtttttttatgtttacttttggactttttgtctatgtgcccacaagcagaagctggagatataatacatttttatcattttaaaaaaatcagcttcatctgctgctcagcagctgctgtgctggaggaccaccacacggtggttagcagcagtgaggaaagcccggagggtgcaccctgtcgacgacaccgccgccgacgccgcgccgttgccgcctgcctgatagaactgccgccctgcctgctaacgtgatttcttcatcgacgcgtgtgtatattttacagtgtgctgaacagaaaaggggaaaaaaaggagttatatatattccctccgttttaggttacaagacggtttgacttcagtcaaactactttaagtttaaccaagtttataaaaaaataataatattttttatcaaagataaatttattatgaaaatatattcaattattgatttgatgaaactaatttagtattataaatattacaatatttgtccataaacttagttaaatttaaaatagtttgactttgacgaaaatcaaaacgtcttataaacctgaaacggagggagtatatgcttagtgctggggtgtgtgtttaagttctgtaataagtgtgtacggccgtgtttagtttgtgtgccaaaatttttataagtatacggacgcacatttgaagtattaaacgtagactaatgacaaaacaaattacagattccacctgtaaactgcgagacaaatttattaagcctaattaatccatcattagcaaatgttttctatagcatcacattgtcaaatcatggcgtaattatgctcaaaagattcgtcacgcaatttacatgcaaattgtgcaattggtttttttcgtccacatttaatactccctccgtttcaggttataagactttctaggattgctcacattcatatatatgttaatgagtatgtctatactcattaaacggaggaagtatttatacatgtgtccaaacatttgatgtgatggaattttcagaagtttggaggaactaaacactacccacgtcaaaaaaaaaaaagaaaaagaaaagcaagcatactctcgcgacgctgcagccgcgcgccgtcactgttggggtcagcggcagtgcatgagaacttgagaaggtaaccagccagccagccaaccggaacaagcgcaagcaccgtgccgagccgccgtccgccgaactggggtcattcagactggagtgcccactaacgacggattgcgtgggcttcgacttcatgtcgccggagaaggccgcaatagcagcgatagccgccgagggcgttaacctggacctcatcctcctcctcctcagtccagccctcgtcgtccatccgctggctcttctccggctccggcaatgtcatccatcccctccgccgtttgacctccgacgaggaagggaccggagggagaggaggagataagaggaggggagtgaaatgacacgtgggccgtgctacttttaatttacctttttataaggaataagttcacattaggtccctctatttgtcgcccagtccgactttcgttcctcggtcgcaaaaccgggtatgatgggtctcccaacttacaaaaccgtgcaaaaaaaggtccctcggcagtattgtgcccggttttggatgacgtggcgcctacgtggctccctttgactaggtcctcgtccaacgtggcattgacgtggcaaatgaatcccggaaaaataataaaaaaaacatgagacccacatgtcagctacacaaaaattataagaaaaggtggggcccatgtggtcccacatatcagccccctcttatctctatccccctctccctcccttacagaatggcgagcggcggcgcagaggggggcggtgggcggagcggccgggtgaggaggggcagcttgcggcggcacagagggggggcggtgggctgagcggcgcatggcatgcggcggccgggcgaggagggaggcggcgctcggcagctgggcgaggagggagacggtgcgcggcggccaggcgagaggaggggccgcttgcggcggtcgggcgaggagggaggcggcgctcggcggccctctcttccgccctctccactggcgcggcgcgtgccgccgcttctctccctcccaccagtcggccggcttgcgccgccgaccctctcccgccggcaaccgcgcaccgtagttcctctctcgccctcccgccggtcgccgacccaaacgcatcgccgctcctctccctccctcccgccggccggcgcgcaccgccactcctctcgcgttggaggtgcatgaagcgtccttggcgaggtcgctgctccgccgtgaggatgaaggagagccgagaagaagaggaagatctgagagtggagagggagaggggaggggagccggcgagctcgagctcgccatcctacccgcccgtcctcgccgaccactaacagcggacgcttgctccgcccctcttccgctgcctcgacgtcgatccctctcgagttcatgtcgagaacgaacgagcgagcgaggcggcgaccttggccggtgagcacgcctgccaccactccgcccgtcctcgccgaccactaacagcggacgcttgctccgcccctcttccgctgcctcaacgtcgatccccctcgacttcatgtcgagaacgaacgagcgagtgaggcggcgacctcggccggtgagcacgcctgccaccactccgcccgccgtctgccgtccctctgctccgcccgccacccgccaccgctccgcccaccgctcgccgccgctcccgccgcccctctgctccgcctgctgtgcagcgctcctctgctccacgcgccacccgccaccgctccgcccaccgcccgccgtcgctccgtcaacagcccaccacccgtcaccccctctgtgctgccgccgctcgccttcttgtagtatagaggggagagagaggaggaaggctgacaggtgggaccaaataggccacaccttttttaattattttttttagctgacatatgggtcccatgatttttactattttttcggataaaattgtcacgaaagcgccacgtcaatgccacgtaatcgccacgtcagtgccacgtgggtcgaagacctagtcaaaggagccacgtaggcgccacgtcggccaaaaccgccctccatactgccgagggacattgtttgcccggttttcgtaagttgggggacgagtcatacccggttttgcggtcaagggacgaaaatcaaactgaccgacaaatagagggacctaaagtgaacttattcctttttataactagcatgtgggcccatagtttttattattttccacttcaaattacaacgtaagcatcaagtcaacaccacgtgggacaaaaactagtcaaatgagctacgtaggtgccacatcagctaaaactggagacaatactgccgagggaccttgtttgcaccggttttataaactgggggacatgttatctggtttttcagttaagggcgaatattactgggcgacaaattaagggacccaacatgaacttattctcttttgttgcaagtttgtgaattcttgggtcatactgggccgtcctgtctgcatgggctgcaagtagatagcccaggtcgacttcttttctgcttttgactgttccgaatataaaaataaattatagtaaaaaaaaagaaagaaaaaactccaagcaggaatcaattccacgagatcaagaagaagaggaagaagtcgcttcgcgggcgatggcgagcagctcgtcgccgccgccgccgccgcagattcgttgcgcctccttcaatcaggacaacaggtacgaccgagcgaacgacaagtaactggattcggggggagtcggcgattctgaattttgggggtgggaagggatttcttgggtcggatccggcgacgaagaaccctaattgtgattgcgtgccggttgatttgtttcagcttgttttatgtcgggacgaaggatggattcaggattttcgatgcccatacagggaagctccactaccagaagagtgagacttccttcaatgcatcttccttttctttacccatccctctgttcttgttgctctccattgcctagcgcgaatatccaacagtacagcatgtaaaatttggcacagattgctcgtagattgtgaagtagaaacagttaattcccagtaggatgttaagctgaataaggttacattgtgctgcctgcgttagtcagctaggttaatagtcattagtgtgcattgatgtatggtagaaccaaatgaattttattgccgttagcatggaaactggctattctatcatggaggagagagttgttctgtagtgcttttataagaagctatggtgttatagctatctgctcaatttgcagatattggtggaatcggcaatatggaaatgtactttcggacaaacattcttgctatagtcggaactggtgaacaggtacctcggccatattttccctgtttgcttgagtcgttcctgctgtgtgattgtctgtcatactattgaatttaatatagacgaatttgctagttaactaccgttcaaatttatctctgcagcctgtactatctcctcgctgccttcgccttatcgacaccgtagcagctgtcacaaagaaagatctgaactttaagacttcagttttggctgttcgattaagtagaacgaggtatgtcaccagtattttatatcctagaagggactacattagaaacatgttagtttttttatgatataaagatatttcttggttaacatatttgtgcaaaaatcatgcaatatataatgatgaatcccatattatacttgctcgtttttttttctgtaaaatagttgtcacatcatgtgcaggcttgttgttgtattgcaggacaggacctttatttatgatgtaaacagcactactatattggaagaaattgaaacagttcccaatacaaaaggtgaggatcctactgctgtttgttcctggcatcaagttgaaggagctagagaaaaagatcattaagcattcttgagaagctctctcaccatatttgctgttaatattgttattctttgtatatcaggtctttgtgcattcgctcctaattcagaagcatgttatttggccatcccagcaagcacatccaaaggatctgctttagtttataaggcatcagaacctgaattaatatgccaggtaatttgaatttgttgtttattggttaatcttattggctgttgtaggctattatccttccatgagattttctcacacatccccacgcattaatgttcttctggtcctggatctttcttgaaattattgatttacatgccattgcatttcattgataatttaggatctcttactgccttttcaaatcagagggaagaaaaaagaacagttatgcaaaattagccgtgtaagatatttatgttggtataataagctgaaaataacaaaataaaccattttccgaactgctttctttcactttgtattattaattattagctttgatagcttgttttgttctttctttacttatgttatgtcttttcactgtttttgtgtaattgaccaacagatagatgctcacgagtctcccttagctgcaatggcattttcttctaatggcacgtacctggcaacagcttctgggaagggtactattattagagtatttctcgttgcacaagcaaccaaggtgaattcaacgttatttattgtctgctcttgcaaccaactagattttcctaaactctttttacatacatacttcaacagtcacacagttttcggcggggaacatacccatcaacaatatattcactctcattcggaccatcggatgatctgcccgatgttcttgttgccacaagttcatcaggctcgttgcacatgtttttcctcgatgctgccagaaatcgaaggtacatagccagctcaaatattgataattcgtggacggtgtatgtaggcatgatctgatttactccacttttcaggaaccaaacgagcaaattgcttggttcaatgattcctggagcaataactcgtgctttggatccagcaaaccatcacattattcacaacgtcatccctgcaggaatcaagaggtgttgagttcatctgatttccactactttctaccttccattattgtcattctaatctaatcctttggaatttcagctgtgtagccgtacataaggtcgaaaattcacaaaattcttctaaacttcctgctttaaggtaagaaatgaaaacgccttttttctgcccctcatctttatttagcatatagctactgtgggttagtaaaatcttacccattattgtctttgcaaaaacttgcaggactgttgtctatatcataactcatgatggatacttccgcgagtactcgatcaacaccacaaagtcaaatgaatcttcctgggttttgcaacgcgagctcaatctactggataccggttgtagcactccccagcgggaggaacaacacaaggactgactagcagactagttggctcaccaatgacagaagcttcagctgtgtgtacatacaatttgtaagatagtgtgctggtagggctggtctgtggtttgggctgagattctaactccaattggacaagtgtatcatagatgtgcccaccaatggtgagggatgattcatccttcttgtggatgtaaattatagatagtaactgccaatatggcaatataattacactacaagtatatgtaactgctttgctacacgactgacagactttgccctgagtggttacaatgaaatgaaccagcatactgccatactgacagaagtccgcgcagattactccacactgggtattgttctactgctctaagcatcatgaaaccaaaagaaaaatacataagtgcaaggattttgctaatgatagcgaacattccaatttgttttcccttgcataacggcacctcgataaaaaccggcgctctgatgatcataaacagcaagatataacttgcataaaacaatacatcctttttagactaggataatgactgactgcagtccctacaatattatctctccattgtttttcttgtctgatatgccaaaagtctccatttcaactcctccaaaaaccttattgttaacacataccttctcaatccttcccgtgctgttccatatctaacagcatctccacaagatcagatctgaccaaaaagaagtatgtttgcattaagtatgcagaaatttgcatcagaacaaattagggatttctgagcatcgtgtccaatttctactgcaccaatatacactttttagaatgtcgccaaaccatatgaaaaatgttaatgagggcaaacatggtcacctgggctgcctttgctttgagcctctgtatctcgtcctgcgaacacactaacctgcagtgctccaaaatttcaggactgaagctatttaatttctttatcaattcggtctaaaaggatggggtaaaagatcattaccgccattgcagctcagtgatctcattgaccagctccttctccttttcgtgtgccgcttccaactgaaaaggtagtaatgtctttgctcttataaccaattactataacaactgacaattataaatagcagtcctgcaatgtcttaaattattttccccactctgatatgatggcactacatattaggaattattatatagaaattactagtatttggttctctataatctcgcagagttaactttgagattcatcctagtgtggttaactcaccaatgatctgtcaattgataatgctgatgatggagatgatgcgcgacttgcaggagcaatgcaggcaggtgacgtcattgccatatcgcaaccacttaactgtttcatcgcatgaagtatttgctcctgcaagtgaggccaagactaccatcaacagagctgaacgtattctagctttttttttgtgacttgtgagtttgtgtgggttgagagatttaccctctgaagcatatttgtctgtagaacattgtacagctgcatataaagggacccaccaataatggttgatgcagcctcaattgaggatggtatacttaacgaaggaaggtgcgaaattgcctacgtgaaaacaaagtggcacgtatgttagtgggggaaaaacccacaataaaaaatgacctgtatattgctcccaacagatggcatcaattcttgaatcgaacgatattgaaaatcctagagataaagctaataacctgcatgctgtgactcttctgtagtccaggtgagtgagcctgaaacgaaaaatcatgtcatcccagagttaacagaacatgcagtaagtatttatggctggaaattaccttatccaactcaacatgcccaggcgtaactttaaaacggcctctttgctgtataagaggaggtttcgatctatcgtcgtggtcctcaacatttgctgctgtattaaaacgaagcacgttaaaccgataggcaaatacaaggttttatgtagccgtaaggaacttgttctgatgagttaccactgagttagctgatgctcaaacgtgactgaattgtcactacggtgaagaaaaaataaacagatttcagggttaaatgcatttcactacctgatgatttaggcacctttggaacagcttcaggggatggttcatctgcaacttgcaagggtcctccgttgcacttgtcacggttatgaatgttaatttgatgcttcgagctgaacgaataagaggcatgctgttacagactgtttaaaaatagcacaatagcgtcatgttaccagcaccatataacaatagcttctcaagtaaaaagggattcgtcatattcatggataaactaaaacaggtcctaaaacaagatttgaatcattctcaaacaagtcagttcaatgtttctaatttttaggttgtgctgctacttgggaaaatgtgattcttcaaattagcatgcactcgtcagtctttaaagttgaacaaacctctctttggatgaaagaaatccatcagatgagcaagaactgaaagaaaacttcctttcatgaaatgagctgaatgaactggttggaatagcatctgaatctttctcttgcaagtccagttcactactttctgtggagctgtgtttcctgacctggccatttgcatgtaccccgtttgtagtcctgagcattgatgtattcctggcaatttaaattagtaaatgacagttttcagaagagaatagtacaagtacactgcagaaatagcctatataatctggcactgccactactctagtgctcgaacagaaataagaccctcttatttgcaagcaactataaaaatctgaataaattaaataccttgctaaacaaatggggtgctcaggagatgaaactgctgacttatcattgctcatcacatcattttcctaccaactttgctcggtattagatggaagcaaaactttatactaggttagaacacaaaactttatacaaaaaattatacttacggtgtccgtatcatacttaattgaaaaaactcttgacatatgaggtcctgttgctcgctctggtaaaatggtgtccaagtcatagaaacatgatgcatctgaatctttgcacgatatactgtcatcacactctgtaatctgcgaacagacagatagagaaattacatgatgtgaatcaatgactaaagaagagaacagaactagttcttacaagtgaagcttgagacttcaggtcatccatatcaaagttccagctactgatgcctcttttgtattcatcctatcaatataagaaacaagaggagcaattatttgcttgtaatacaatgtcgacaatgaaataaacatataaataccaagacaggaaaaaagaaatgacctagaatcctaaattcaggtaataaatgcctaataatatgttatagttattacactaagaatgtgtaagtttttaatgctgcaaaacagatattgcaatttccgtacaaatcgaaggaaattttctaatatggactactcacccgaggttatgatcaccattattatgttttgcacaatatgttttgggaatcctttgatttacttttttttttggcaaaaatataatagtacacaacaataacttcattgatcctcgaataaagaaactaatgagaaacaagtgtatcatttgacctgcacacctgcttagaaatgcttgattatttaatgacaccatcacatatatacaattatacaaaggcgtactgaacaggctcagtgcaagagaaaatattttatcaatttactataataatagaaccatagttaggaaaggtataaatcagatttttttttctagatgatctaacagaaatgtagaattggcacctgtgagatttcttccttctgtccatcaggcattttcttttgagaaagtaaaacttcatccttttcctataattaatagtaagctccactgttaacttagtgaagacgatcatttgcccccaaaaaactagttatagagccctaaaccagtgtaccttcagagctaaatatctggcaccaaggccaggcaatccctccaaaagctttcgactaatgaaatcactggagcgagcttgcttgaaaaagggttgcttcagcaattttttcgctgtaggcctttttgaagggtcttttaccagacacatagcaaccatttgcttgaaatgctgatataggagataatcgttgttgacaaataagaagtcatgctcatcataaaaactacaatggtaggtctgttcaaatattaaacatatttacccttgaaaatttcttatctctctcatagtcaaggcccggaggggcattctgaagtgtcataagtaagacctgacaaagtgtatgaactatataacttcagaaaagtccaccaaacccatcataagggattgtctcgaatttatctcaatgtcatgcgtttgattataccttcatgggagggaacttcgagaaaggagcatgaccatgggcaagttcaagtgcagtaattccgaaggaccatatgtctgccctgtaatatatttgtaagatcaagcttgtaaacatgccatggtgaagaaagtatccagacagttaaaataagtagtagcctacttgaaatcgtatccatgtagctgctccataacctctggtgccatcctaataaattacagtagtccacagattagatgtgtgaagacacgttaatggtgcataaatgaaagcatatttgctactttttttcagatgagtaccagcaaggagttcccacgaaagtattcctagcccgttgcctgtcaccagaatcaaaaaggcaagcagaaaccccaaaatctccaagcttgactacaccccgtgaatcaacaagtatattccctgcctatgatcgaaacaaagaatgcagcaatataacatctccataaacaactaattcgagaatatctgtgtgagatatccatgcatggctcaacagccatacataagaaaccagctgtggtgcaaaatgttcatttaccttcacatcacgatgtatatgcccatgatgatgaaggtactccaaacctttcaggacttcacgaagtacagttgcaatgacagcttcttcaaaaccatctggatagactgacttcattatgtgaaggcaagaccctccagccatgtatggcatgaccacccacaacgagtggttatttgtaaatgaacaatgtgccttcatgacgttaggctgatctatgagaatcatcgtctgagcttcacgcatgatgttgttctgcgtcaagcatatccgtgttactatcattttagacagatcaagcggcggtacgtaaatcgcaacaatccgagtataacctacttgcattacaactaaccactgcaacaatctgacatgaatgcagtcagcaaaaaaaatttgagctataattaactgtaagacaacagaaataatatatgaaaattttcgatacgatagtatgcgactcattggaccaaccgaccgttggacaatatcatccacaagtacatttgtaaaaattaaaatgcaccggaggataatagtttaattaatctgcaaatcaaacaggttaattaagcgagacgatggatctctctccctctacgcaggattgggcccaacaaacgaattggagatgatgtacgcgcaaacgtaccaggtcactgtttgtgcgctcgaagtcgagcaccttgacggcgacgatctcgtcgaggggcttgcagagcgatcggtacacgatggcgctgaccccctgcccgatctcctcgtacagctcgtagtcctccacgcggatcgggtacttgcgcctctcccccgacccacccaaccccgccgccgtcgccaccttctcccacgccttggccatgctcgatcgatcgccccttccctaccaccaccacccccacccgcatccaccgccgatcgacgaagcgtacggggacggggcgctggaattggaggagggatttcgaggtggaagtggaggcgaggagggggaggaggaggaagagcgggaagagggggacgtgtgaggtcgcgcgttgcggaggggagcgagagagagagagagagagagattgggggaggttggatcatggcggccgaagcgggaggccggagatttgtgtcgagggagcgcgccacctgggccaaggcccaagggaggcggcacgggggctacgtggcgtcgcggcgcggcgtcggatcaacggccgtgaggtttggacggagatgcctgtatcactgtgtgtggcagtattgggcattcttgcgtattagaacagattgaatttgaaattttgaattctaaaattagctgatgcatggaacggaggtgcttgcatgtaatttcgaatcggcctcgtttggtatgtgtattcagcacacaaatactaacggtactacatcggttacttatggtccatcggtcttagcgaaaatttgaattttaaaacttaattttagagttgattttaagaagtttcgtagtttactttttcaggattgtctttttaaattgctaacaacatataaaagtttctcatcaattatccttagctgcttcactcaatttatttattttttatatcttatcagccgtaaagaaaatgatggagttgtgattttgtaaaatgagagagttgcttgtacaatttgtattttgtttcagcgattattaatcatatcatgcaggaaagcaatcatatgaagatgacatagatggcgggattagagaaggctcacactgccccaataattatcctcatagttataggaataccttgcaaaatgttaacttttaataaaattatgaaatctattagagcaagcatccgttgtagtctagctggttaggatactcggctctcacccgagagacccgggttcgagtcccggcaacggaatttttttgttgtttctcgcaccttcggtttttatgcgttttgacccaacataaaaacggacagcatgttctgttaccttcagaagactcaaatccttctctgatttcaaacaagacgatgtccgcaccacctgctacgtttgcatgttctctagttctccacgtatttttctggttcagagttcagagtgcaattttgcacagctcgtccatgtaggacgacaatacttcacacatgcactactactctactggagtacattggcttcctaactctgaagctgtataacacttctctccgacgaaacgaaacgaaccccaaccgaagtggtaaccggcgaggtcgccttcctttggattggattggattggattgcgactgaaacccccatcagagttcagaaacgccacacgggatacgctatgctttgctttgcttcagacgcttccgatatcccccacatcctcaaggaagcaaccagacaagcaggatccaactgactggatcattggaggcaggagaccttgagctggatatgaactatgaatatgcagtgaccccaacacccatatggagtactgtactatcttatctgaagaagagaacactcacctggacgtgggctcgtggcacaagctggatatgaagaggcccatgcttcatcaatcatcggagtcttgcattgcacgtcctaaaccttagcttcagttacaggtcactttaacttgacagcaacgaccaatggctttaggttattttccctttacaggttcaagttggagccaagtgtgtaaatccaacagagaccagtacattactcgtatacaacaaaacaagatcaagtgatcaacctaaacaagttatttggctaaggccctatttgttttagcttaaaattattgtaatctaaattattaaatcagattactctaaactggattataataagttgacataaaataagctgcaagttgtttgtttctctggattattagaggcatctaaaagtagtaggtctttaaccactcaataatctgaaaaaagctcctctataggagattattggattatactaatctgacttatagattataataatctagcataataatctagttgtttgtttcagcttacttctgataatctagattataataatcataagctgaatcaaatagggtaaaaaaaaacaggatgcagttgggcttaaaataggtttcagattagcaaagcagtacactttttccgtcgttgtcctcttttattcctcgcgccattgcactctgcacgctgcgctgcagcagagcagcgggttttgttgcttccctcccattagatgggtgggggcccgacctggccattagcaacagcgagcgcactagtcctccactgcccaaagtaaagtgctccatgtcaacaggtgaggccgtccgggagatgatcagatgaatcacaattaacttctacttgtatttttattgctatcatgaaacttgtcacgactcaccaccgcacgaggcctctgatggatgcaattactgtagatatgtttatgttaatccttgtgtacgtcaaataaatcggcagtacgccagtacgtagtagggcaatgacaacggacagtccaaaccgacgtcgaatactctatagtatcccggtcgacgggtcgagagcccgaaacggtgcaggcacagcacatttggtttcaggccttttcaggttgcagatgcctcgactctactacacgcgtgtcagcgtcttgtttgcctttgcctgggttggcgcgacacagaatcggagatgccaccggccaattgatcctggactcgtgcaacccgatacaaaatgccacgggaagctcgggtttgccgaaaattcacgggaccttgctccactggtcgcacatcccgatttcacaccggaatagtagccgttttactcgtttttcccctatcctgacgtagtgcaagatcatcatttctactgcaatgtgcagagagcaactcatgctcgggttgcaaatattaattcaaaacgatgaatcatcaacggattctcttcaatttatttgctctaccagatttacaattaacagagtttggaatacaaatatttttttattaatcaaatcctgataattagaagcgcagctcatgagggtagatctcaagaacaaaacacattcttattccctatgcaataaagaaaggcagttcgggtacagctcagaacgacgagaggccaccgaccgcgttgacgggcccacccatgtggtccaacgtgggtttaggtgggccccaccccgacaatcccgccccacctccatccacagccacagacaggtggtcccacctgacgccataaagcaacccggccccaccgcccagtgccagcgacgcgggccagctggcgaccacctcacgcccttcgaggcgccactcgcttttccccttctctctctctctgcttatcttatcacattagaaaaaggcccacggttggctcatatttacaggagactgccactgcttctcctccttcctatttcttctcgcattctctccctcgtctccgggagaaaattttgcgggcggcgaaacaaactagtaatcgattcgaaatttaaacgcattgttgttttattgtttgattagtttagctcaagaaagattcatagctcagctatgaccagccagattacacacaaaaaattcgagggtgtgaaacgttatggagaacgaaatttacagaagagcatggagaagataaagggaaaaggaagagaaaaatgctgctctccattgctttcttcttcctccctcccctcccccaagaaaagaattccccccagtattccaaagaacatcctaaaatatttcccccaaaaaaaaagtcgaaataagaatgttaatgttttgatcctggagtggaatcgaccactggatggccagagaataagaagaaaaaaagaagaaagaaaaagaaaagaattagcagaagaattagggcggattatagtcacaagttcttggatcccctggtgtagccgtagtaggagaggtaccacttgacgaacttcttgagcccgacgtcgaggttggtggtcggcttgtagccgagctgctgcctcgcgagggagatgttggcgtgcgtgaatggcacgtcgccattgccgggcatctcgaccacgttcttcttggccttcacgcggaggtgcttctccaggatggacaccaggttgggcaccgtcaccggcgaggtgttgccgaggttgaagatcctgtagggcgccggcccgcgcttcttgcccccggtgccggtgctcttcccggccgtgtcgagcgagccgaggcagcccttgacgatgtcgtcgatgtaggtgaagtcgcgggcgaggtcgacgcggttcttgccgcggtacaccgtgatgggcttcccctgcaggatgttgcgggtgaaggagaagtaggccatgtccggccgcccccatggcccgtacacggtgaagaagcggagtccggtgatggagaggccgtagatgtggttgtacgtgtgggtgatctcctcgccggccttcttggtggcggcgtacagcgacgccggctggtcagtgcggtcgctctccgtgaagggcaccttgtcgttgaggccgtagacggaggaggaggaggcccagacgatggccggctgcgggtcggcgtccttgcatgcctcgaggagggtgacgaggccggcgatgttggagtgcacgtaggacgccgggttctccatggcgtagcgcacgcccgcctgcgccgcgaggtggagcacgtgcgtgaagggcacgacgtcgaagagcttggcgaggaggcggccgtcgttgatgtcgccctcgatgacgaacaccccgtgcgaggcgagcagcgacctgcgcgccttcttgagcgaggggtcgtagtaggagttgaagttgtcgatgccgacgacgccgtcgccgcgcttgcggagcgcgagggagcagtgcgtgccgacgaacccggcggcgcccgtcacgagcaccgacatccccgcgcccgccgccgacccgggcggccgcctcggcgcggcggacgcgcggatctggcgctcccagtgcagcccgccccaggaggcggcgaagtacttggacgaggtgtcgacgaaggactggaagctgaggtacgacgcggtcatggcgacgaggaagagcgcccagaggaacatggtgctggtcgacgcgaagcagcggtggagctggcggttcatcgccgtcgccctctcgatcttcaccttccccggcgtcgacgggaacatgtcgtcctccagcacccgcatcctcctcgcccgtctagaaccttctagattaccaaaatcggcggtgccttttggatcgagggagttcttggggggggaattcggggattggaaaaaaatattattattagggtggggaaaggaggggggcaggggctagatgtgcgcctgcctgaggaaagggtggagatgggacgaggccggatataaatagggggggaggagacgcgtgagcgccgccgcggcagctgctcgctgacggtggcggccggccgcctggctggttgggtgggtggttggttggttgaggggagggtgatcggtttccgtttcctttccttccttttctttccttcctctctttgttgtgtggaagggagtatttatttatagtagtttgttgctatttttgatggatttattttatcatatattgatcgattgggaatggctggttttgtgtagtgatttgtgtttccgcgtgaagagtgtgtgaattaatctgctgtgaatggcattgcgtcgtgcggtaataatggtggtgaaatgaattcacgcgtgtggagaattcgacgagtttaatggaggaagcttccattgactgggattttatttatttttggataagttgtttttggaatttatttattgggggggggggggggggacaataattctgcccgtagaaatcgtgtcacatggggggtcagatttgtgtgttttagtttatctggaagcggtgtttaacgtggtcatgcaatggcaatagcgtggacagtgtgattcatcttattatttccaggtcttcaggagcagattattttacggtgaatagctaattcggtcattaaacttttgttacgtgttaaattagttcttgatgtttcacatattctgaacaagctttaaaagattctcgtgtggcttaaaacagttctcgaacaccattaaaaatgccacgtggtattaccaagttattttgcacataaaagtcagcatttaaatctccatatttacctgttacaactatgggtgtgttcggaaccctggttcccaacactaagtgcccgcacggaaaacggagcaacgattagcaggtgattaattaagtatttgttatttttttaaaaaaatggattaatttgatttttttaagcaactttcgtatagaaactttttacaaaaaaaacgcaccatttagtagttcgaaaagcgtgcgcgtgaaaaatgagggaaatgagttgagaagagagacggctgaacacagccatatatggtgcacaatgtttagctttatattttgagtaggaaaaaaaagtgggtgagagaagaaaaaggagacaccgaacataaaacaaaggaagatgtcacattgtttaattaccaatgcaacatctgtttcgccaatgaccaaaaactgaagacccaaagggcaaaagtatctgccaggcagggagtccttttgattcaactatactaagaataacaaacccttggcgacccccaccaaatggttgggcaaaatcaatatggatggggctttctcctctaatgaaggaaatggagcaataggaattgtgattagaaatattgacgggagagtaattctaacgtcctagagatttttcagaaaatgtgtggcagcagaggaggttgaattatttgcttgtcgtgaaggcctaaaatgtaccaatatcggtcgagtattgagtctgactgtggcacggtaattggaagtaagcctgctaatggattgagttggaatggcttaaatggactggattctagtttggattatctttgattgggtgaaaatgggttgctatttcaaatggattggatcggttttggtgacacataagtggattggtgtggcctggatttgatttggtgatatcgggttgaaagtggatttaacccatggatggcaagtggattcctttaacagaccgagtttgactactccttgttgccgtcctcttcgtctcgggagaggtcacacatgacctggacttggtggcgacagtcagcggagaggccgcgcatggcggcaccgtattcgtgggagtcgaggcagttggaacgtgtctcgttgcatctcttcgatctcctcccgtctcgccgctagagctacccgctcttgtgccgactaggcttcttgttgttgccccactgctcccacatggcgattggatttccttgccgtggctggtgatggcccgtgctgagcctagacaacatctactacggcggggatggtgccgctgggcatggtcaccatagctaactgcaggtgtgcgatatgtacaaagggagcagttgtgtcgtcggcccatcgctcaccgccgccaccgccgaggagacggccttagcgagctggctggcctcacgatgctcctgcgcctacgtcgacgtgaccgtagctgagaacggcgctggcgtcatgtcctctgccgtcaccacgacgccacagttacatgcatgcaacatttgctctatccagctgcgtcgccgccggtgagtacggcatgactattgaaggatcgaagtggatttgatgtaggtttaaatggtttgggaggtggattgaggccataaaagaagaataggttggttcggtttagactaatgaggaaaatggattggtctggtttggattttatgggatggctagtggattgggatggtttgggataacattgctagctgttgtggattggattgaatatggggtggatcttgcccaattggtaggcttaatttgggaggttattggctagagaggaagaaagatcaaggtggacctttctgctgcgcgcaacgaatgatacaatgtcatttgtttaagaagtgtgatctgtcacactgtaaaatagagtgtaataggttagctcatgatattgcacagcttgcaaaataatcaagtcagaacgcagtttggtgtgagactatcatggcttgtgttatgtatatgggcagcatgattgtaatccagttacttatcgataaaactctcttttccaaaagatatgccgttatgttttgtttgtttgttcttcattgtttttccttttttttatgaaaaatgtaatagtagaacaaatattaaatgctaaatttgtatgaatggatgatgtggaatgaccattggcgtttctagtaagcccgaagactatattaagccacgtcagggaccaaaatgacgttgaagtgaaagttctagggttatcaaccccgttattttgtccacggcggatgacatcttttttctcgttttcttgttccaacttccaaactcacacagagccgacagaggttgctcatgcagtcatgctccagtgctccacgctagtcagtgccatcgtggcaatggatctgaaggccgggggttgaggaaatccaatttagaattcatattgttagacagaccttgctagttgcctttcttgttggacccataccgcacgatcttctccgtgtgctaatcgcctatcactgaaaccttcccctgcgtttgtttgctccagcctccaggattttatggcgagtactcattctatcctataaaaaactaacttaatagctaatggcatgtatggttagaacattagtccattagtccctataagagaagcttatagggactgagttgtttctttccacctgctgcccccactcacaaccctatcctctctctctctgcattgttttagaggtaacatgttctttttacagtgcaattaataatctttagtctttttttaatccctgtatccaaacagacatggactaaagttttttaagtcctacgactaaaggatgcaaacaccaccctaagattgatatatcctactaaaaatttagcggtttttttttatggaaagactacatgcgccagccggccggctagatcgtttgctagatttgtgtctcgcccacgatcgtgtacagttggaagtcgcccacgatgcgttgtcgtaaacgacctcatctacctacgcgcagcccagcaaccgatcgagagagagctcacggttgatggccgccgcctcctgcattcattcaggtaacagtagtagtgagctacctagcctccctaccagcagcacgagaaaaaagaagagaccacatataatgttgggttgttggagagaagccttggattcacttccaaacaaaggatccgtcccaaaattccccaatccaatcaacacagaaccagccagaacccctagagggatcatctcatgtgcgtcctcttgacgacctttccacaccccccaagccaccattgctgccaaagtggcaaatgtttgcatcccaagcctgcaatgccaagcactggctgtgcacggatacgtactgcccatgtgacgcctcctacccaaccctgctgcaagtgctcttgctgagtcgctggtggtggcctagtgcatgcatgtctcagcctttcttactgactagtctctctgtttcataatataacaacatgatatgaaatgagatgcatcatattgttacaaaagtgattcatcgtactaggataagtttaacacgtactagattgttgtattatgggaggtggcctagcgcatgcatgtctcagcctttatcactgactactctactctgattatataacaacctaatagggaatgagacatattctaatattacaaatgtgaacatgagatttgcacagattcatagtactatgatatttttttattttatactaaattatcactccctccgtctctaaatatttgatgccattgattttttttacacatgtttgatcgttcatcttattcaaaaacttttgtaaatattatttaaaaaattgagtagtagtagtatatttaacaatgaattaaataatagaaaaaaattaataattacttaattttttttaaataagacgaacggttaaacatatttaaaaaaccaacggcgttaaatatttaaggagagagggaggagtattatactataggatagaggatggagggaatactcccctagctaactgggtgtccccagcctaatcaacactgcgtcaagcgaccgtaatgtgaagcacggggggcttttccccgtgtttgggtggtcaaaagctggcttgatctgtcgttgggacgtgagtgcccacatggagtaaacagtgggacgccgataggatcacttgtgaactctgatgcgtgcatgcgtgaatggatgcttttttggagattgcttccttatgagtggcgattaattaagccagtgatatactccgatgagtgagagggtgacgtggcactaaccaggaacatttgtagttgtaggtggggggaaagaggagaagagcattggtcatcatagctcggtggatatggaggccgatcgaacttattcttctttttttggttcggttctgatttctttttcatcattcctgcgtgacacatgagagctacggtttttttttttcaggaaggacaggtccaacgatacgatggattagtgcgctagaagttggtttgatcgagtgcgtaagcttcaagttactgcaaacttttgctaatatgcttatccaaaacaatgagccgtttctggctagtctttacgaaaagtattttgtattttttggtcaaaaatttaaattttatcatctacagttggtacagttgggtgctgttaccaaatctgattggttcatctcgatcaaactaatctaaactcgctctcgccgtacgacaccggacacacgggccccttttcactttgttgggcgtccaaacaaaaagaagccaattgatcaggacagctataacatgggtagcttgcaaatgaaaccttcaactgtgccgttaaatgacaagaaaggctttaatttccacgcgctccaatctccgtcgcgaccgcaacaaaaatatgcatatccatccatctccgatgatagtaacatcgtgacatgatgacacgagtaataaatttctgtgaggttatccctctaattataggttagccaataataatactaatatgacttcaattaaaattgttaacaaattagtatttgcaatttttgaatctgtacataactataaacgatttcgggttaaaatttttgcaacctatgtaactataaacaactaaggtcctatttgtttcaacataagattgttataattcagattattgatccacgttattataagctggattataataaactatagtagaataagaataagttatgagttgtttatttctctggattattgggtttgagctaattaatgtttataataccataagctattgcggagtgggaggaggatgagacggcggcggtgatgcggctaggggaaggagcggggcacaggatgggtgtcggtgatatgggtctggaggtatcaggaccatcgggaggaggctgcccccggtagccacgtgcaccccgccagggggatcggcctcctccgcccacctaaccgcatttaaggcagtgtgaacgagcgcaccatgctacattaaatgcagtgcgtggtgcgccttgttgtattgtgaccaatctgggaccagtcgaatgaccgatgtggccagggtagtacgcctgtgcactgtcacattgcgtatcacagccggagacggtttgcctaacccggtcagcgtaagatttctgtttcccggcgcaagtggggacccaaaagtcttcactcattaaataccgaatggcatgcatgtcccccgtgtcaactggatagatttgatgggccccacgccgtagcaacgcgtgcaatagacttccaaggcaagcaacgagacatgcatttaatgtgattatcctccctggataggctgggtgggcccatgtagtaaccccttgagatataaaaggaggtccaggccggaaaggctaagggacgatcgatcgcccctagcgcggtcccccctccctccacgtggtttctttttttgtcaccgtattactttcttattttagtaaatttatgcacctaaagtttatacatctcaagtttacacatctaaagtttagagatccaaagtttataagtcaaaagtttatatatctaattcaaatttgaatttgaattcaaatatttttttatatattgtatttctatacatctaaagtttatacacctaaagtttatagacccaaagtttataagtcaaaagtttacatacccgattcaaatttgaatttgaattatatccaattcaaatttgaatttgaatttgaattcaaatattttttatatatagtatttctatgcatctaaattttatacacctaaagtttatagacccaaagtttataagtcaaaagtttacatatccgattcaaatttgaatttgaattcaaatattagtttataggcccaaagtttataattcaaaagtttacatacccgtttcaaatatgaatttgaattcaaatatttttatatatagtatttctatacataaattttttcaactttatttttttatttttaaaaaatgtatggtgtagtaggaagagaagatgggaggaggaagggagagagtagcttataagggatgggggtgatcgcctggagcggtcacccgcccattagccacccccggttcaggcctatctagggagggatgagcctttttcactaaagcagtcttctgccctcatcatcaacagcttctactctaacaaggagatattgtaatttctcacacaatcagctaagcacaagagtagagtattatgcttcttagcggcccgaacatgtataaacccctattatctcattgttctcgaggaatccgatctcactgagttctcgaatctcacccgctgcctccggccaaaccaacaaagtggggcctcactgtcccccgctagcggagttcaccctccaacaatggggcttggggaaggatttgcgcgcagggtttgggtttggagaatgattcgcgcgtgactagggagatagaaaggaaacggatgcgttgggtttgatagcagtggtgggtaatttacataaattttttaagtgcagtgggtcttcgtgtccgttgcacaggattctggaacgtcaattttcttatcttcttttttttttaagaagaaagatattcattacttagcttggatcggtcaaagactcaagcgtcgtaactttctgaagtgagatatacggagtactatttacatacgcaaatccgagcgatggcgactggcgagaggtggtgagctaaggtatctatccgtacctgcgccgcgcaattgactttcccggccgcgcaccgcacgtcgtggctgcgtttcgtttctcggtctcgcgcgcgtggtgtcacgtcttgacccgccgctccgacgatctcgcgcgtacgtacgtacgtacgcgacgacgactgaatggcaacagcagcagccgtacgttgccgtcgccgtcacgcacggcgcgacacttttgccctcacctcctacgcctacacgtagtacatacatacatacacgactaaaatacacgtacgtagtacgtaccacgagactaggacgtctctcacctaatgggccggcgcgcctaccgtcatcaaggcctgaaaagcataagttcatgtatatatatgggctctctcatcgaggcccgattcagccgaggccgaggcgacacatcgtaacgggccggaaaccttattgggcttcgtccttgggcttagaaaatccagtttccttcttccaattccggccagccttaacacacaaaacagctagcgcccgttgtattgcagccgtggactggacacgctggaggaagcatcaaaaccagtattttacgcagaagtaaacgcccagaacgcccaacttgcccaggactttcgtcatgctgcagatgtcaccacctataatacactgcccggatgaacattccaaacccccaaccatatctcatcgtaaaatttgcagctcgtataggacagtaaacgaagaaaccatcgtcgtacgtcgtccatgtctgacgcccctcccatggccgagaaaccaactgtaagtatgccaatgtctgcactttttccctctcttagactgtgtttagttccacgctaaaattagaagtttgactaaaatcgaaagcttaaagtaaaaggtcggaagtttatgtgtgtaggaaagtttcgatgtgatgaaaaaattggaattttgaagaaaaaattggaactaaaccaggccttattcgattcttgcatctctcgctgatctgatgagtatttgcagatcaaggtggagacgacgccgggagactggaggttcccgtcggccaaccagaccaagcgatgcttcacgtgctacatcgagtacaacaagcaagttcgccatcgatccttacctatacagtaccccctatatatatatatagctagatagattgatagataggagtacagtacatatatatagcgatgtttcatctgcacgcctagtagcttatagcacgcatgttcatgaagctgaagtaaccacgatgactcatatccatatggtacgtaaatcctatctataattctgtatgcaggtgcatagaagccaagggtgaagggtccgacgagtgcaccaagtatgccaagtgctacagatccctctgccccggggaatgggtacgtacttatagctaatggaaatattttacatcttcggcttctgttataaaacacacggtaataatttgttaaacaagaaactgagacataagatagtttacatgtataagttattctatatcacgtactctgaaccagtagcagtacacaatacagtaccagagagatcgagatcgatcaatgtactccttcctacttcctccgttttaagttataagactttctagcattatattgcccatatttatatagatgttaatcaatctagacacacatatatgtttagatttattaacatgtatataaatgtgggcaatattagaaactcttataatataaaacggaagaagtatctctcaaatggcgacaaagaaaaatatgtatcgcatatctatgtgtggtccgtgaagatgtagatgtagatatatatagtcaagacaaggcatgcggctagtgtactgctagtggttcatcctggacagaatatatgcatgcatgcacaagccaagcaatatgcaaagaagcaggcatgatacatgcactctagtaggtctctagccatacaagtagccaagtagcatgctgacgaaaacgacgcgagtagcacggccatttatttacacgccggaattgaactagctatagctaataaactcgccgtgtacagagagtgtacagtacaatactcgatcgcagcttggtcctggctaccactgtgcagtgccatttttgttcgattagtagcactgttcctcactggcttgatcgttcgaaactgtgcttgattgcatgcaatattccctagctaagctagctgtttgcgaagacaactctgaataattctcacatgcgtgtttcttgtttggcgttgggattttgtgtgtgggtgtgtgtgcagatcgagaggtggaaggagcagagggcaaacgggactttcgctgggcctctctgaaacggggacagcgaccgatcgatcgaccatatctctacatatatcgatcggctacagctaataataccaatcaatcctgtatgcaatgtcgtctcgatcgtcagggtgaagcctcgtcgtgacactcctagctagtattatgtacactcatgacagtgtcagttattaattggttgttgtgtctaattgcagtattagtagcgaactagcgatgcccctgcactgctgtacagtgccgtgacaagctactctgaattttttagatagtacgctagctgcacccgtcataaatttggttgtctttggtttcggttggctctgcttccatgttgctctactactagtctactactaataatgggtaattagctactcacaggtcgatcagtacgttgatgccacatatatagttgtaatagtcatatggtttgggtgaactagctaggtagttctatatgatacacgaggaacaattgaccaaactaactaatcagacaaattaaattgctacatggagtgcaagtcgaccaacgacctaaatcatgattgccagctagtagctaattaagacatacagagtatgcatgcatatactgatcgattgacttgccaaagactcaaaagtactatgaagctggtcaatcaagagtaaaaccacacacacatgaagcatgcataagtagagtacacgcgtcgacaattctcacgtccttaattttcaattttaatttctgggagcttaatttttcatctagacgagttcctccgttgcataggtcgttgtatatatcgccatcatctgcctgtgcctcgcatgcttctctttcgctatatcttccgacacgcatctccccatccctatcagctagatttatttatttttcgttttgagttgagatgaactagaaaatagtaatatttttaatttatcggctaaacaattaatattactcctagtcaaaatgcatggtgtgtggtagaaataagccctagctatatatagctatatataaatatataaactgaagactactgatcactactctgactactgtacgttccactgatcgctgccgctagtgttccggataaggtttaggcaattgtaatgtgaacagcacagtgatcagttcattgaataaacccagcgaatcatatcgatcagatggcaataagagtcaagcatgtcatcagccttcaagcttcaactactgtactggactgtgggtaggctctgactgtcaatggacgtcagaaagaatattgtaattagggcatgtttagatcctctaataaaaattttcaccctatcacatcgaatatttagacacatgtatacattattaaatataaaaaaaataactaattatagattacatgtaaattgcgagaaatcttttaagcctaattgctacatgatttgacaatatggtgttacagtaaacatttgataataatggatcaattaggcttaataaattcgtctcgcagtttacatgcggaatctgtaatttattttgttattagtgtacgtttaatactttaaatgtatccgtatatccgatgtgacacgctaaaactttatacccatggatttaaacacccctttagtgaagtgagagagcatcgactctctgtcaggtgtcagatagctaaatggagaaaactgaaaagcgattatgcttgtcttcagttatagttggctgacctggctcagctcaagcacttgagtagtgtcacgcagagaaacacttagagattttttggctagctccacaagacattaggctagatgacttgggttcgaagcctcacctcttctaattatttgatattagatcattccctaatattcgtgtttttttcaccaaaccaagcagtaaatggagaaaaatataattaattgcaccttaattaatggattaatgtttggagtattgggagtactgtcattcttccttttagcttagataattgccgtactctcaacagaacaaatgcattacatacagtcatacagtgaagagacacttgtaccaaaagaactgcttcattaattgcacatacgttacgacatcctttatacatagctgttacgtacgtagacatgtatacaaggtttgcatgcaatttgtagaaaagaaaaagatcgaatcacctgacaaatatgttacatgacactatacttacatatgcacattaccctcaactcgggcatcactcatgcatgatctgaaactctcagtgctaattaataaagaagaagtgatatatatatagtagatagagaaaagaagaggaggggaagttaacaacaactacatatgattcttacatcaattgattattgatcatgtcttcctcactgcatcttcttcttcagtactactactgttacatgaaacagcagttactagctagctagttacctgcaaattaacaccaacacatgcatatccatggctcagttagttcatgcatgggtgtgtgcaatgcaagcacggtgaggaaagtttatgagatcgagtagcttaattaattaactaattacctgagtttttgagtttttgttcttggagagtcctcacaagaagctgcattacatcgacctgagctttcagagacacggcatagtctagggtttcccccagcaacgcgcacatgtcgagagctttccctcccggcacgatctctttcagcacgctcgccctcttcctcaccatggccctcgggacgccaccgccgccgccgccgccgccgccgtacgcctttgtggtggccgccgtggtgttgttcgccggcctgatcggccgccgccgccggcggatcaggctcctcctcacgatcttcctgcagatcatcttcctcggcgacggcgacggcggcgaacggtgctgctgcggcgcctgcgcgagctccgccgccagcgaccggctccagcacggcgcggcgcccctggcggcggcgagcgcggcgtcggcggcgcgcttgatggcgctcttcctctcgtggaaacccatctccccggacgccacgccgcccttcctgagccctaggatgaggttccggagcagcgcccgcttgaacctccccgagccgccgccgccggcgccgccgttgccgccgccgccagcttgcactctagctgaaggcatggtggtgaccaagcaagctcaaacagctgctagctatggtaggtgtacgtgttgcagcaaagttgaaatggagcaagaattaatcctacaacgagagaaatggaaatggatgggagggagtgtatcagaatcgaaggagcaacatggacatataagtaggcattggcatgcatacgcatcaattatgcgtgcacgtactatctactcgttgatcatgatgatgatcttttcgtacatgtatgtagctaggttcattggataagatctctggaatgtgagttggagagaaagggaaagagagagaaatagagagatagagctatctaactatcatcacgagaggagaggggagcccatgtctccattatattggcttagctatagggaaagagaggaagaagaagaagaaggttagctaggactaggaggactaggagaggagtattggctaggaggagagatcgatcgagaggagacaatgcacatgcatgcacatgggtggctcgcgctcgctgcggcccacgcccacgcacacatgccgcactgagctagtgagtttaataccactcgatcgcgcgcgtgtagagagagagagagagagagagagacaatgcaagcagcgcagtggcagttgcacagtgcaacgcccctgaaggccctgttcggttgcacagtgcacagttgcacagtgttacgcggcgggaaatgaaaagtatattaaaaaatttatgatagatataataagagatcgaaatcgaaatttattctgggccgagaaccaatttactcatgatagggacaataaaagcaggtacaatagcaggttataagccagctgcaaacatattttaaggagataaatgagaagagagaagagcagcgggctacagatttgtagccagctgtagcacggactcaaagacgcattgtgtgtataacaggtgggaccatgtattaatagtgtagtatgtaactattgtatgaatgaactattagattgactatagataaattggagctagtagtcgactgtactattaaacttgctctaagagaccagaattagttccacacctcttgactagtggattgattcctgatcttttattattcctatcataaataaattggttttcggcccgaaataaatcccggtctcccattgtatctatcataaattttttactacatttatcattcctggcccggattgaatccaagcaacaaggccgaaatgttgagagtagtgtgggggtggggggaaggggtcccttggctggatatgagacgcggccgtacgaacagtgttgcaagttgtaacgtagtcgatgggtagcatgcatgaatcttacaagtagctatagcacgctctcgtgcctgcctgccttggcctggggctgatttgtgcacacacttgcctgacaacttgcctgatctgtcgtctgaaaatactatctgaatcgaccgtagaacaacctagctgcagacatgtatatatatccgatgccctccatactccattcatccttaaaaaaaaatcggtttctaactacgaatctagacatcggctatgtctaccttatagcaactggttaatcctatatatgttacgctcatgtctactcgttaattattccatttaatccctgatgctcagtaatactatactcttaaaattgatagccaagtgtgttttgttctgttttggatagcgtagtaactgtagaattactggttaatctatatgatttatcttagcttttaatttaggtgatttttttaaggagttgggaactagtcccgtcacttgatatattgtttttgttttcttttctatccctcaacgcgaaaagcctaaaacttatttactgtgtatctattgtaactatttttattatacaaattattttcacgaacacgtagaaagattgtatattaataccattgtaaaaattacgtccaggttcataattaagtgtttctttttgcgcgggagagggggtgtgttattgtgcaggtagcaaaaggacgacgaaggcttgaccagaattaactggcggaaggacctaacgactactgctccagattaattaagcttcagtcgtctatggatatggccatgataagctacacgagttagtacacgtgtaggcagtacgacacatggcccggccggccccctgattagcgggatgctttgtttgcttatcagttatcaccctcctcgtattacgacgacgacgacgactagtgcgtttggtggcgagcatgtgatgtgagtagtgttcatatatgcatcattgttaatttcgctttggttcttccctactctcttgagacgagctagctagattaattgttgatcagcagctaattaactgtgtgtgcctattagtaacacgtatgcaagctagtagcattgttctcataattgatcaatgatctctactggctactgctcatgctgaactgattaaactattgcatatatatattcagatagcagcacacgtacatgctgcactgcaacacgatcgaccgatcgagcatggattgaaagcttagaaaccaataaacctatgatcgatgatggatcgatcgatcggttggtgcacgcatgtggtttgtgtccttttgtcatgtgaattaattgagcgaatcgatcgaagcttttgctgctacaaggcaagctttactggggatggattctaatagctcgagtggacgtccacccgtttattgcatgtcaactaaatggctacgaaaaatttttaaaaaaattggcaagatagatcaatatgtaatatatcgctctataaacatgcaagttaaaattcaacttctacaagttgcaacaaaaataacaaatttaactgtaaatatacatatagtaatttgagttttgtttgttatttttgttacaatctgtagaagttgaattttaacttgcatgtttgtggattgatgcattacatattgatctatcttattcatattttttcaatttttttcataaacatttagatgacatgcaataaacgggtggccatccactcgggctgttaaaatagtttcccagctttacctcgttttcgctagaaagggataggcagcttagtatagtgcaggccggggccgggctctggcatgatccggaaaacatgcacgcaccagcgaacacgagcaccaccccatctccagcctctgaatttctcaaacgccacagcaccaactgctagctaggagtacatgtgcagtgtcgtctgttcgccaatttacctaagcgatcgatcgactgctaaattcaccttcacatatacagttgtgagtattcacatcacaggtaattaagcagaagcatatatagaattaagtaggaccatggtggtgtttgaaacttatgtagataaagataaaaattaagtgttttatgcaaaacgaggtggtgttaatatgcgattaatcgagttttaattattacaaacttgaaaaatatatttatctgatattttagagcaacttccatataaaaaattttcatatgaaaattttatattgactgaagtgccgtttagcagtttaaataacgtgtcacgaatatctaaatttcctttcaatttttgttggaaaaaagaacaaggcctgtgtcggccacgagatagataacgcctggtcgcctgctgccagtgccagcacagggggccggatcggaggaaagctcacagttttgatcatctgatcaatgccatggaacgggttaaaattcagagagaaattaaggaaactcaacggtatgccaaaaaacccttctcaggatcaatcaaatcatgatatcatataatcgctcaccgatcaagagatagggggtcccaagcacacaggcacatgcatgcaagaggtcgtagtagtggctgtagtacgtcttgtagccacgatctcctttcacctcaacaagacggagaaagaagtagtaacagcacttgtcacatcgaccggcgcgctgctggcatttacaatagtttcccgtggatgcagtagtcttttgtcaattgctcaatgtgcacgcacagtcggtagtattactctctccgttacgtaaaaaataaatctaaaatcgattgtgatatattctaagctcccatcaaatggcctaataatcagccaaagaaaaaaaatataaattttaaattttcaaacttaattttaagattgattttaacatattttaaacgtagtttctttttccgcattggcttttaagtcaacatgaacacatataaaagtttttacctacaaaaatcatttttaagttaccatgaacccatatataaaagccaaacgatgtgaccgctagtattataaacctagacagatgtatatctatattcgtagtggtaagatgtgtcatattcggtattaagggagtacacggtacgtgcagtgcatcaccgtgactgggttgctttttctgcataagttgtgtgcatgtttgcaacaaccaactgcttacttccaatctcgcatgttacttctgcaattctctgtatatccctgaatggtggcatgttccaaagtcacacatatactccagctagctagcactggcccaccatgcacgttgctaataacagtacaacagcagaagcagcacagttaatttccatcatcatgaattgaaccctacatatgtctgcccatgatcactttcccatgaaccttcactgcctatatatagtaatagaatccataaataaactacataaaaagttagctggattgggccgcgcttgcgcgagccggcagaaattgggctcctggcacgcggccgctacagaaatttcgccatattgggccgccttagtccacgagccgtattgggtcgttttaggtggctagcccacgggtcacgagccggccagcttcttctccctccccatggcgatcttgcagagttcattgccagctagtagtagctgttggaaatcaaagcacccacaagggacacggctaaactttacgttgtcattttatcaggtgattagctaaaataactcaaactgagtagcaacaaagcaagccaactgaaacttttgcaaactgcagaaaagagtagaccagtgcagttggcatggacagatctgtcgcatatacccttccattatcgttgtcctcctgtcgatgcaatgtccatctttttccagtccgaaagatctgcttcagagtatcttgatgcagagaactcggcaataaacaaacctgtactacgtgaagagcatcacatggacggttattggaaaccaccaaaagcagcagagacacacacacacagaacatgcagggttgtactgtaccagccacaacacatgataccttcatgcctgccactaacagaatctgaatcattggtttccagcaaaagtgcagagaagaaaataattcaactcatccgcatttcatttcttcatttccggacaatacacagcaatacaaaggttatttacagacaagagaaaggagtagttacatgctgctactgatatcaacaaggaattgggaccagcaagttcatctcacatcggcaaaaaccagaccaatgcaaccaatgaatatacatggtaaacctcaaaatgggcacaaaactgaggaaatatcaggtatcagctaccagtggcagcaattggatcaaaggttagaggccatgctctcctgctactttctccttgggaagccgaccgacgaaagctaggtccgaaccttgagcatcttattaggcagggatttgtatccatagcacccatacaaaacgacgggttaagcttcatcgccggcaacctctggcagctcaaggaacggaaggaggatgaacccataggtggcatgcgtgcacactggaattcagtccggtacagatggctggcgattgagggagtagaatcggagttcacagctgggcatgtggtgcaaaatgacaatgaaa

SEQ ID NO: 70820 - DNA, 3642 bp, Oryza sativa
aatctatcttgttcttgcttgtgttctttgattcgcatgcagggattagccttctcggcgaggtcaaccgggtttcggcacggttgataaccagaggagacatggtgctgcaattgcggggctcagtagcgtgttcgttcagaagccggatcgagttgtgtcgcgactccgcccaaatcgactgtttatcaatacctatcggaagatcgggacctacatccctcaccaggggatcaggtgtattactatcggaggaaggaggaacacttgagttaggggggttgctttggtcagccatggaacccaacaagaaaaggaagactgcgaagagattatttggacatagaaaatggacagggaacgagtgggagaggaacacaaggcagaaaggggtcacggatctggaaaaaggagattacatggaagagaagagtgaaaaacgaaggtggaagaagcgtgctgtggaagattgagagcttgctacagtagaacactgactagaggcatcaagccgaccgcctcgtgtccgaaatccgatcctgatcgggaaataattacttacttccttcgtttcatattataagactttctagtattgcccacattcatatatttgttaatgaatttagatatatatgtgtatttagattcattagcatctatatgaatatgggcaatgctagaaagtcttataacctgaaacggaggtagtaggtaaataagatcagtagcatgaataggatatccttgccaataatccgttgtacaccgtaagtatctaatgctttgtttatagggttttagtattactattgataatatgattattaaaaactaacttacatattgttcttaattaagtgtgaaattaaggtaagttaggttcggtgttgtgtatgctagaaatgattcatcaaaaaatgaaattagtgtggttctcgatgaaagtcgtgaatattgatgacttttggttgcgtgtttgctactcctttcatttcaaattacttacaataaatgccacagcactataatattttaaaactatcacaaaactatatatttaaattggtagtatatcacaaaactaaaaatttaacatcaaatttagcatagaactatgtatttaaggtgaagtatcataaaactaatctgcaacaaagttgttacaaacttcaggtttagtgtaaatttaatcacaaaccttggatgtttataactcaaacataacattatcattagtactagggatttaaaccgtaatttgcagtagcttcattattaaatgtttagttctgctatactacacctaaaatctattttataaatttgatattaaatcagtagtcttataatacaccatcttaaatctatagtcttgtgatagtttgattaaatatctatagttttgtgtaatttactcagaagagaaaattaatgcataaccattatacagaataaggaaaaaaaaattaatgcatgacccttataaacaccgttggacattaaacaatgtgacacgtctccagaaaaaaaaatagaaatttgctgaagacaccataaccattattttattattttcagatcaaatggagagagaaaaatgccaaaaggacgcaaatgcctcttgggccaaaggcacatacttcctccgtctaaaaattcgttgttataggatgagtcacattatatcctagattgatcctttttgggatggagggactatatatatctgggtctagtacattagacctgaaccacactctatcccgacataggcgtgtggcgtcgatgcagcctttgaagtccggtagcatcgatggcggcagggatgaattcattggagaagaagaaccggcatacaaagaaccatccatcttcactaaacctccctccattgtcgctcgtcaccgcttcatcctgagttagctacttgctagtaggatttttgagagagagggtgagtgagttgggagagtgcagatcgatggccacagggtgctacttgaatccatcgtcttccatcgccactctcgctactagtcgtggccactgttgtggacgtcatctacctccaatttgtagggttctggagggggtcccgatggaggaaatgtagcttgggtctagttcaaacaagacctagctgtgttacaagaagctcgcccgagagacaacttgtattttctaattgatgttagtgtattcaatagtttgttaagtgtcttataagcaccccacaagtaatatcttgttttgggactgttaaatgggggaaattatgcacctgattgccttttggtatttctatttgaggttgaagaggacagacatgagtaaagaaggataagaataaatatggtgagaagtggtgtggtgtggagtcatgggtgcatgacactccagggtttaaatattgaccctatgaatattacacatatatatgtgttgacggtccttatagaccaatttctgcagtcaatatatctaaaataaataaaagagaactagctatgcttgcatgcatgcatattttgtttaagaataatctatttctacttgtacttggaatattatttgatttcagagattgctgcataaatgaaagagaatcgacggaaattaactgaacaatcaatcgtcatccgtcgagtggcagacttttagaatgattggcttacaaaaccattttaacacctacgaataagcccaactacccttcttttgtaatactttagcattaataaaatattcttctttatatagcttcgttcttttacataattcatattatttgagtaccgactttagttcgtacttgtctcaatataattgtgtagctagcttaccagagatatgcaaatgattgctctatatcgatcgcgagggtgtagagtagtatttaataatgtaagtgtggtgcttaaattattagatattattctttggggttatatgccatgggtcaatagaggtgggccgctgatgatgacaactcagtacgggtatttcttcacgttcgtatataattctaagacattttcctgatatgggtactcctctgtattcatttctggtcagatggccatgacggattgtcgtaaggaactcggcaatcaggtgtggtctctcgaaacatcaggagggcatagttagagggtattggctatatgattgtatactagcaagtgtaaactatagatatttatatactagaagtataggaatgattattttcatattcattctccacttagcctagattttattttagcggagtagtccttaaatctttcttctatgtgtcaaccttatcctacctaaaaattaattaacccatgcatagactttgatgaatacaagtaatatatgaattgttagcatagtattattttattatattttccattaggatttaattaaaaccataccttagattactaccatgggataattggacggttaccagattaaatttgtggcccataaatataccaagaatatttcagtgccattgctggaaattatatttctagtaataccgttaagaaatatctacaatatgtaagctttaaataggattatagtgagatcaggaatatgtcgctagtgtcttgtctctttgaacgtgtgttagtggatgca

SEQ ID NO: 70821 - DNA, 5723 bp, Oryza sativa
tgtcatcatgggttcgcacggtaagtgtgcgaactcatgatgtgttcacggtgtttgcagggagaaaagcgaactcgcacaataatgaagtagcgagaacgatccgtagcactgtgaactcgtggagcggggatgctccctagtccccgttgagcagactcacatgtgtgtccacgatttcgcatccctaatttgcgaactcgagcgtctgccatgagttcgtatctttgctctgcaatgatggtatattttaatcaattctttcaaatgtgtgtattcctataaaaccggtgaaaaaaacatatcttcaatttgttttcataacttccatacacatttcatgttgctaaaattattaaaagaatatgtaaaattagacaaacactagtttaggggttatatgaatggtactgtaaattttagagggcacaactctttatcctcctgattttgttactataaagctatcgagtggttatgaaaggacgtgacctatatatgtacatgctctgcgattaatccaatctatcacgttgagtcattccttctcacaaccttaattaaaaacaggaacctacatagcaaatgacctttaaagctaggacaatgttttggcaaaaggtatgccactgtttttcaaccaaaggtgattgtgcccaacttctgaaaagtgaaaacattagcagagcagccgtaaacattgaaagtaagtaagtgccattagagtacatttgtgctgccctacaattgtacatgtgtgacaatctgttcctctttttgactcctgccccattcccaccaaacaacagaatgttcttccaaagcttgatccacacgcgagagcatgctggtttgtcaaggattaaacgcatcgactttcaatttgctggcgtattaattagcgaattactatttggcaaaaccccagcttgagatttagaaatgccactgttagtgttagctgttagggtagtacgtataggctggcaaatttaaatcatacgtcctctaggcaagaagcttaaattgcctctaaaactaggaaccctgttgctgcgttcaagacaaggttttaaaataccagtctcctaggccagactggttaccgaaatgtatagcacttttttaaaatgcaactgcaaaaatctaaatatgaatttgaagtgatttatctgacgatcacctggtatttttggtgatccatagttgaagcaactgcaagttctgaggctaaacacatgcccagcacgtgatgtgcaggagaatccaatgtcctgttcatctctcttgttaatgaggcagcagatcttgtcccaaccaaaacacagtggggggtggtgcactggtggccttcagtcctacatccccttcttcatttctcttgttaatggcctggcagatcttgtcttcccctacctgaaaaaactcacatttattatgcaaccaatagtagcattggccatggtgtctgttcaatctcatcgttttgcccacatctgattataaaccgtaacatttattaacgataacaatataatttatgaggtaaacttttatatacgagcatgattaggtaataggtttttgtcattttaaaccatatttttttctgggtaaaattgataaacatatagatgcatttagtttgttaccaaacattggtaatgcctaagtaatttttgcaacatcatatttagcatattttatcaaaacttggtgatgctatcaatttaccaaaattttgatattgcttaatattggaaatgttctttttgacattaatatgaatatatcttatatcttcttaggcaacaacaatatatatagcaaaagtagtccatatagatgggacccacatatatggactataattattgctttcttcacaatgtatatagatagcaactagtattaggaggagacaggaaataaagataaataacatatttattctatatgggtagcccatatgcttatgggtggcttttgctattttcttgctatggactagttccacaatgtggttaggtggctgaatgaaatattttattgcttatggactagttttagactacattgtggatgcccttagtgacttaaaagccaacgctaaataataaattataataaaaaaattcaaagtcaactactcaactctaaagttaagatttacttcatccgttttacaatgtaagttattctagcattttccacatttatattgatgttaataaatctagatgaatctagacatataacatcattgtgagaaatagtagaatgacttatattatgaaacggagagagtaaaatttaggatttggttgtgcttgataagctgaaagagcaaacgatgaagatgtgctgacagtaataaaaatgggttcacaaattttgggatggagtaaaggttacaaaaatggcttccaaatttgatcttgagcttatctgtgcagtcagtgagctgtactgaactactgatgaacagttgctgaagaacatggaatttattagtaagatggaagagaggttgctttgcttcagctcgagtgtactgcattttcctatgctggattcctttgagtacgtgtaaatttaacacgccgccatcaataggaatctggtacaaagaatgatggagcaggggcatttgaatactgtatattttattatcaacccaattcatcaagcaatttgcagcaaatttgatgcaagtctgaagaacaaaacctgaatttcatctgaaccgaacccctgcgaactcctacattcgagattccagttagaaaatttgcattctgctgtcacaaattttactaggacaagcacgaattgctcctaaaagttaattttttttatatatatcgcacgaattgttcctaaaagttagtaagaaaaagagagcaaaaagcctttccaaccatggtgtttggtgggctcagaaaggaaaaaaaccagaatacctaacattcagttaaatttcggtcaagtacagtgcaaggcagatgcacgtaacaatgtaacatcacggcaatgagctggttaatctaatcccttaactaacaaattcccaatctcacagggccccagatctctgttgccaattcaaaaaaaaaaaacagcttaaaaattcgtaatagagagtagcctctctcaccttcttcaatggcaaagcttaaatagagtgaatgggaagctagagccatggccatcatcatcatcaacgatgcatccatggctatagcctaagaggaagaggaagaggagatgatgaacccatcacacccagcccagcactaactaaccctcccttcaatccaactccacctcaatccaattccattctctcgctcgcaccaaacagctgcaccgattttgttcttttcccacttaaaaaatttggatctttttcgggtgctaaaaaccctttctttcttttttttttcttttctgtccacttcgttcgtggtggagtggatttggaccacgcgcaccaccgcaaccaatcccccttcccacgacaaatcccaatcggaagcaagaatacaagggagaaatcgatagaaatcgaccctgaattggagccatttgccaccaagaactcccccaccaggagaggaatccatcatttcttggcccactccaccaatccgaagaaagaaatcgcgagaaatccccaccagattatagcgcatcattagcggaggattagagccaagagaagagaaaaaaaggtggaagaaaagcaatggcggaggtggcgctcttccggggcccgaccaacctcgcttcacccgcaagccgctcctcctcctcctcctcctcctcctcactgcgttatttagccacctccgatggcgacgtgctcccaagaagaagcagcagcggtagcggcagcagcctgggatctacaggaagcttgggaatccaagaacggcgcgaggaagagggaggagaatcggaggaggaggaggaggagtggtcgttcttggcgctgctgctcgcgctgctgcggaagtcgctgctcgggtgcagcgcggaggacggcggcggcggcgaagggatggagatagggtggccgacggacgtgcagcacgtggcgcacgtcaccttcgataggttccatggattcctcgggctccccgtggagttcgagcccgaggtgccccgccgcgctcccagtgcgaggtctgttcatcactaggagctgaattcttcagagtttcaggccattcagtttgtagttcaggtttaattttctgtgttcaaaaagtggtaaaccttttttgtttgaattcttcagagtttcaggtcattcagtttgtagttcaggtttaattttctgtgttcaaaagtggtaaacctttttttgtgtgaattcttcagagtttcaggtcattcagtttgtagttcaggtttaattttctgtgttcaaaaaagtggtaaacctttttttgggtgtcattgtttgcatttctgctggagttttgatatgcattgttgcagaaatgttaagagtcctctaatttaaatagtgttggcttcaaacaagttgttcttaaagaagaaatttgagcctgtttcctaaatttaggttgcattggtgtttgcaaagtatggtttttgtttcggttgtggtaaaaagaaaagttatttgtttattaaaaactctgtgcgactgtgccgctttcatctgaattggtagaaagacattttttatgttttctaggtggagttttaaattctgtttgaattaagtttgtgtattatactccgtttggttttggtctttgtgttggtagactttataacctttgctgcatttgaaccgtggtagacaaaatgtgcatgtcttgatgattggggttaggcttcggaccaccactctagaaatgtagaagaagtgtgtgtgccacatttttctccatcactcattaataatggtccaatcatgtcttcagatgtactgttttttgatggcatcgcatgatttttctgtagctgcttactaccttgtaaaacttgggtggaaaaaataccttcaattataaatggtactgtaatcaaactgttgttttttctactaacaaataaggctggttggaccgttgtagtggtagtttgttgtaaatcaattagatcatgtgttagagaaaaaatttactgttatatttaccttattaaaggtatttacttagtaatagtagcatgtggtttgcctgctccttcatcctggcgtttacagcggtagtatttctttcctgttcctttaacccatcaataattgtggtcctgtttgactcataagcaagcacaccaatttaacccatcaatattcatgggctagagcttaaaaggtatgcatatgattatctttcatcaaccgaatctagtaagaaggaaaacgacacctttaattaaacaccataccagaagaaattgtcctaggagttctgttgattgacattggaatatatatataaaaaaggatcatggcatcacctgttattagaaagctatgagaaagtgtcatgtttgactaatgatacacgccatattaattggatgatccattcacatttgtactttcattttcatttgtctacatgtgtttgttttgcgttttgaacttgagttgcttgaaatattgattttttttctttgctgtcctttctgacttactcctatacatctatactaggaaaacagcagatacaataagg

SEQ ID NO: 70822 - DNA, 5242 bp, Oryza sativa
acaatgtttttatgtaccatataaattgttaaatatgtttcttaaaaatatgccttgaccttattgacaaatgctcttcagctcttgttttcatacattacgttgattctacgacaagttttgcaaacttaacctatttgcactgataatatggaattttgagcaatatcgattatgcttaatttttgtttgatttagcatccgagattgtggctgattaaaactttacttgcagtgcaagtgtctttggagtttcaacagaatcgatgcagtgctcctatgattccagaggaaacagtgtcccaacaattctcttgatgatgcaaagacgtctttatgaacaaggcggtcttcgggtatggcttgttagattttaattgattttaaaactatttaaattggttactgtttttgttttaatcagtgtctttgtttgtactttgcaggcagaaggtatttttcgcataaatgcagagaatagccaagaagagcttgtgagagaccaattaaatggtgggatcgtgccagagggtattgatgtccactgtttggcaggtctaatcaaagtaagcttctttctattattttgaattatgtgattccattgacatcaccagtatcctgatcacatgtacaatacttagatagctgttgattattgtctgtactgaactagtggaatttcacaaaaagaaaaacacctggcagagaatccagacttcctatggaacctgatcatgtcctttccatttagaaagatttttttcacaatttattatttgtcaacacatacaaaattgaggctgtgctgtcagcaatattctgttgcagaatctaatatttgcttttggaagcagttataggtgcggtcacacaaatttgataacaaaggtgtattcccaccccatatatattttcgcatgttttccaggcctggtttagggaactcccgagtggggtgctggactcaatcccacctgaacaggtgatgcaatgccagtctgaagaggactgtgctcgtgttgccaaatgccttccaccaactgaagcagccttactagactgggctgttaatttgatggctgatgttgtccaagaagagcaaataaacaagatgaatgcgcgcaatattgccatggtttttgcaccaaatatgactcaggtagtgtgttatcctattgcgatcatggtactgatatttcattaggtggattctaactgttgtcacacatgtaatgcagatggcagatcccttgactgcattgatgtatgcagtacaagtgatgaattttcttaagatgctaatacaaaaaaccctcaaggatagagaagagtctgatctggatgatttgtctcttcctcagaaggacccgtctgatgaaaatggacaccagaccaccggcctctcgcttgattctcaccctgacgaaggatccaggcgtccctctttcgtcagcgaggagccccttctgaacagtcccgtgcacagcactgaagagaaacctaataagaccaatcttgctgaaggaaaatttgcggattccagttgcccggaaaatgtagccctaacgagcatggagacagagggctctactagttgctcccaacctgctctggcagcagctgccgctgctccccgtgctacagctatgaacttacttcaaggcaaagggagccgtagcctgaatagtaggaggactagaaagggcaaggtgcagtttggaacacgtgctgctccagcatctgagaaatcaaaaggtgcgagcattgtgagcaggataaactcaaaggttgaacggatcgaagcgtggcgatgaaatcagaagttgccgcaaattgttgttgtgaagtagatgactgacccaatgtttcctgtttcctgaaaataggaccaagagctgtgtgctttgtgcattttgcattttttgatgtgcttatcatttcttgttggaccatgatcacggtgtttttagatcattttctgttgctgctaacttatgtatcttgtttatgagtactactgttgtctgagtgaatcaaacagactgttgctttccccttgtacataaatgtctccaatgcctaaaatcttagctatctgagaattgttcatggataattatgttggtacttgtgtttattctcatttcattgtgtacctctttttatctctcattcttctggaatctggttggatcaaccaactgttccagcattttcatcttgtttgcaagtactctgttctcatatgtttgaaaatttaagttctaagttttgaacattggatcctcgattccaattcacattgcgttaattcatccacttcatgtttctgaaagtatcgtaatttccctatactgaactatctgaaatgtaactctcaccatcttatccatgtccatccattgcatcatgtagctttgtcctactccctccttcacgctttgtcctaatcgtcaaaaagaacaatagtataagcaagaaacacatctattgcaatttcatccagacatccaggtacgcttcagaaagaaaattcagacagataagaggcagccgagaaatgcaaatttcagcttgctttctgcctgttcagctgtaaatgggatgaattgcactccattgttgtgacagtcacatcctttattccctgtcagttttgaaagcagctacacattccatcttcaagatcacttcacagcggtgtgattctcagtgacaagaacactactggttggggaaaatcatcgcgccattatcagatcagttcttgcaccacgtgaaattggaattgttttttgacagaacgaatggaattctgttctagtgatcttatcagagtttacatcacgggggaatatccggtgaaaaccatcgaataaaaccggacctttttcacgggtttgatggttttcactggatatttccactgcatcatggtctacaatcatatctcagtcgcacacagaagtggtaactgaagcattttttttataatacaaatattagcctctacatccaaaatacatgtgaccaagtaaactgtgtgtaaaaagggaggaaaatacctccaaggaactgacattaagaggaagaatatgtgccctatctcgagacagagagaactcagaaaattgatctagcttcttacttcatagagacataaaagcatatggatcatgcatgcaagtcacagcaagatcatggcaaacatgaggacaggtcaactcctgttccagaatcagaatagtgaagcaactgacgtgtcaagtacagataacagatttcatggggctcagagatgcctcctctagctgcattattgcacaccttttacctgctagtagcttctgaattctgatcaagcaagccaaaaagtacttatattatataagatcctgaattctgaacaccaacacttgtgcttgcagcttgctgttgcagtggcagtcatacagaagtacagaatcgagtagtagtagtagcatttgcaggcaaaatgacaggtctcctcaagtagttgctctccacttgtgagaaaatattccaattccacagccacatacatatgcctgaatctttctcagcctcttctttttctctcacaatatatatgatatatatatctctctcttcctctgaattcatcagagaattactcaaatttcttcctgccccaaaatttgtcagtcacaacacatattttatatacaaatacaaaacatttttttctgcaaattgtccatctctgacgcctcatctgaattgactgacgcctttttgaggtaaacgcagtgacacatctacttaagcactttggctgaagcttctgcggcatatcttttttgccggtgcaaagctttggttcttggccggtggcggcggcgcgcatggcggcggacggcggcgcgctgaggcggctgttcgagaagccgctgccggtgccggagaacccgacgctgctggaggcgctgtcggcgtgcaaccatgtgcaccaccgcaagaagctcgtcgacacggcctccttcaccgagatcttcggcgagctccacttccaggagaagccggtggacgtcgccgccgccgcccggttcctgccgccgccgccgccgcctgttcgcgcggcgtcgtggatcgacgtcgccgacgacaagagcaaggacggctcgtccctggacgcgctgctccggccgaagtcgtccgccgtcaagaggagcgccagcttctgcctcaagagctccgagtcgtcgctgctgctctgcaccgaggggctcgggacggaaagcacggtggacgccgacgacatggtcaaggacggcgacggcgacggcgaggccatcccccgtggcgaggaggagacggacggcgtggaggaggacgacggcgcggggagggagaagcggggcacgccgacgctggcaccgacgccgccgacgttcccgccgccgatacggtcgatcgggcgcggcgggaagccgtgcgtgtgcttccggtcgttccgggcggaggggaggttcgtgctgatggaggtggtgatcccgggaaggagctcctgcaggcgacgcgcgagggcggtcgcctcacgctgcgcttcgccaacgccgcggccgtgggcggcggcggcgaagcagacgacgatgtcaacgacgacgacgtcgatggcggcgagaccaagaatgcatgcgcagcaagagatgatatgctagctaataactgcacttgttaattaagaatttaagatggctgcaagttgcaacgaagaacttgatgcttttgaatatttgatcgacgtgtgtcaaatcgccatgcgtgaatccaagcaaacagaaaaacaagtttgtttcgaatcaaggagaagaagttcataagtggatcatttcagaccttcatggttgattcgggggagcaccggttgagtggtatggcatggactcataatttcttttagagcaatgctacacgtactaaatttttcttactaaacttttactaacaatcatctcaaccgtttgatttaagtagatggaagttacaaaaaatctagatgcactcgtagcataacacatcagtgttagtaagaatttagtaagaaaaagttagtacgtatagccttttcctttcttttaaggtgaatatgactgccaggttttgccaagcagtataaattttataaataaaaggagttatctacaaaggagccacaaagaaaattgttcttactccctccatttcgaaatgtttg

SEQ ID NO: 70823 - DNA, 20997 bp, Oryza sativa
tcacccccccccccccccccttccttctgtccattcgaagcaagaggattgattatacggctcaccgctcacgcccgcacgcacgtacagcggacggagtacaggagaaaggagataaatgccgtgggtttatcgctttttgtttaagcaaagctcgatcattaaacttctcaagagctcaattagtactatattagcttatcttgaagctaacattatagatatataatagattagctataaaatttggctataatttttttcttctctctatctctcacttatatatttaatgtatttatcttgaagcttgtgttaagctagttcttacataagaaccaatactcttatttttttttgttgcctctcttcttcgtataagtttatagtagacttataacttactattatatttgctctgaaaagtgtgggttggatggtgggtgggccccgtgaggtgggttgggatgttttccgcacaattgttaatgtcgtgtttctagttcgaaagaagctcagaagctgtttcctcgtagtcatagggtgatgtggcaattgttccttttctttttctgtttcgcgcatcgagcagggtgagcattttagttgtgacgggaggtaatcaactcatgactacacaaacgttaaccagaaatgagatgggcgctcttccaacacccaccagcccattctcgggtgtcacgttcacttatggaaaaagtacaccgaaggtccctcaatttgtcatcgagttacaaaatcgtcccctaaacgcaaaaccagatatatgacatccctcaactcacaaaactgttcactttatgttcctcggtggttttatctccggttatatccaacgtgacggctgagtcaacgtgagacccacatgggccccacatgggccccatatgtaagggagaccatgtcaccgccctctctctttttttcccctcttctcccctcgtctatcctttttcctctgggcgtggatggcggctgacagggaaggagcgcggcggagaggagggccgtgcggcgccattgtcgtggctgcgcgttgttgtcggggtgaggcggcgacgcatggtggcgcgggcggcgtggcggagggcaaggccggttcggccggcggttggcgagggaagagcgcggtggataggagggccgagggccgatgacttggacacggtgagctccgccggctgcggtggagacggctacgaccatggcctctcgctcgctttcgccggtaggtggagccggctactagcgtggcgatggcggtgggcacattgaagaggatgagcggctcgatctaactgatggggatgccggtctcaatgttgagctgccccagggcgcccttgccggtgaagaagaacaggagcaccagcatccacacctaggtggtgcagcgcctgcggatctagggtgtcgacgacctcggccggatccccatccctcctttgccgccgccacttacgccgacaccctcctccacatcgccgctggtcgtcgctgctccgcgtgccggtcggggtgggtgggggagacgggatgggcgatctagcttctccccgccggctttcatcgtctatcctcctcaccggccagtgcccatcgtcggctttctcctcaccgtccgaacgggctcaccggcccctcccttgaccgagcccaatgagcggtggcggcggcaaagctcggtggccacatcggacacgcggaacatcttcttcacaaggaccggcattgcgagggcgtggccccgcgcgctcgcgcggccttcctccgaggtgagcattgcgtcgaacaccgccagggccttctcggacacgctcttgtcagcgtctacgagggcctcgattagtgttgggatgagccccgtggacgctaccctcgtcgcgacgcgcttgtcggagctcaccaggtgggtggtggcgaccatggcggccttggtgacctgcgggtagatcagagccttgatgatcacaaccagtacaacgttcagccttctgggcaagctcccgtgcttggcaattgcgacgagatcgagaacccatcgagctagacgaggccaagaccctggccgcttccttgtccaatggcatcatgcaaaccaatgccgcggcggcgagagactcgaacgccgcggccagcatgcgccccgtgccgacagacacgaagcatcgccggttccgctcgctgtccctcgcaagcgcccggaccctggcgaccgccccggtggcgcgctccgccgcgccgactcgtcgacgtcgaacaacagctcggaggcctggactgggatgcgctccacgccacctctccccatctgccgccggctgcatcgagaagagaggagaaaagaagaaataaaagaaaagagaaaaagaagagaagaaataagacaggatgatgtcagaaccatcgagggatctaaagtgaatggttttgtaagttaaaggatgtcatatatctggtattgcggttgagggacgattttgtaacctgatgacaagttgagggaccttcggtgtactttttccaagaaacagctcaatagtcaccaaaagtcttgagcctttgttactgggccaactttgtgttgtgctaatcactgggcctcaaattgtaggtctatccggagacagcttcctcactcgtcgtgtttggatgaattttttttattaaaatatttacaaaactaattttgtgtttcaaagggcaactagttttgtaaatttacaaaaataatttttaaattttacaaaatttacaaaactaatttttaaaaatcactctcaaatcaccctcccaaagagtggcgggcgactagttatgtaaatttttgaaacacaaattagttttgtaaatattttaataaaaaattagaaataaaaaaaattgtgtttggaccgggattataccattaattgcaggtgtaagccttttaacgatatacttgctccgtttctaaattaaatcaacttagtacattcaaattcgtaggactttacgtataaggttgctttattttaggattgatggtgtagtggtccctaacaatttgcctgtgtcatgaaccgtcaaaaactagacaaaactcaatgctcaaaaattgaatttaaacttttgatttcaaaataccgaaattccggttgaaaataatcgaggctgagaggctcgttcccctcacatgaggcagcgttatatttccagcgtaagagcaactccaacggaatcggtatccggctggccaagccaaattttggccatcgatgggaaaaaacagggtccaacggactggctatcacgctagctatcgcagtcggctggccaaatgactgggatcgctggccaaatttggtcagtcgggagcgctcgccatcctctccctcgcattgtctctctcttcacgtgctctctcctctgcgcgcggacacggcgcaggcggagtggttgaagccgaggcgccagtggttcggtagcggcgccggcaccgggcggccgagcagggcaacgccgacgccgcctcgcgtgcacggatttgccgccgccggtttctccaactagcaggagagcgtggggcacctgggagagcaactggaggacggaggcgagatgggaacggagcgagacggcatcatcgcggaggcggagcgcgtcgcggcaggcgagcgggatgcggtggagcgcgtcggcgctgtcctgctcgagcgcggccgcggcgtcgtcggcggccgagcggaggcgctcctcggcgtcggcgaggaagcggtcgagcagctccgacgggtggcgcgcgtccaccacttcgggtcgaacccctcctccccgaactccgacgcgtccaccaccaccattttcagcccccactcgctatgcctcctccgccgccgccaccgccgcggctcgtcgtggacttggacgagggagacaaggtggagtggctctgagtttgctggattgctactactcctttgctaggtgggaaaaagagaaagaagagggagaggaggaagaaaagcaacgactgacatgtggggaaccagtgtcatagacttaaaacagagtgggtagatggagaggctgttggagcgagtaactagtttaagtggccaaatcagatggagagttggctatatgggtatttggagagtccaatttagagagactattggagatgctctaacataggcttgtttggccaaaatgatgccttttggccaattacagcctttttccttttttcttaaacatttttccaatctttccaagtgtccaattccaaaggtatggaaatacgatatttcaaaaataaaaaactattcccaataaatatcattgtatttataggaatatttagattcttttagttacatatttgataacgaaaggacgtcaaccaaaatattatgattgggatagaatgttacattttacaattttacatgaatggaaaagcacggccacagccatccactatggtgcaaagtgctatgttcttccttcgtctagaaaaataatttctagggataaatatggagaagcaactgtttagattcatctccattagttagttttttttctaagataaagggtgtactacactacactctacagtctacacagaatagagcaaaaaacacagctgcatagctggtctgctcaaagcagagcagccaccgagctcttcatccgggtacagcaccatgcaatgcaccttcaagccctccgatgcattatgttcaccattcctcagtgatactccaaaccaccttattgggcgaacacaacacccgtcaaaaaactaggtgttctattctttccaaatcatccatatgattaggatgaccaccgcatcaaacacatatcatcgacctttggtaagaggacttgcatgctgccgcccaccagattactaggtcaaagtacccatctagttgcagcatgatctaccatcgtgtactgaagggatatgaggtgccaacaagtatcaaactttagaacagagtagacatcccgacagacttggccatcctctccgatccaaattgtctaaagttaaacacctccccctaacttctaaaaacatgaagagtttgcaacgccccgaagatttcatcttccaaaggaatttcttgagtttcccacgtatctattcctctataccctcccctgcaatgatccaatttgatcttgcaagacagcgattcaatcgccaccgtcctaatcctatcgtggttatggatagttggatttcgaaattatcttttgcatttgtagcttgccgcagtaactatatgaagctccgtgttcggattgagcgtaggccgcctaaacgacgcttgtcaacaggattgcagtcagtactcctcagagttgacacgggaattcacagtcaacctttgttaagtccgatgaaacttacgcaaaatctatgactcaacaacaaatctcgaagagcgtcattccctgtggaggtaggcaaagagggcggcggtctgtcaagtgatgtgcacgttaatagcagaggcttgtggatgagtcattgcggtaatgtcgtagcatcctatcgatctattccattactgttgtatggttgcggttattttcccaatttagcagcccctacctttagaaagtacggtcttggcctatgatgttctatctcagatgatgtaccaaggattttatttcacatgaactttgtctttaatgtttaacaaatttgctttgttttcttttaaaaaaagttatgcatcagttcagatacaatgcaacctcatctatatatcctatatagttggcatcaaaaactaaatatgcattgggccacatcacccacaaacaagagccattggatcattgcaccaaaaactaaacatacattgagccatatcttgaatcagaattaatgcgtaggttcaaatgaaaatatatgtattctctaacataattaatgcgtaggtgagttagtaaaggagagcacgtgtgaatgaaatatcttggattcaaatcctagctatgaaaaattatcaaaaataaatagttaggatgatagattaatatttaaagttttaatttggtatgtagaactaatgtaacacatggagtaatgacaataattatttatgactatgtgaagtgttgcaatatgatttttttgccacatccattttgtggcaatatcaaaatttattaccactaaataaaaactattgcaataacctattaccacgctatttattaccatggctagcaacaattttaaaatggtggcaacatgtatctattgccataattttagtattcatgccacgatttttttcgtggcgacaacttatttttctattagtgaaatttatagttgcattgcacatatgaatagttcgccgcgacttgtggggagtatcatctagtatcatatataccccaggccccatttcaacttgttgaagatgaaaattaagtagcgcatgcaaaacgagaaaactattagcacatgattaattgagttttaattattttaaacttgaaaaatataattatctaatattttaaagaaactttagagtgaatttcagaaaccccaggttttggggcacctataacacaaaaccccaggcattacgatttgttttgaagaaccctaagttttggggcaaaatgtttcaagaaaccccatgtttaagcttatatcatcgtttttgctaatatatttatggataataattgaaaaaaataatacgagatatttctgagtatatataaatgctagcctcattttaatgagcaaaggtcattggtagtataattgtttatatgtataaataataggttagtgtgtcattattaatgatgttctattgcgtttttatcaattgtgcaactaaagagtaaggaaaaagatatattacataggatcgggtgtgtatttggagcttactaatgtaaaaatatactaaaaatcatatataatatttaaattatgagtatttgagtaaatatggggtttcttgaaacatttaccctaaaacatggggtttctctaaacaaatattataacgtgggttttatgaaattcactcaaacttttatgtataaagttttagtgcaaaatacgtcgtttaaaaaacgtgctagcattaactgagataaaatctataacttcggcagtgtttagttcccttcaaacttttaaaaattctgtcacatcaaatatttggacacatgtatggagcattaaatatggaaaaaaacaattgcacagtttatatgtaaattgcgagacgaatcttttgagcctaattacgctataatttgacaatatgacgatacaataaatatttactaatgatagattaattaggcttaataaattcgtcgcagtttacaggtggaatttataatttgtttgttattagtgtgtctgtatacgtaaaacaaaattagcacacgaaccaaacacggccttcatcagaaaagaacatgtcccactcctgcagatgaactgacgaagtcaatggcactacgaggtagagttgcagacacgtctatagtagccggactctagcgtaggaaaaacacgcgttgacaggtgcaaaaacgcccatggccgtcgtcctgtgtgaacgtactatagaggaattgtctcataccggatgttttttgccctttccgcgtagccccgttcccgattcccattcccagctatagtactggtggctagcttttgagttgacagccaccgtttttaaccaacgcgcgagttctgaactttctgaaggcgatacctcacccacctacctatccgcggcctttgtcattgtttctttattctcgagtcgtccggagagtttgtattcgcgggaggccggtgcctggaatgcagccaatttttaagtccagttcccattccagctccgtctttctttcttctcctcctggatttctgccggctcgagatcttttcaacgctcttgagctagcggcggctttgtttaattcgtggtgagcaacgtcgtcgtcgacgacgaattcgatccggaggaagggttcgttgtccggcccagttcggccggccggatggcattgttgggcgtcctcgtcggggcggtgatcatcgtcgtcgccaccgcggccgccgtttcgggcagcgggctgccggtgcctggatacgacgggctcgccatcgggttctaccacgagacgtgcccacaggcggaggacctggtgctcgccgagatgagggagatcgtccaggaggacaggaccctcgcgccggcgctcctgcggttcatgctccacgactgcttcgtcagggtgcgtgcctcgcgtgctcgatcccttcctcagtttctcatcatgtcgcgtggcgtcgcggggacgaaccctcgtgcgtcgatgtcgcgtcgccgtggtgcgtgctgctgatcaatggacgatgggtttttgatgatatgtttgtgcttgcttggcttcgcgtggcgtgcaggggtgtgacgcgtccatcatgctgaaatcgcgggaaaaaatcggggagagggacgccaactcgagctacagcctccgcggctacgaacagatcgaaaggatcaaggccaagctggaagatgagtgcccgatgaccgtgtcgtgtgcggacatcatcgtcatggccgcgcgggacgccgtgttcctggtaatgacgccaactccctggctactttaattcgagatcagtagtataatccgatcgccgtgatctttattatcgttcatcccgacgtacgttgacgagcggcttcgttttaccagagcaacggcccacggtaccaggtggagaccggacgccgggacggcaaggtgtcctgtaccattgacgccgacaacgatctcccaccgcccggctccaacattgtcgacctcaagatctactttagtgtcaagaacctgggatggaaggacctcgtcgtcctatcaggtacgcaataccgcaaataccagcgtccagtagtacttttggtcagtgcgagcaaaagcacacacaatatccattcaccagcttcaatttctgctcgattttgcgcgtgattttgtgcgtgattttccgcagggagccacacgatagggagggcgcagtgcggctcgttcgcgcgcgacaggctgtacaactacagcggggaagggaggcaggacccgtcgctgaacacggcgtacgcgccggagctgaggaaggcgtgcgtggccggcgaccctttcgacaagacgtacgtggacatggacccggggagcccgtacacgttcgacctgagctactaccgggacgtgtacagaaacaggggcctcttcgtctccgaccaggccctcctcaatgacaagtggaccaagcagtacgtggagaggatggcgtccgcggattcgacggacgagtacttcagggactacgcggaggccatgaccaacatggggaggatcgaggtgctcaccggcgacaacggcgagatcaggaaggtgtgcggcgcgtacgttgactaggcaagggggagtagacggagccagcgcgcggttcgttgggtgcgagttggcgcaatcgcttcgatcgatcaatcgtcatgtggccgtggcaaacgtgggggctagccaaccacagtggagttgcgttattattctatatatcggtcgaggtggttggggcgttgacgctcaccgcccgctgaaattttctcacaactggaaagaaaaactgtaggtatatcaacacatagaatagtccttctctcttttttttcttcgttcaccctgttcttcacggtatggcatggtgcaaatatatatatacggcatcttttaaaagttctacgacaaatcatgtatgtgtatatgcgtgaacatggatgtatatagtacaacgtgaacatgtatgtgtcctgccttgtcatgatggcagctggcagtttagcacatgaccgcgctctgcgtgcaagaggaggacgaggattattcgccgtgacgaacgaacgggcacaggcgaattgtcccggtagacaaaaggggatccgtgatgaaacggcgggccagatgcattcaccggccggcccgaagtgcaccgtccttgggcattttttttaaaaaaaatggggcaaaaattttgtatatctctactattataaaaactagctgggtggcccacgcaattacacggctagcacccaaacaaaatcatatatcttttactatggttttactaaaaatttattaaatagctatctcattgtcttaagactttaaaagaccaaaccttatcattctcgtgtttctaactatatagttttaaaaattcacaccagttgctactccttacgtcatcttcttttttatttgcttactcgatctatcactatttctattcattcttcttggaacctttaaaaattggattttatagtttttagagtttattgtcacgatgggtttcgtttttataatttctagatgtcccgtcaaatgttgccattatactcctctacggcccgtccactgtttcttctctttattgtcattgagattttaaaaatcgaacataattatcgtttaggttcaattttttactttctagaagtccggctaaaccatcagcggctttgccattatactcctctacggctcgtccgctaccacccttctttattgtcattgaaattttaaaatcgaacataattatcattggtttttttttactttttggaagttccaaacctttaaaaattggacttgcagttttattttttataatttttagaagtctcatcaaacgatgccactatacccctctacaacccgtccgtcgcataatctttattgtcattgtgattctaaaaatctaacataactatcgttggaattcattttttattttctagaagtcccgtcaaccgtcggcggctctgtttctcctttttattgtcattgagattttaaaaatcgaatatgattatcaatggggtttattttttttttttactttctagaagtcccagcaactgccttacttgtttgcttcacagcctgcctgacgtccctccttttaatcgtcattaggattctatttggtgttttattaataatttttatatgtcgtatcaaccaccaccactctactcctttataaacctgttacttaatttatctcgtcatgtgttttagatggtattttctttcaatagtctttatttttatcacaaattttagttatttataaattttattccaaattgaagtattatttttctttttctaatttcagaatttattttttgagtaaatttcacataaatacaggtattttgaccaaattatcacaaaactacagatttaaggagttatatcacaaaactatatatttagcactaaatttatcacaaaaactatagattttagattaagtatcataaaaatgcatatttagtattgattatcacaaaactacaacttttggagtttaaatccctagcaacattgttatggtggagctataaacatcaatactttgtgattaaattgattctaaacctgtagttttgtgataatttagttactaaatatgtagttttctaacacttcatcttaaatgtgtagttttgtgataaatttggtgttaaatacgtagttttataatacaccgagttaaatctgtagttttgtgataatttggtcatagtatctgtagttttgtgaaatttactcttttaaaaaaatagttaataccatattgtgttcttttaatatttgtattttttattttcattttcagttatttcaaaattgtattcctacttgaactcacttttaatttctctaattttggatattattttatttttcattcgaaattttaattaatctcgtattaggttcttctttaaatattgcttatttttaattaaattgtattcctacttaactcttcttttattttcttttgctaatttcggatttatttttattttatttcaaattttaattaatctcgtattgggttcttatatggactcttcttttaatattctttatttttaattccaaatttcggctatttttaaattgtattcctacttggactctcctttccttttctaattttggattttactttatttttatttcaaattttgattaatctcgttttggattcttatatggaaacttctttcaatattgcttatttttaattccgaatttcagctatttttaaattgtattcctacttggactctccttttcttttctaattttggattttttttatttttatttcgaattttgattaatttcgtattgggttcttatatgaaaacttctttcaatattgttatttttaattccgaatttcagctatttttaaattgtattcctaattggactcttctttccttttctaattttggattttattttatttttatttcgaattttgattaatctcgtattgggttcttatatggaaacttctttcaatattacttatttttaattccgaatttcagctatttttagattgtattcctacttggactctccttttcttttttttttctttttctccgattaatgtgagaatttctagcctccacagcgaacgtggtgcctccttttcgagctgtcttaataatataatagatagatagattaaagatgtttttgtctgtgctttggtacgtcattcatgtatgagtaggtttttaagttcgtttgattttgaaaatgtatatccgtatttgagtcagtttttatgtttgttcgctttgggaaatacaaaaggagtcgtataaaaatctctttaaaaaacttgtatgctaactcaagacaatcgaactcctggctgcaactcataattttctaaacaaatataaatatccacgcgaatttccacagtgaatttcaccttaactaaactgtataacaataataagattaaaatagacttcacctgttgcaacgcacggacacttttctagtatattgataaagtacaaaggacactaatagttttgtacatgacttttgcaacgcccacaaaagaaagcatatcacaagacttctcccaaaatggtaaacactcatagactaaaagtccctgcctgtagtggcggaggacgaggaaaaaaaaggtgtggtagcaacaacacgacaaaaacaacataatactatgctttgatgcaacaaaaaatgtattgatctgttttaggattcaaattcccaaacgaaattttcaagatttttttttgaatttagctaaatatatccaaatttgatcaaaatttgttcaaaattcaaattattttttgaagatagaaattgccaaaccgatagattaaacctttatcttttggttgcgtcgtataactaactaacaactagcgcttatatagatagctaattacaagagtaaaaacaagataataagtataggttggttgcattgctttgtgtaactaactagcaacaaagtgaaaacaagaccatcaatgaagaagttaatcacgcattcatgcactttaccactggctaacggaattgaggtatggctaatgccatatctcgccataccggaagcttcaccactgcctgcctggacccaagtgatcaccttttcttttatttttgcagtcattgttgttaggccataccgctgttttgatagattcttgcattgcgctcacaccatagctccgaggagatgaggattaccaaagattttagagcctttgtcggttttgcaggctcggaaggttcatctatcccaattttgcagattgaggtgcaaccctatccatctctagaggtctgaccagattcgtcgtgagaacctgcagtggacaaggaggtggactgtcgtttcatgcgtcgtgtggcatagtgggcagatttgttggtttgcccagtctcttctctagagtctatcaacaatccatgctctgttctgcaatactatccatgcaaagaatttgtattttggcgacacccaacggtttccgctcttgggtatggccaagtaggccattaacagccggtttcttcagaggtttaagttcactttgactcccttaagaggggccggatttgattcgtatccctaaaccacaataccggatatctcgaccctcaaatattaaaaccggtacaatttgactccctgcgtagttttgaagggcagtttcgcttacgtggtggtattgacatggtcttccttccacgtggcgttgacatggcgcttatgtggcattataatttaaaaaatatgtgtaggacccatttgtcattcacacaaaaagaaatgtgggacatctctcttcccttcttcctcatccctctctctctctcccttctctctctttctctttctctcccttactcttctccttcggccagcaactagcggcggtggtgggcgagagggcaggcgaggcgcagcggtgatggtgcgggcatgggcacgggagcttgatcacaccaatgatgacacatgcattgggcgcggcagatggcacagcagcagagacgcctctccttcctcaagcatggcgtgagcacgtgccttcacacgccgtcctcaccgccgctgctccccgttgttgtcccgctgccgccgctccggagcgcgggggacaatgagggagtgcgaggtggtgaccagtggtggacggtggcagcgactggacggagctcagcggggagctctagggcggcggcgccgatggtgatgaggatggctctcactcgccccttctccccagtctccttttcttcttcgtggggacagcgagggagtgcggggcagcaacctatggtggacgacggtagcaacaggatggagctcgcccagggagctctagggcagcggcgccggtgatgacggggacggctctctctccctccttctccccagtcttcttttcttcttcggcgtcctttgccatcgccgctgtgggctcaccttcgagcctccttgcccaccgctgcaatggcgacgcgccactatccgccgaaaaagagaaagaaagagagaagggagagagagggggaggaagaagaaagagataaaggatgacacgtgtgcctcatattttttttgtgaataacaaatgattcacatatatatgtttttaactttaatgccacctaagcgccacatcaacgccacagaccaggtcaacactatcatgtggacgccacgtcagcgaaaccgtcctctaaaaccactgagggagttaaattgcaccagttttaatagttttttttggggggggtcgagatatccggtattacggttccaggatacgaatcggatttggtcactaattaagggagtcaaagtgaacttatttcttcttgggacgtggacgccttgtcttccagggcttgcaatgcgctacggccctagtgtattccattcctatatgtaagtagctttttgtgtaggggcccatatctcctaccggtcatgaacttcggcccattatgcttggaaatgattcatccgcaaaaacggggtgtttttctaacggaagcacaatagcgaccggcttgatttggcgctgtcatatgattctttgctatctacacacgatagcgtgtggcaccgagcttaatgcattgttatacgtcatagtccagttgtatgggtatcatggagagtttgggaaatcaggcggtactcaatcggctaatccatcgtacaagtttgctactgtgtatttgccgttctcgcacagtacgcatacctattttattctgctctcaaagtgtcttggaaaccaagaaatacgctagagttgtttacgcctggctatcctcgcactcccagcgatcttattacaattgatcacctttatacaatgaagtcaatcaacatcctctctgcttggtcatgttggttaatctagactagatgccctagtcctcaagttttagaagaagtcaacaatagtaattttggctaaaaactaactaataatatacttaattagtagtatcaaacaaacgataacattacatttgtatttgaaaataattttatatgcggttaaatttatagttattcgattttatcaaagtataacaatggatatcataccaaaaacattgcacacatttttttagtgacccgtacaagaaaaatgtgcaaagcttcatattgatataacaggggaaagtaggaagctataatcaagaaaaaaactaaaaccatgcttcacacctacaccaagctagattgcccattgcaaaaatattgcacaccttatatcgaaagaaagtactatcctcgtcccaatataaatgtaattatgggttttcgtatccaacgtttgaccgtccgtcttagttaagaaatttatgtaaaaattagaaaaaaaatagtcaccataagtattattcatgttttattatctaataacaataaaaatactaatcataattttttcaaataagataagacggacaatcaaatgttgaacatgaaaacccacaaatacacttatattgggatggaggtactactacctaacatacaaatggatagagatcactagccatgtgtcctattggaaaatttataggatacctatatgtattgttgcatgcattagtacaattggtactttatcatgattcttttggaatacagtttttggcaatattttcaaaagacctagtttaattccgacaaatattcttcaaaatcatctattgcgaaagagagaaaagcttttgtttcctattcatagtataacctactccatccgttccaaaataaaccaatctcgtgttattacatcatagtacgatgaatctaaagataaagtatgtccaaattcgttgtactaacataacgttagtttattttaggataaatgaactataataaaatctgaaaaaaattaggaatcaaagcagtagtttctacaactgctaactactacaagggaaaataaaaacaacagcatatctcagtgcccaattatgaaatttgtgtcaatgctagaatttagcaaccgttttacagaagttttgcgagatcaatttgatccccacagtaataacagagataaatctccaaacctccaaggaaacatttgaaacggagaacttatctccccatcagatccaggaaaaatctcgcagttcaaaacggtgccttctgttgctgacccgatctggcgacgcaactacagccagatacgcgcacgagcctgcgggaaggagagccacaagagccacaaggagagtccgtccgagggggagagagagaagcaaacgtagacggcgaggcaacgatccgaacccgaggtgaaagagattatcccctcaaacaagccaacggccccaccaccacacccctttaacattctccgcttccttcccttgcctcgccgcttcgttctcctctcgccgaatcaattcaccaaatcgaagagaaaaaaccgcaaaccagcaaccgattgcttcgttctcctctcgccgaatcaattcaccaaatcgaagagaaaaaaccgcaaaccagcaaccgattgcttggactaagcgcatcattattttcttttttttttctctcagagagagaagtagtagtaataaacgtaaccttttcctcctattttatttcacctaatcccaatctcctccccccttccttcctcggccagagaaaaaaaaaagagaaaaaagaggagaggcctcgcaactgcaaaccctcgctttctccgatcgaattgctcgcccgagcaccaccagttcgccgcccttcccaccaccagtcgcctccctcccccgcgcagggtatctcctccggccgccccagtggcgattccccccgagctcccccgcgcggcgccgtggccatgtcgctcacctgaggatacggtcggtgggctgtttcttgcaagagtctctcccccgagccccccaagagaaacagcccgggggacgccgagttgttgattcgatcgccggagttgcgccgaggtgaacctgttttttgtttttggtggtggttccgtctcggttaatctgctttaacttggaggcaaaggctcggtcttcgtctgaggaacgcgggggagcggtggtagcgtcgcgtgcacgggtcctcctcgaggtcggcttgatgcggagcggcgcgcaggctcctcgaggcggcggaggcggcggggccttctcgaagcggacgctgtccggctacatgaggatcatgtcgtcgggggcgtccacggccgcgtccagcctgctgtcggtgggcgcgtcgctggtgaactcgatcgccagccacgacgaggatgggagccgtgaccaggttatttcgcttgattttaaacaattcactgtgctcgttggtttttttgggctgtgttttactagcatagcaactgctagcttggcaataattgtagtacaacggaaaagcctttagatgtctcaccgtctcacgtgtgcattagtggtaactggtgcaaaatgagcaaagattaattatggctggagggcgcaatcagtttctgctcctgccaccaaggtgctcaccatatgtggcagtattagtatttattgttagtgttgatgcatttattttgagcaccatataacaatctgcctatgtttgaaatagatagtgcttttggtagttactagcaattgtccagcggaaagaaaaagtggtgagatgattagtgtgttaacattaacaatgctagctgcagatgttaatccattgagttatcatgaatatgaaaagcttcttttgagcttcggctataattctcctggccaaataattcctatttggacagcacattatgatacgacgctgcatattatatgccattcctagttcatccaaatggacaaatgttgtggcaggagtagggtcagtcaaatcgtccggatgtacataaaccggttggatctaagtaaaagatcccctttttagtagaagtaataattccttgcaaaggatccatgtctacaaaaactagcaaatacatgcagaagggtaacttttccttttgtttgcatcctcgggaaatattttcatataaaaatgtatttacacctgtcttacatgtaaaatgtggttgcaggtacaatgggctggatttgataaacttgaatgtgggggtgacatgctgcgacaggttttacttctagcttacagatctggtttccaagtatgggatgttgaacatgctaatgatgtaagacagctagaatccagacatgatggtacagtttctttcatgcaactcctaaagaaaccaattgcctctacaaacagtgaagacaaatttgcagatgaacggccactgttagctcttgcttgtgacggaactagcacaggaagtctaatcagcaatgatggcaatggccctgttcccaatggagccaatggtactctccataatattggccatgagaatcatcctactgtacttcggttttattcattaagggtccatgattacgtgcatacaataaagttcagatcaactgtttattccatacggtgcagttctagagttgtagctgtatctcaggctaatcaggtatgccatactccacgcttttaacttggtgtttggatcatgaataatcctttatggaaaacaaaaatgcttcttgcagatacattgttttgatgctgcaacactggagagagaatacacaatccttaccagtcatatagttccaccaatttcaagttatggaccacttgcactgggtcctagatggattgcatattctgggaatccagtcccagttccggatacaggccgtgttacccctcagcttcttaatctatctcccctagttccacaacctggttcaaatggcagtgttgtggcatactatgcaaaagaatcaagcaagcaactggcttctggcattataacacttggtgatgttggatataagaagttgtccaagtattgttcagacttaattccaagtagtaacaatgttataaaccaaaggaattctggcttcaaagcaaatggggcaacaataaacgggcatacagacagcgaatatgctggaatggtacagatttcatctcagtatatgttggttaccagctttggatactctattgtgatgtttctatatgctaaccatattaacaaccaaccaattgaaggccattgagaaacccatctgactagttgagtaatcatctgatggtgcagttggtgttgttcctgtctgattgcaccattcagccctaactcgctgtctcgctgtgcataaaaatgaaattgtttgtcattttattttgcaaacaacgaactttgagttagtcttgatgattccaccaaaaagattctgttttgttaaaggcataatgagaattactgttaacaacttatccctcaatgcaacatgaatttaagttttccccttctgcttaaacctagcaaaagcaggtgttgtcgtaggataaatgaaaagttaattcatcctgtggtcgtacttttgtcttggtggaattcagatatagagtaaactgacgatggtggatgtcaaaacttatcctgattaagttggttagtgatagcgcttatttgtgaccaaaggagttgttttatatattaaaaagttgccaggagtattatttcaagatagttttgtgcatatgccactgatatgccatatctcactgacaattggtacttataggatggagtgaactttcagtgaggattttatccgtactcatatttgtcttgccagcttcatggaaccgtgacatttacaatgttccctttccaatgacaggttattgttcgagatattgtctctaaatcaatggtggttcagttcagggcacatactagccccatttcagcactctgttttgatcccagtggaactttgttggtgacagcttcaattcacggtcgaaatatcaatgttttccgcattctgccttcttcgcatgggagttcatcagaagctggtcca

SEQ ID NO: 70824 - DNA, 628 bp, Oryza sativa
agctttctgatttacaaggactttgaagactaaccttcagataggagcagaagtaagcaaaactgggaacaaattttggaagtaatctgacacgtgtgggaaacactgatatgagctgggaaacaatgcaagctccagaactaggaagatttctcagaacccagattgcatagaactcacatggtaatttgcctgagatgtcaaatgatttaatgtcctgcccagtgacaacaaaaaggggttagctagattttgttgctgaaatactacttatttatgtgatttagtggcaaattatgtttcccgtgaagcccttcatttcgaaaagagtgccttcgattgataaaagggttgattttacagttctaaagttaatgagtagctaaaagttggaacagaatctacactttcagtgccagaacatcttggattgaatttaaaagctatctaatagaatagaagtgaatctgacgcccagaaaaagagaggtccaaactacctagaaatgaagtcttttcagatctagcaactcatctaaagtctgacattgcacacattgttggtgggtctgaaagacttttggttattctgctgcaatcagtatgttgcaacagttgactagtaggag

SEQ ID NO: 70825 - DNA, 4125 bp, Oryza sativa
tgttctgaatgttgcaagtgttcgacaggtgaaagtattattgattcttcggtaggcagcacaaaacaactgttactttgtgcctgcatccaaagcttttcagaattcagattgacttgtagctaaggcaaagatttgggcaatggatttagctttcattaaattaagctataggataacttaatcatgcagcatcaagtgtagtttgcgtcaccatctcatgaaaaaacagttatgagttaaccatgttcgtggtacgaagtttcagtggtatgtgtgtcttttccccttcaataaaaaaggttggtgatagtgttgatgttctatgcccatccatcgatatctccaggtgggttgtttataaaagttttgaaggtctctggagatattttgggagtaacttctccagcattgtctttcataaagaaaagtttcaggttgcatttttttaagtacttacctttccacctatcatgaaaatgtctattggaaagatagaattctttgtatagtggtggaaaatcacaccagcctcctcaaatcctagtaaagatttggtgcaatggcttttcgatattttggtgtttggtaccttttaaatttaaacctatgttgcaaaaattaggcaaaaggatgtgacgtaattattatggggaacccgtgtggcccaacgatgttttatatagtacttttctagagaacatatcctatacatataagcttctcgtgcacactccgtgcataccaactagcaaatatcacagaaaattttagaaaaaattggacacatgttccaatagtattacatccacgtgtgaaatattatcatcaaattcattatatttcagccataacaaaaaagacaaaattctgacaaattttcacccttaaaactgtcagatttttcactttttgttacagctaaaatataatgaatttgaatatgagactttgcagatatatgtaatactattaagagtatatgtctatttttttagtttttttgtaacatttgttaattggtgtgcacggagtgtgtacggaaagcttatgtgcatagtagaatttcccgtgacatttttctagtagtacttctacgtacttttgcatgtaagggttgttcggttactaacattgtcataaatcataactcactttagttaagtgtggcttgtcataattttttccctacaaattgtagaactatttttagaaacaacaccatttaaatgagaaattgcaaaagtagagatctgttggctaaaattgtaagtttagcacattgtcgaactttggttgtttgaaaggggttgcagggtaaaaacaacttgaaaactcatggtgcatgtgcatggcctattattgttggccactacatgcatgtgcttttaccttacatgaatgtgtaattagtccagcaacctttattgaacaatggttgttcgataggttatccgacgtgtcatgctcgtagcttcgtattgtggttgtttgatatacaccctactatcaaacaactaaatgattggtgaacaaacgattgagtatatgacaagaggggcaatgtgctaagaaagtgtggcaagtcataattgtagcaatgaaccaaacaaaaggttaaaagatgcagcagcctaaagtttggtatggtaagttgaactgttattagatggtacctaataggttattaggtgttcttataatgctttcaatgccgacatacttatggataatatcttttctagataatatcaataaatttcaaaatccatttcgtcacctaatggctaccatcgtctttttaatctataccgctgtaactgtttggttagatacgggagtaacattacccactgaaaaatccaacttagttcactaagatcaggcaagccatagaagtgaggctcattttctagaatatgaacttaatatggcctcgtcaggtagtgatgaaaataaagattaagtacatgcacgtaaaaatgagaaagccattagcacatggttaattaagttttaattatttcaaacttagaaaatagatttatctaatgctttaaagcagcttttatagagaaagtttagcaatttaaaaaatgtgttaacgaaaaataaggtaaaatatgtatcttactcagaaacgaacgggccttaacgataaatggattcacaatggagcttcaaaaacaaatcatcgtttcctaacccatttgtctataaacactttattttgggcctttccaactaaggcctgtgtggataatttcgcctctctataaatttcggcccacataacgtagttgggcctcaaccccaaatccccccaaaattctgatttcctaatcggatccgctcctcccactcccgcagcctctggtttccgcgcttagtcttcctcctcccccacctccactccgcgcgacgatccgcaggtcatctcccctccacccgcgaggattcccggagatcctgcccgctccccccgcccccctcaacccccctggagcggaggcgcgtggtggctggcgcttcccccctgcggtggttgtgctgctgtgttcgcgcgcggggcgcacgggaggtgttcgacggaatgcccagccgagagaaagagagagagagggagggaggtatgtgggtaagcgtaagcctcttcgtttccctgttttatggtttactacttgtgtttgcatgctagcgtgcggtgtctgcgcgctatttcagatggatggaactggaacatgatcttgcactgctttgaataaaacagtgatgtgatgttgagcattcggaattgagacatagaactaatttttctccgggtttctactactgttgaaatgctatttcgcttcaaagggctagtaaaaatggcaaccccattctgtagtccatcagtgttaaacccagaagctcaccaggcattagaattccctgctccttaatctgttttatatctttgttatcttgcctagtgaaaatctgtaacattttagagttcctttttcatgagaacttgcatccttttcctgatcaaatttcatgcaacaggattgaaaaaaaaaatcgaagtatggcgaatatcacatcgttgttgctgacattctcttcctaccagaggttttatcaaactctcaaattttgaaggtgaactaacaagagaaattatcatttcaggccacaacggatcctgtgctcttaacagcaggcaagcatccaaactttcctattagctgctgctttttgtgtcatcagtgcatcaaaccaagtcaattggtaaaaagttagcttgaagtataattatgaacgtatgagcagttgatttgcatggatgggcatttggtttcactaccatcctctatgccaaaggaccaaggctcttactttagcatgctctggaatttattttgctactcgtgctttctgtgacaagccgaaccacaggattgtccacaaggataaaaatcttgttagggtcgagagggatttgattgacgtgtttacactccatgaacttctgcagttatgtgcaaagaggaggtccctcttagttgggaaaagctgccatggattagccattcattttgggctggtaactgatactgtcacatgcaatattctcatcaacttgtacacaaaatgtggccagaatgattgtgctcgtcgcgtttttgatgcaatgtctgtcagaagcataatctcttggaataccatgattgctggatatactcataatagagaggatgtagaagcactgaagcttttttcaagaatgcaccgagaagggacccagatgaccgaatttaccttatccagcactctctgcgcatgtgctgcgaaatatgctattattgaatgcaaacagttacacactattgccatcaagcttgcacttgattctagcagttttgttgggactgcatttcttgatgtttatgcaaagtgtaatatgataaaggatgcctgtgggttttcgagaatatgcctgagaaaacttcagttacatggagttcattatttgcaggatttgtgcagaatggtctccatgaagaggtattgtgtttatttcagagtacacaaagggaaggaatgcaattgactgaattcactgtttcatctatcctc

SEQ ID NO: 70826 - DNA, 1130 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcc

SEQ ID NO: 70827 - DNA, 4783 bp, Oryza sativa
ctcatagcctagcaggaacacgattggatgatcaaatataactatgaaagcatcaatttttttggaatatgatttttgatgattgtttccatgatttaattaatattacgaattatgtactcgaagccaacctctctacaaataatttgtttagctagactacactgggcaataattaagtacaatgagattatataatcatacatataatgcttataatgcctatccacttgccataattatcattgttttcatgctatattagttagaaaccatagtttatgataatcttttaaaataaatggctaattttatcaggttatgtcattcgattatttataactaatttgcagttaaagaaccatattaacacaactaaattaaattgtttgtatttttacatatgtagattcaaattagtgttgtatatttgctaagtaatatttgaaactataaaatatgatttgaatttttaaatgttgttatggaatttataattacatgtcaaatgtcatctgccacattgtagcttgcactaaaatatagccaacataattcatcaaagtaaaatcacaccaaaataagtgataattacataatttgttttagtcaaacgaatgatgaaaacatagatcaaaagtcaatagtgtaaaaactggaggtaatataaatattttgtggcaaaaagagcagggccggctctacatattttagggccctaggccaactccatgacatgggcccttaggcatacactctctctatatatacacatatgcactttgaatttttaaagtatacttttaaagcattcatccgctaatcacgctgaaaataaatattgataatatcctctatatatgttgctaaaaataccaaaagagcattaaaatggaattactacggttaccttgaaatcttgactaaggatcaagctccagggacttcattaataatacttgacaaaagataagatgacagacatccatttgcttctcataaaaaaatactccttcggacatttcttgatgcaaaatcattaatgatggtatcaagatcaatattgtccaagacatttttctcaatgcaacacatagccaagccatttaatctttcttgtaacatggttgatctcaaatagtttttcaataactttaattttgagaagcttctttcagctgaggctactatcacaggcacagttaaaaggataaatgctttttaggtaacattgcaaacctaaacgtatagatgaaactgatctttaattagtatttactagttactactgactgattaatactttgctagttcaattcaatggagtatggacaatatggttgcagcacagcagtacgcaagtacctgtaaattgaaacctgcagacactctggaagtaggcagattcacattgtgtcagcggtcgccggtcggacgatgtccagggcaaacagtcgacagacaaaggcacaaagctgtgaagggctgaatgctgaagggatcgccggcggcccagcgtggggtgaacttgcagaggcgccgtggagggcgcagggcgatggaggcggattggcggagactgccgccggtagaggagaggagacgagaagactggaactcggacggtcgcgtatgcccgacgattcgatcagaaacttgtatacatgtatatggtatacctaatacatacctaggtcttctgggcccctacttttcctgggccctaggccatcgcacttcttgccgtagcccagagccggccctgaaaaagaggagatacaagtgcacgtgagggagagaggagagggagggattacattctgtttataatctaatctaatctaatggtctaaaacaatgagcccaccaatttaaatgaaaaaaattgagggctagatgtttctaatctattagaatgccacttggtggtttagaagcgtttacagaaatgccacattggcatgagaacgcttgtagtatgtttaatggacttgttcaagataaagtggtataattcaaatatcataaaatttggtgttatatatgaaaaatgtcatgtttaagagtgccatatgttaattttggcagtgcagttggatgctgaaagccgacagagagaaaattaaatcaaagatgaccttttgttagggatcgatgtggaagaacatgactgtattactgtaatagaagtttattaaataatcttaacatcttagagatatttcattctagagatcttatgtctccagttggttgtaggtagattggacgtccagtatttctatgctaacatggccctccgctattgcaaggaaccctaggaagattgattaatttagttttctaaatttgattttggttccatttgccctttgggcttgcttaactgatggtatcacctgctgcagcactgtctgtactgttagagaagtgcaagaatgtcgaggtcaatgtacagcaagaagaccaacaaaggagtattcctcttctcttgtacctcactagtcaaagtgacaaaaatgggagcactcctcttcactttgctgcatcgttgaaaactagtattgaaggtttcacatcgagattatgtgaacattttcgcccgaaacaaagcccaacaacattgcttcttggactcaatgaatctgctatatatcagccagacaacagaggatcatatcctatacttgttgctgcctccaatgggatactcaaggttgtcataaccttgctcaaaaggtatccagattgtgccactttgcgtgacatccaaggaagaactttcttccatgttgccgtggagaagaagcggcgtaatatcgttgcatatgtgtgtgaaaggccaggattttctcctatcttgaatatgcaggacagccatggggatactgctctacaccttgctgtcaaagccggtgttttttcaattttcagctcgttgttccggaataggtaggtttgcctgaatttatcaaatgaggatggtttgacacctcgtgatctttcgtggattatgatacctgcgaggttgtactctaaaaaggtaatcgttctctgccttttctgaccataattatcccatataatacactacagaggccgagtttagttccaaacttattctttaaacttccagcttttccatcacatcgaaactttcctacatacacaaactttcaacttttccgtcacatcgttccaatttcaatcaaacttccaattttagcgtgaactaaacacacctagagttgatgatactatacctatttaactaggctaccacatgttaatctttcagaacccacgatatatgataagtcaactattagcactttctggaggtactgttggttacagtcgccaggaccacttcttcgaaaaatacagcaagaaaagagacgaagtaatcgattcaaacgatatgacaagtgcggcacaggttctcggcatttcttcagcgcttatagcaaccgtgacatttgcagctgcattcacgttgcctggaggttacagagcagatgaccacactgatggtggtacaccaacacttgctgggagctacccttttgacgcgttcattatctcgaacagcctagcattcatttgctctttgctagctaccgtgagtctgctctactctgggatacaatcgagggacatctccatccggcgcaggtactacgcgttctctatgctcttgatgcagagttcaactacgagcttcactgttgccttcgccatgggaatgtacctggtgctagctcctgttactcttaatgcagcagtgtctgtctgcatcatagcatttgtttctctgctacctggaaatatggaaatcggggtatccctagctatcgcaaacacattgaggattagattgggaatttgggcagcgatgtcccaagcaaggccagttctcctgttcacgtggaaaagagtttggtcctgcataattatctttggattgcctggattgatgaagattcatagaaccaaaatggcttgattggcgtgtcacctttttttctgcattgatgtactttcttaatatatcctttattcggagtgttagaagtacatttacacaacatcgtgtatgacagctttgctgttacccctctgcattttaacgtagaatatacctacgatcttaggcagaagatgaaagaggggaattcagagtgtggcaaataagttacagtgtatttactactccatatatactgtaagttttcataaatgtgtgactgaaacttttttatgttccactgttttgaatgaaaaacaaatgtttataatattatctaatcaagatttttttttcattttattggccagccagctaattattatttatgtgcttgatatcacgttcctccaatcgtttgatgatagaaatttgctccaatttaacaaaaagtaccaaatcattttcgatcgttggatctaacaatgcccatcctgcccagctaaatccaacgatccagtatcgtgaggtactagtacctcgaggtactttttgcaagaccagagcaaatctcttattgctaatcatgagacctgtatgtccggactaatataattaagggttaattggatacatgccattataatttttgcgatatgcatgacaacacaatatatgatagttaagggcatgtacaacaataactataatgaattaatgatatgcatgacaatacaatatttattattactagcttggatgagagagggggaatagagaaggatggcttagtcacaacacatatatgagaaagta

SEQ ID NO: 70828 - DNA, 23975 bp, Oryza sativa
  unsure (1)..(23975): unsure at all n locations
tccatatgtcctatagaatataataacttttttatgttagaaacaaatattcaacaaatatatatgtggaattaaatagggaagattaattgcaattggctgagaagagaaaatatgtgaagaaactaaacaggagacggttgtgaacttgtgattaattggttaagatgaatgaatagatagaaaaattgctatatttattttaggacaaattttaatgttaaaagttcctatattattttaggatattttttttaatgttaagagttactaaaaaccgagcgaatatttctcttaagctaaagtgaagtaattttgtataagtggctaggtaacttatgctagtttttttccttctataattgtttgaagtgaaattaagctacatcagtgcattttgaggggaaaagcacatagctagagcaatcatgttgacacttgacagctcaggccctcaatgaaaactacagtagttgatgccgtttcatcccaacttgaaccactgtcactttatatctgtcttttgcttatgtccatagcacttcaactaactcattactcatgggaatcgtgttaattatcaaaagagcttgacccaccagtggaagtctcacataataatgtactttattcgacgagaataaatgggtttcatttacttccgatttttcattgagaaatacataaggtatgtaatcttctcacctgtatgtcggaaaaaattgaccttaacttgtcaaatacaataatcttctgtttcttctgcatattctccaatatctcaattgtgttccatatgggtcttcctagggatgtctaattagatgaggatataaatgaaaattttatatatatagttcaaatttaaactaaatcctacagttttagatccatctttactttcttcggaacaagccccaatgagaaaagaattattggtgagcatggtttacttataaaccttaaacaccccaaattcatgtgattgaatcaagacaaatttcagaataacccaaaagcgatttgcaaatttttccaattcaaacaaatgaagaatcatatccatgcatattttctagaaacgaaattctcatgcagctagctagctagctagctggaagaacaattaaatataaccatcaataagcagttagagtgacagcaacctctgtgcctgcaaacaaaacggttggaaattaacccaacttgcagatagcccactccatcagtgcatgggcagtgtgggtcatgccaactgaaaccaaacctacggcacatgcagttcagtgcacagcatatgggacaatgcatcttagagattgtagctagtataggatgtaaagaagaaaaacaaatctgaaaatggtagcagcttcagaattctcaccaattgggatgcacaaaatgtatggcttgtttgatgttgtaacagatcaaggcactgcagagcagtgactcaacacctacctaacacgcatgtttgttgctccttacagtgtcgttttcctgctggtccagcgcacgcacaaacctgtggctttatttttctttctacttcagtctattggtataaaccgaactaatcgaccatgccatacaagaaatgtgaagctctatttaaaatgtagaagtattaacatatggtgggtgtatttaaagtttgatttggtgtgaaattctaacgaatgacagactcgaaacatgtaacaagttctatgcgagaaatatgaagcttcattcgaaatgtaggagtattgacatgtagtgggtgtatttaaagtttgattagctgtgaaattcttagggatcacatactcgagacatgttacttggaactgttagaactggaacagtagttgattggataaacttggtttgcacatggtgacaacgagaaagtaaagggtaagaaacaataggatgaaatgatactcagccattgaccaacatgatatagattgacatcagattcagatgcaatgaagaggttgtactacatctcagccctggtaagtcaacaagatacagatacaacataaataatctaacttaaccttgtgcaggtcaacaaacctcacaaatgtcattatattgctggtaaaatattcacacatccagatgctctaatccataacactaatgaaaaggttctccttctagttaaagcatcgttaaatgaaaagtaaacaaccatgcttgttcaattcataacattaatggagtgaaagaatctgaagcataagtgaaacataaacagccatattcagtttaattgcaaataatgattactgaaatatgttgtttgaatatgtgaaaataatagaaccaaaagtaactaatgactagcaatgctctttgggtttatgaacttttgagtattaatatgtagtactccctccttgtgaaaatctgagacctatttctttttcatcaaaaccaagaagcaattaactcactcaccatgtggcaaaaccaatgaacatgtaatcaataagtactagaatagcttcttggtttccgatcaacaatttaatttagcacatagtgactacaaataggactcggatttttggagaaaccaaaaatgaaatatgtctcatattttttgaaggagggagtacatctcaacggagtatttttcgttccactggtcataaatatttaataccttatgcatgagaagattcagttaaagttttgaactttaaacgtcgattttttattataataattttatcatcttccagtggtatttttcaaggtgaccgtatgcatgctattttcttttaaacttagcattcgaaaaattttatatggtcaaaattttaaaaatttaaccaaatcttgttatatgatagaagaggagagtagctaaccagcgacaatgagaatgattaaggagaactgtggtatgatgagtaacactcaaccaatatgatatatcaagatcggatcaaaaaccagattcagatgcaatgaagttgaacatctcgattgatcggttctaggtaagtcaacaaggtagacatactatcatacacaatgtcgtttctcgttcagatgatgcacctcgtgcagggcaacaatctcactatgccgtccctggtaaaatattgatacatccagaaactctgatccatacatcctacagttaaaaaaaaaaactgaagcctgcatccagtgagagcagtaaacaatcatgttcattttgactccaagcgatgcctgaaatatgttgtatgaataagcgaaaattaagaataggagcaagagcaagttaccatagttgagctttttttttttcatctttctctaccactaaaacacactgaccaaaatagtttcctttttactcgaaaaactaaaatgtgacgccgaatttgcttggaattatccaaattaaagaactactgattcttaaaaataatacccctgctaccctagcaggagcaatctgtcaccatttttaattaatctaaacatagcactagaagacttaatctaattaaactatagctcgcgattttgtctgatcgatgcagagattagtaacttaattgcaccacggaatgcgggaaacgatcaatgtggccgtggaaatcaagggctttggggctcgaaatcagatggggattctgaggaaagtccatgcgattgctcttggaaaactgttaagaattgtttttgaggcgtctggagaacagtagtaaaacaaacggggacggctaattatgtcggtgaggtactgtcaacagtgaattatatattttctggggattagtcgcttcccgtcgagtacgtgtcactgtgtcagcctaattcacccgtttgactcattaattagaccgggttttttgtgattaattttcagttctgcatttttgctgctgctgatatattagatggaacggcaatggcaggtctgctatgttgcgttgtgcaactaaaactctcttttaactctcttttcttttaatatactaacgtgcaattcttttgcgcgtttgaaaaaaaatattttttttagataatggaatacatatcccggcctttacttaaaagagctacagccaattattataaagaagcgtttgaagaacatagtgtaattagatggaatctaattaaggtggtgtgcaatttcataatttcattggatatatatatttcttgcaattttaacggtgtcctactctctttgtccataacaatgaagcataattctgaacggaggttgatcaaatctttttaactttaaccatttataataaaaaataataacaaaaaaaataaagattgacagtataaaacgatgttacgtgaaacaaatcatcataataacatacatctctttctatttaaaataatttatctttaagatattatatatcaaagtagtatattgagcatcatatttatgtcatgaattgcttatattcgtggaggcacgcagcagataatatcacacaaaatggctgccgtaacggtcgtgcaagctgaaaagttatcactaaattagtggctttatggccctatttgtcagcttttgtagtggatttatttttttttcgctctaggtcatacgagtacatcctagagatctgctaacgcaccaattttctggttttgataattacttgtaccacaaatactccctccgtattttaatttatgacgcctttgacttttcgatcaacgtttgaccattcattttattcaaaatttttgtgcaaatatgaaaatatttatgtcatgcttaaagaatatttgatgatgaatcaagtcacaataaaataaatgttaattacataaattttttgaataagacgaagggtcaaacgtttgacaaaaaaatcaacagtatcatacattaaaatatggaggtagtatataatggggtcactaatcatcattaccattgcttcctttatgtgatgtactaatatgcatttcttttccatcattttatcactaccctccttttttagtggtagtggtacaccatcaccatccctctctaatccaatacatacaaaagcactaattaaatgactgctggtactacataacaacagaacaacgatcagattaactggacagattatcacatcaaccaaatccaaatcacccatcacaagttgcagttattgagccgttgagggagttaaaaaatagtgttaaccctgtcgcaaaacaaaaaataaaaagttgttatctcttggtgggcactgcagtgcatttgcagctgctttgtctgcttctaccaaccggaatctccaacccagagatgcagagcacgctccctggccctatccactacaccatcaccttttgttcagccaacaaatcaataattaactaacaattaacaacagtaattaaagagacgtgtagtcttcagagaaacaatattcagagacataaaattgttcacatgatcatttttagtcccggttctttttaagtaccagaactattgtggttttgggttgaccgaacaaagatagttttccagtagtgtgatgtagttcatttgaagaaataatttaggaacttcagagagactgaatttgtggatgtgcagaggtaggtataggaaggcgtcagttcgcatggcagtagttagtactcgattacacgatcggagatacgttagttgtgggcatgaatcggatcgtgtaggatggggatagggagggggatgaacaagataagatgagatggaagatggccaaaatctcaataatttccctcagcagcgcctatctggggcacatgttagtgttagtgctgcccctctcctgcactcttttttttattttttatttttttggttctaagatgcttctctccctgttctaatactattactaccacacacatggttcctccttccctttgactccaccatgctgcccctgcacaaactgaaaaaacatagagagaaaaccaaacattggaaaaaaatataatttatccataaatgtacatatatatgtttttcttccaacagtcatgatatagttttgcttgtcccctcaacggctagtagattattattgttgttattgttagcaagataatacaccacctgtcagtcatagctgtccccaggtccaggtgaacccaaaaaaaaaaaagaaaaaaaaaaccactaagcaagcaaggcatgtgtgccatgtcttttgctatgcttcccatcaaagccaccttaacaacaaacctcccacacctccattctccatgtaccctcccataccataccatactcctccatagcccatagcccatccacaaacaaatagagagagaaatatgttagagagagagagagagaggaattgtttattaaggggttcattagtggacataattagtaccaccttgtaagtagtaaaccatgtgccctactatataacaatcccctaagcagcactgcttttagttgtcccctcctcatttgcttcttcttcttcttcctcctctttgtttcacacttgtggtttgtggttgccaactttgtgagcgaccatggagatgaggagggtggcggtgctggggttggtgtggctggcggcggcggcgacggtggccatggcggatccgctgccgtcgtactacaacgcgatattcagcttcggcgactccttctccgacacgggcaacttcgtcatcatcaactccggcaagctccccaacatgcccaagttccctccgccgtacgcccgctgctccaacggccgcctcgtcatcgacttcctcggtacgtcgccggtttaccggccatgatcatcatcatcatcatcatctcctcgatcgaatgcgagtggtttgattcggttggatttgcagctgaggcgttcgggctgccgctgctgccgccgtcggcgaacaagggcaccaacttcagccagggcgccaacttcgccgtcatgggcgccaccgccctcgacctcaaatacttcaaggacaacaatgtctggagcatccctcctttcaacacctccatgaacgtccagctccagtggttcgacgaggtcaagcaaaccatctgctcctcccctcaaggtccgtccatctccaattctccgcatcgccattgccatcgccgccgtcgatctaattgaattcaagaacatgtaaataaatacagagtgcagggagttcttctccaaggcgctgttcgtgttcggcgagttcggaggcaacgactacagcttcgcgtggaaggcggagtggagcctggagaaggtgaagacgatggtgcccagcgtggtggcctccatggcggggggcatcgagcggctgctcgacgagggcgcgcgccacgtcgtcgtgccggggaacctccccgccggctgcatcccgatcacgctcaccatgtacgccaccgaggaccgcagcgagtacgacccccgcaccggctgcctcaagaagtacaacagcgtcgcgctctaccacaacgccatgctccgcatcgccctcgaccagctccagcgccgccaccccgactcccgcatcgtctatgccgactactacaccccctacatccagtttgcccgcacccctcacctctacggtaagtctatcttaacttctggctatgtatctggacatatctacgttcttttttttttcttttgccgtgcaactctgctttcctctgcaatgcgatgttcaagacagaaatggtagtttgagggttggtcagtatggggccgggggaccatgccaggcagcattgcaatacagcaagagctagcactggatgatggttgggggtactgtgtgtgcagggcggccagccactgacactaacctgacggttacatctcacaaaaccgtacccatcatctcacccacactcccacacagaccgtgtcgggttggtttggtggtgctcgttgctccgtgcgtgcgccacaacattccatttctattgtttttctgttcaaccatggcagccaaccaaacagcccccgtaatcttcttgacgtaccgacggcgaggattttctagagttacttcgctataacagtacggtgtcattttgctgtcttaaggtatcaacccttgggaggggagatggtcctgaactcatcattgtcgtcggcgagttagaggcagagcagagtagatacgccggtgtcagcggccagagcaacggtgtctgtgagttcacctaccaacacgtacgcgcagtggcacagctgttggcgtatctgctgcagtgaccgtccatggccaggtcaccttgttttggcttgatccggcaccattactggggacaaacatcttctctcatctcccacaattattcctcccaacatctgattaactctgcacaataatcaatcaaatccctcattggaagcaatcactaggttggtgtgtctgatcatcgccaggtgtatgaagtctgaacaaagaatctcagcagtagcaggatacatcagagcatcagagttgcagaacagagtctgcattgcatcttacaagctgttaatctcactcgacctgtggattcattcaagaaccgattgagagttgacatgagaaatgtgtttgatgatctttgatgcaggatacaagaggggcgcgctgagggcgtgctgcggcggcggtgggccgtacaactacaacatgagcgcgtcgtgcgggctccccggcgcgacgacgtgcgaggatcccgacgctcacgtcagctgggacggcatccacctcaccgaggcgccctaccgcttcatcgccaacacctggatcaggggcccctacgcccacccttccctcgccagcgttgtccgcgacgacatggtctattagattacaggtgatgatgacctccatgtttttttttcaatttttggatcaccagagatgaagaagaaggatatggcgtatggacttgccttgagtcgagttgggttggactganagagagagagagagagagagagagagagagagagagagagagagagagagagagagagagagagctaacgtgcattccattttgttgttggtgtatattggcataagtaaatcgattagatttttaaatttcttttttgttttattttgttttttaaaaaattgggcggttttggtgccatgtaatactgcctactacttggtcataaattaatggtggatggatgaactgtttggtgtaaagcttggcagattggagtagtttattgtcagaaaagggaaaaaaaacagaattgcttgtgatgatcatgatcatgttttataccttacgtttgagtgggagtagcatccaaactccaaaagagaagaaatcatcaccgatcagctcgaaaggcactacacgcatcacatatttggcttgtttataactgaacataggtaggacggtgagggccggagagataggaaaataataaacatggaaactcaggttacccgctttattgattacacttgacactttcctctcatgagcttagtgacaaagcacacacacatgctttggtagtttgattgcaattacctcaactaaagatcatatgcaattatgtattgcacaattttcttttttgccacaaattgacgagcaaaagcaataagcaaacccatatgtggttagaggagaggaccagagtgctgtagttgcagaaaaccaacaagctggctggcagaggccgcaaaagcacttttggcgaaaggcctaatgacttcttccactgcaagctagccagcatcattgtcgccttttggcatcgaatgcgatgaatcgtgcagaagaaaaccgatcgatccccaaccggatccatcctccatgactcgtttctcttcctagcggtacatcttccctgttgtcaccgatgagggcttttgttttgcgccctgttttccaaagtttttttttcaaacttccaacttttccatcacatcaaaactttcctacacacaatcttccaacttttccatcacatcgttccaatttcaaccaaacttccaattttaggtgaaataaacacagccttggtcaaaccaaaccaaaaaaaaaaaatcctactcatggccggtttcgatgtgttgattgatgatagctaaaattgaatttatggcagttgttaatgggcataaacgaataaattgaccatttgaaaattgaacaaaaatgttaacaaaagttatttccagaaaatgttgataaaataagattatgtagaaatcacatcatttgaaagattgaaaatcatgtccatgataatctatcatcttaagtactccctccgtttcaggttataagacgttttgactttggtcaaactgatttaagtttgaccaagtttatagaaaaaagtaataacatttttaacccaagacaaatttattatgaaaatatattcaattattaatttaactaggaaggtagcccgcgcatacgcgcgggcatgttgtttaatcttgtttgaacttttattacaaatgtttatgtgtggatgatatttttgaaatattttttgactctattttaaacgtatgctcgttaataactggtttcggcgtattacttgaaattgtatatcttcaaatttattagaaaaaaatatgtcaccataacgaagttagttcatatctatttgtattatgtgtgattcttttttaaaaatttttggagtttccaaactttatataacattttttattttatacgccatagactactttaagtagcattttaattttattatatattactgaaatatattgtctattaaaaatatagctagtgatactacttcatctaattaaagatgacttatattacttatattccctctgtcacataaatcgaaggagttgaattttatcccaaaacaatagaaaaatttatatgtaaccgggacaaagtgattttttttaaaataacaccacattaatctccaaagtaacgtatcatattttggcaaatatctataatatctatagtgtagtgcatgttagttcagtgtccagattgttttcaacacctattgtttctaatcatatgagacgccattggtaatttggagaatacatatgtacatttaaatcagcgttgtgtattcctcaagtgttctttacacctaaaatatgatgtgaaattattatcataacattaattattacatgtcggctccatatttgtgatgtattttgggctatagatatttagtagtttatttatttaaaggaatacaaccggatcacaaattggatatataattttaaaataatttaaaagataaaacgcttaaaagcattgattgggtatttcatatttacatttgcgtaaatttgaagattataatattttatccttaaattgtagaaaattcttttttaaggactgccattttttggctttatcataagtatattttctgttcttccagcaaatgatatgtaagcaatattgttcttttcaatcatatctatatacggagtactttttctggtcaacagttacatatttctcatgtatccgtatataggagaaatgtattattttttaaacaataaatctaatctaatggtgtaaaatgaaacaactaaattgtgttgttttcatttatgcaaatgtagatttaaattagcgttgtgtattcgtcgagacactctagaatatgatgtaaaataaaaaattatcatagcattaaatattatatatatcagcctcgtatgttaagatagaacgaataaaaatcattgatgggatatttcatatttataatataaatttagtttaactacgtatatttatgcaaatttgtagagtaatatatttatctttaaatagtagataatactattcataagaccatcgatcctttccgaatgatacacatttttttgttttattgtttttatagtaaggattttgaaaatagtatttcaatagaccaccgtgcatagatttttctttgttccgatggacagtaggtaagcttcatttctttttttcaagtcgtatgtacgtacggactacttatgtattttttagcttaacagttatataggtctcccgtatacctacatggggtattagtttttaaaataaaatacatctaatataatggtctaaaatattagattcaccaatttaaatgaaaatcgatggtgacatttacttaaatttatattgaggaatagattttatctttaaatagtagaaaggataatcaattttttaatggtcctacgtatgttttgttcgctttattgttttttatagtactaagtctgtgcgtaatttttttctttcgataaacagtaggtaagattcattgttttttagtcttacgaatgaacatacttgtgtttttgttttctttttccggtgaacaataagataaacggtaataagattcattgttttttaagtctcacgtacgtacatacctacggagtacttgtgtgtttttttttctttttccggtgaacaggaaggtattagtttcctcttaaataaaatacatctaatctaatctaatggtctaaattatcaggtccaccgatttaagtgaaaattgacggtgagattaggtattgccacgtggcggtatatgagcgtttgcagaagtgtcatgtggtggcttgagagcgtttataggaagtttaatagacttttagtatataatagatagatagatgacactaatttagtattataaatattaatatttttatctataaatttagtcaaacttaaaacagtttgactttgatcaaaatcaaaacaccgtctcaatccatatttatggatacataggccccattctttttttattaatttacagatttcacctcggtttctgtttacacgttttccaaacaaccgttgaatggtatatttcgttcgaaaactgctgatacagaagatgttttaaaatatcagataaattcatttttaggtttgaagtaattaaaacttttgatacagaggtggctaatagcttttcctattttgtgtgtacgtactaaatctttgtgtcatcggcaggtccaaacggggccatattcttgcttacgaaagcaagcaagcagcgtgcggttttccggccgagcggcaaggggatagccatgaaaaagaagaggagattgagttgagttggagctaggcgcccgagcttttagctatctgcctagctttgtttgtgctttgcttgattgccgcgcgcaggaggaggtagaggtagtagaagccgccagcgcgcgcgcgcgcgggggcgcatgtgcgcgcgtcgcgtcgcgtcgcgcgtcgctcggggacaaatcacgtggacggggtggggcgggcggctgcgacgtcgtgcgcggcgcggcgtggcgtggcgcggaggcttcgcgccgttcgttcgcggtctctgagttaaatgtgcgggtcgcggcacatcagatgctgcctgctctgctcgccgccgcccacacacaccggccgtcacggtgttgtccctcccagctcccagatgtggcctgaaatctgaacgtttgaatgtcttaatcgctcgaaacgagtaaataataaatgcgtgaacattcaattgtgggattttctaagggtagagattttctaagggagtatggcatggtttagttcccaactttttcttcaaactttcaactttttcatcacatcgaaactttcctgcatacaaatttctaacttttctgttatatcgtttcaatttcaatcaaactttcaattttgacatgaaattaaacacaccctatgtgtgtcctatgtgtggagaggtgtgtgtatttgtctttccatccaatcgtaacaaagaaacaaaacaatagggtcttttttttttgtctaagtaaaaagactagtgcaaacaaaacaaccacggatcaaaatgtacatttgtggcgtaaggttcattcttctatgctttttcaaagtagtgtgttgttgaaacttttcttttgcagtagtgttactttcagtgctttattttcttctctctcttaggatgaaaacaatcggaaacggtatttatttttctattattacagaaacggtactgatacggtcggagctctctatttttacaactttaatacgacacaaacaaaaattagaaaaaccaaattttactatcatagacacttagaaagaatatttttcattatcttttatgaaaacggtatatatacggtgagaaaatttatgtaccgttttttcatcccttctctctctccttttgcacagataataaaaagtaaattcctggcaaccactggttgtttgggctaatcggtgctttgttggtcaatgtaagatcaccattgctcttgctccaatttcgtcctgtagtgggctttttcaacgagcccaacccatagaacccggcctggatcacgaaagaatctaggcccatctaagcactagcaaactgcaaacagctgccagcgatcactcgagagcgctcatggcaggttgacgttcgctgcatcggcgacaaattaagcagctacccgacatgccgacacgaactaatctgcaattggaattttggaagaatactggcaccactgatggactcaaccaatgtagtttgtaaatcttcaattcttttttcgtaatttttagaaagatttacaatggattaagaagacaaacctagtgctcaagccctaattacctagactcgtctctgccctgactaccaccgcgtaaactaatcacaaagaatcagagctcgaaaagatgcagagaattgaagtccatgcaagagatgaaaggagaggacaccttctctattctcacgatatgaattcacattatttcccaatcatattcatgtacatcgcatacagattaggcactcttatgaaatttggagtacaactcagaacaaaagaatcgaccaaaacacagctaaaaacacaagagcaattgctactgaaaggctactgatcacagtgtctcttccatgacccaaaaacatactgaaaggcgctactgatcgcctcatctcatggcctcaaaactagggagtaatatattgctccagctctctccctctccagcttcgtcagcagccgcagcgacttgccggcgacggtcggtctcgggccgccgtcgttgctcttcgacttggtgggatgcggcggcggcggcggcgcggcagcgttggtgacggcggcggtgggcgtgatcaccttaacttggtccctggatacgcgcacggggcggaagggatcgtggggcgggaacccgacgttgtagacgacgtcgaggaagccgtcgtcctcgtcggcgtcggacacgacgacggcgccgagccggagcacgaggtggcggttgagccccgcgccgatcttgccgacccgggtgcgcacgctcaccggcgtgcccttcttgatgatcggctcgtcgacgccggcggcgccggccaggaatggtgaggatgcccgtgaaaacttcttggcgacacgcccagtgatcggcgcgaggtgatccgccggcgtcctcctgctctcgatgtcgcggagaagcctcttcatgccggccgattgcaccgtcatggatggcatggtgctggaattgtttgatcgagcgagagaaaatcaggtgagatgggatgagagtcgagacgaggaggcggcaaaattatataggcggttgttgaatatgaaacggagtctacacgcgcagtcggagtcggagatcgacgcgttcacaggcgcagtcggagtcggagatcgacgtgttttcatttcccgccatctttcaaaattttgtattcgtaatgttggacgtgtgtggcggaaattgggctgggcgggttgaggagaagaggcccaggctgacatttgtacagcagggtaactgggcttggtttgaaagaggaataagttcatccgaggtcccttaacttatcaacgaaccgattttcgtccttcaaccgaaaaaccagatacaacgggtccctcagctgtcaaaactaatgcacatgaggtccctcggcagttttggctgatgtggcacctatgttattaatttgacttagtcttcatctgatatggcatggacgtgacgcttatgtggcaatgtgacccgaaaaaataaaacctcatgggacccacatgttagtttcacacataaactaatcaaaaatggtggggcccacatggccccacatgtcattctcagccccctcttcctcctttatcccgatctccctctcttttctcttcactctctctgccctctcatctcccaatgcttgatgcctcactgtcgtcgccgtccatatgctcccgcaggccgtagctcattggcgtccggcccaaagagatgagagagcaaaatagacttatttctaaccatataagacatggcccaaagagttgagggactcaaaataaacttattccaaggacgagcacgatgcaatgatcgtgccttcggatcgacacggcatgacccgagtcttattgagtcatgtctgggccgtaggcgcagtggctgcacaaagcaccatatggcatgtcgactgggcgtgccttgatgtaatgccccgctttcagcgagacgttaaaaactagtttaataaaatcctaattgcgaaaattccgttctttgagtgagagtctaagtcgtgccatggatctcaattcatatcccttgttccctctcgtcgacatcaaaatcctccaccccaagatttcaattccgattcaacttccgaagtcaaataccgaattcaatcgcatcctttgaatcctcaccaaatacttgtccctgttttcgcaaatatcaaattctcattttgaatctctctcttgacatctccttgactccaccttgtgttcctagaccaaatatcaaagttaaatccaattccaaacttcttttccttccaaaccagttctcacagcagaagttcaaaatccgtccctctacttttgtgggccgaattccctccctcggcccatctcctctctcagcccgtttccccctccccttcccacgtgcgccgcacgtgagccgctcgggagagctccctccctccctctctctctttgttctctctccctctctttgatcttccggctgccgcgattcgattttcgccgccgcccgtggtatcccgcgcgctcccctgccgtggccgaccggaaggacatcggtgtcactccctctggtcatcgcctgcgccgacgaccgtcctgtccccgctccactccacactgcccaccgccgtcaccatggggttgctggcgtcacctcggcttccatgtcccgggctgcccgcgtgcgtccaaggccgaaagcccgagagaatgcgcctttctcacgcgctctcccttctccctctgctcgcccaaatcggcaaggagcaaagctcctttccttccccttttcgcttttcccctgaccacagccgccaccatcacctgccacccctttggccgctagcgccggaaccagccaccgctccttgaccgcccttgatgtcggttccctctcccaaaccgcctctcctcgtgcctataaagctcgagccatccttctctatctctcccattttcgctccccaccgccaccgcgccattgccacctgagcgtcaagtttgccgccgggtgccgccgctcgacaaacgcactccgtctccttgtcctccgtcgaccgaacaacggtcgtcgccgcctcatcgcgaccctgtccgtgccgccccggtgccgtgatcatgacccacgcccccgtgcgccaccgactcccactcaccaccggatcaccgccgccaaattcgtggccgttggtgaaccctcgtccccttccccttatcgcgttaaacgttgtcaccaccctcgctttctctcttctccatcgtcctaccaccctcgatgctgcgtgtgccatgcgtcgtcatcggcctttctctctctaaccaactcgtcgtcaccctcccggagttccttgcgccaactctttgcttccccaaccgtgccatctcggagctgtgccgccccgccgtcgcgactgccatgaccacaactccatccccatcgacgccgttccctgtcatcgtggcccgccgtggctctatttttgtcgccgctgttggtccccctcccttcgaacccgctcaccaccacctttctcgagcccctctcgacctcccccttgctgttgcgtggccgccaaccgcccctcttgctaccgcgccgtgccgccctttccgccgccgcgggagcatccccgaagaccattgggccccgtgccacttcgcctcgcgtcgcaatcgtgtaatggttcgtctaagcccgatcccgcactctcttttccctccttgcgctcggccacatcacccatttggcgagcctcgccgtcgtcgccggccgccgtcacacctctcctctcaaatccaagccgtggaatgagttccccttgacctcctctagctgccggtgatagacgcccttcccggctcgccgccgttcgccggcgcccctcggctgccgtgcgccgtccgatctgggcaagcccgggctccctctctcttgcgcttgcatggcagtccacatgggctcgaccaagtccgcgcctgccccgtcagcctccttctctccctccctcgcccgtgggctcggcccaccagccggcctcctcctcggcctatcaatacaatcaaagtccaattttactccctcctccaagtccagtgaccccaatcatgagctaaagtccataattgttccctccaaattgctcctccctcaccctttgattggccccacatgtcaatgagcgataaaagaatattcttttccatagaattcaataaatcatttctcctattccagaaattccatttaagcttccaaaattcatatctattgatccgtagctccgattgactccgttccacttccaataattccgtaaatttgagatctatataatggcactattaattagtctaaatagggtctttcttttggtcttgagcaaggcaagtcaccctttgaccaattgctcccttaattccaaaataattattattttgtttgcaacctgcattattagaaatacttaactcgcttggcctcggtctgcgtgccaaaccgatggacctacccagtagtcgcactaattcctgtaggccgttctaccctgattccttgtcgctccacctttgtggtacttcggtatccgtgctctctgagcgcgtataccaactattccacatacaccgttgtttgtcgataattgaggaaatgggttcgagaagccttgaaaacccgacatgtggtgtcagtgtgtttgaaaataaaataaattgtgaaaactcgcgatacaggggttgtgcctgtgtggcgttgtcccgtatttgcatataaggaccaattcatgtgggaaattcatccgagcatataacaagtgcgaccacacgggtagaatgagacgctcttggttgagtaaatagcaaaccagggaagccttgatgccaagagacaagtggattcaccggggtggtgtcgaggagaaccactgggcttcctggcacggtatggtctaggacctaacctgttgttggtttgggacccctctcgttggcatatggcgactctgtatcggttttcgaaatgccttgtcatgaaagccttaaggtctcccgacgtggctgatctccacgggctgggtgatccgagttagtaatgttgtgtgggtaaagtgtaccccatctgcagaggttaactaactgttcgagcagccgtgcccacggtcatgtgctgatttgaggtgtttcccgttgcgtagttttgtttgcatgtgctttctgaaaagttgttgtggatgggaatcgttaccagaatcaacctatgtggcagatggatgacctgaatggtcagaaacggatctatatgattcagatgtctacgggcattatagactaggcttcccgagtggaagcagattgttgtgctgctgggcaacatgactctgggagtccgagaaaatgaaaaggctctaggagccgattaataagagaaatggctctgggagccaagaagtaatgatacgacccgggaggtcagtacattaccatttgagttgttgaaaagcatctcttaagtcgaatcgagacgcaagtctcttttcgacccaaacctgaaaagaaataaatcacctaatgatttcaaataaaaaatttgcataacaaccttgcctctcttccaagctgaagttgaagaagaagtaaagtgaagattagggttacgtcttggttcccagccatcgcctgtggtgttgggtgttagtccattggttccactgctgctactgttgttggtgtttgcctcgtatgtcgtcggttctattctcgggctgtcctgagctataatctaagttaaggaaaataagtcctctatttattttaagaattacaattattcatatttgtcaccgtgggtaccagcgctattgtcgtgggattgctattgagatcgcggtttcgtaggaagcggttcgcgccgtttttcctacggcatgctcctgttaggtgccgttgtacggcggtgccggatcgggatgtgacacttgattgtacccggacggggtccatttggtcatctatacctcaatgttcagaccgcaagcaaattacccactcccattttgcttcagttacctcatgaatccgctgctgacggccgccgccgccgtcgtcttgtgcttcctcctccatggcgcggccgcctccggcgacccgttccctccacggttcaactccatcttcagcttcgggagctcctactccgacaccggcaacttcgtcctccagtccgccggcctcccgtccatccccttcaaccactccccctacggcgacaccttcttccgccgccccaccggccgcccctccgacggccgcctccccatcgacttcatcggtacgtgttctacgcagttgccgtcgccgtcgccgccgttgttgattaatttctcgttgctgtgtgattgatgctgttttggcaatggcgcgcggcagcggaggcgctagggctcccactcgtgccgccgttcctggcgaaggaggcgaacgacttcggcggcggcggcggcgccaacttcgccatcgtcggcggcacggcgctggacgtcgggttcttcatccggcgcaacaacgcgagcgtgccgccgttccagagctccctccgcgtgcagatcgggtggctccggagcctcctgaggcgcgccggcaacgccaccgcggcggagcgcctcgcgacggcgctgttcgtcgtcggcgagttcggcggcagcgactacaggtacctcctctccggcggcaagagcctcgagcaggccaagtccttcgtgccggaggtcgtgcgagccatctgccgaggcgtcgaggtaactaaaacagtaaaaacacaaacaccattgcccaatgtccattgcatttgctcgcatttgtcgccgccggcgccgacgaagacgacgagtgtgtctgtgtgtgtgcagaggctagtggaggaaggagcgaggtacgtggtggtgacggggacgccgccggcggggtgcatgccgatggagctgaccaagtacgcggcagccaacgcgtcgtcggcggcggcggcgtatgatcgtcggacggggtgcctccggcggctcaacgggctggctcagtaccacaactggctgctccgggaggctgtggagcgcatgcgcggcaagtatccgacgacgaagctcgtctacgccgacttctacaagccggtggcgagcctcgtccggcgaccggcaaagttcggtaagtcgccgcgccgagattttttttcctgctttaattacccagtttcatattgtaagtcgtttgactttttttctagtcaaacttctttaaatttgatcaaatttatagaaaaatatactaacatttttaatacaaaacaaacatattatcaaaatatattcaatattaaatttattaaacctaatttaatgttgtaaatattgctattttttctataaacttggtaaaatctaaataattttcactaagaaaaaagtcaaacaacttatagtatgaaacggatggagtattttctactagaaggaaaaacaaaaaggaaaattgtaattatttgtttcgagtacaaatcggatgcactgacatggttacacccacacacatggacatatcctagctagcacaaatctaaagagactgaaggcctaacataaagacgcgaatattagagaatgaccttatattagataattagaaggggtgagacttcgaatccaggtcgtctagtctaccatcttgtggaagtggccgaaagacccctgtacgtttctcattgaaggcctaacatcgtgtagcgggtacatactttgtcaagcccaaaataatttgaacctttaacaaaatttgaacaaatttgaccaaatcagaaaaaaaatatataatacttccctcgaaataatttcaaaattttcggtcaggaattttaaaccatggtcagccgtaccacctgaaacttgaattgggtcgttagattgcaccacaggtaatctgattagctgagctcggaaaacaaatcctaataggctcaaattttgatgaattgtaatttgatttatcttttatagatcgacatcgatcagccatcgtcgtagctatagctcataaatgcgagtgtgcgacagtagccatgtacacacgtaaagagatataagagcaggtacaatagcaggctataaactagctgcaaacatattttaaggagataaataaggagagagaagagtagcgggctacaaatttatagccagctgtagcacggactccaagacacagtgtgtatatgacaagtgggaccatatattaatggtgtagtatgtaactattgtatgaataagctattagattggctatagataaattggagctagtagttggctatactattaaacttgctctaatgcctgattagtgaagtcaaattggttgatgaaacctaaagcgatagaacaattaactgcgctagcttgagtacttgagcacttccaagagctttgcaacttacgaaattttagaatctttaggtacgttaagccatgaactatgtcgggaaggcaaagccgaagaagttacaagattattgtggcttgtggatcgagaaactagctataaagtctacaatcacagtatctttttatgaaaacaatctggcatgcagctgtaattttgttgggtgtcacacaaaataatctaccagccagcttgggtcaactctgctagcatataaaattacaaaacacttgtagaaacccaatgaaccctgttaggtttgttgacataagggctggtttggttttaggcctaaattagacttatcaatatttggcaaatttaatagtgtttagtatctatttggtttgaagccaaattttgacatgcctaagaaaataggccatttcaatagtgaacttaggctattttagcttcaatccaaacacaactttacctttccaaaattagtcatgccaaaacttaccaaaatttggcactgacaaaatttggtaagacctatttaggccacaaaccaaaccaaccctaattctcgctcatttcaatctaaaccaggttagtccttttggtcatatatatttaacgtctaaattaatatttctagtaaattcgtcaatcttaaaatattcttgccgtctttcagaaatgcttatagagatatggtatacatatgtgcgttcatatgggagagtgcatgtgcgttatcatcactaacgtttataatgtgtttcttaaaaaagattaaaatattattgaccaccgataacttctcagatagttagtaaaagaaaagaagaagtgattacatagatttttgtttcttgaaaagcacattctatatacttactagattttgaaaatcttataatataaacataaaagtcaaagtt

SEQ ID NO: 70829 - DNA, 1050 bp, Oryza sativa
  unsure (1)..(1050): unsure at all n locations
atattcaaacctaaattaatcatcaagggcataacagacatttgcaaccaaacgcaacaatgaaaagaaggaaaatataatggcaggggtatggaagggatcaaattaaaatttcaagggtatagaagggttaggtaaatttcagaggtatgaaagggattgagtgagtttttataggtacacatggaatttactcaaactgcatgtgttatgttggtctgaatgtttgggttgcggtaatacaggattccattaagaattttccacagctttttcgttaccccaaatcctctttcaattgtatttcgccgcgagacatgcacctagttgaatatttcactagtacagaagagctttttccatacgggcgaaatggatctttccatgcagctagcctgcccgcatggaacaagaggtctgtaaaaatcgatatttctccatgcgggcaacacaaccgcatgcaaaaaggggattttcacatgtggtccacaaagccaaccgcatgcaaagatatttttcagccaaaaaaaataaaattccaaaaaccccccgaaaccctaacccgtcgcccgccgcccaccgccggacaccacgtgaccggcgccagatccacgccgctgcggccgccggccgtcgcggggcagcgccgtgcctgctgccctcgccgcctgccgtcatcgtcgccgagcgtcgtgctcctccgtagggcggcggatccggccctcccgaggacggcgccgccgactcgccgtgcccgctgctcactgccgagagcccctaggacggcggatccggccttcccgaggacggcgccgccggatccgccgccgtaggccgtcgccgtgcccgccgctcgccgccgagaccccctagggcggtttttttttcctcccccattntattcacacgtactccccagatttttctttctttgtatgtcttctttgtacttcatctacacatttcttgtattgctcactcctatctctccatcttcaacctccactgtgtttcaccattcattatcgcgcccgcatcctaaagtttacg

SEQ ID NO: 70830 - DNA, 10351 bp, Oryza sativa
ctcatctgtttgcctttaagtttctgagacgaaactattgcaaaccaattaaagaacgctaggacagtcagagcttgcgttcttatgcaataaaaccagctacagtagcgaaataactgtgtaaatcagaacactttaatgttctatcttggtcacttcaatttcatcagagtacacatttccctaactacaaatatgtactcctacgcaagaactatcacttttttatcgcatgaaagtagaatgtgatataaagctcacatttctcagagtagcaattcacaattgtacttgtattctttcaacaactttgtgcgaaatgctggcaaactttagggtgtgtttagttcatgccaaaattgaaagtttggttaaaattagaacgatgtgacggaaaagttggaagtttatgtgtgtagaaaagttttgatgtgatggaaaagtttaaagtttgaaactaaactcggccttaactgaaaaggtaagaagaagagtcaggctcttccaagattatgatgcaatcatctttttaaccttagacatagattaccactcactggatgaagcatggaaaagttacgagtaagacatctaatgatgcatttgttgtagtatatcttactagcaacttaggctctagctaatcaatagtattatcgtcttgaaaatccagcaatttgtaacttatttctccattaactagtcaggaatctttcctacatttatcgtttctgcgccaagggataccagtattaagttggcatcgttcctcaaaatgggctacaacctttatgagctcagagccttaaaggcaggtgtaaagagggacatgtctaatctttgaccacaaaaaaatgaattaacccaggaaccagtgccatcgtggataaatgaatcccattgacataactctccagcaacaggtagaaataactctaggaaatgagcagggtacttctccctccctctccacaaatataactgttccaagcatttaaaatttgtccacaaatataagaattctagaatactacttattcatcaattatatctcatctgaatttcttcccatcctatccccaacaacaaccatctctccttcaataatggacaccaaagtcttttctcctcaatcttaaatctactaaataacttagaattacttatatatgtggacagcgggagtactctacaaacataatcaatgcattatggaacacaaacttgtaggattgaacacaagtaaccaagcctaccagagagggatgaatggtagggaaaaccaaaaacccaaaaacttttagcggaaataaaagttaccctcaaatcgatggaaatctcgacgtagtcctgtcgccgccggccggaccactcacacgccgccggttagatcatctccctgccgcctgaacccgaagaaacacaaatcgaagaactctcaaagtagatgacaactttattgcttctctctgtgttacaagtgcaccaacagcactctttacaaaaatttcgactaaactcgaaaccctaactaaactagcaactcaattgctctcgaaaacgataccgggaggctacctctccctctctgtttataccgaaaacctcctactcaaagtagcagaacaactcctaatcacactaggactctatcctcaattaccaaccaaattacaatttaccaaattgtaattctctcaaactacagccgcacgcatctcttataccagcttggtctcggtctccatcgcacgggacgacaccaactcggcctctctaccttgccctccagggcgacacggtctgtatccaaccgagccgctgcatcgctacctgtttgcacagaacgcacacacatgcatgctacagtaccgcccgtactgtagcaccatatgccagccaatcacagacacgatcaatcacacatatatgcatgctacagtacctcgccgtagtgtagcatcatatactcttcctcagttgtactctaatccccttcgcgaacaccgacgcttgcatgcatacctcgtgaagcccgttgcgaatatctctcctacacggtatccatccaccgtgtaccatctcgtatccaacttcgtcacccgatatacttaatagtctggacctcaactcctccttgagtttagtcccgatccccaccgttgactgaagttgacctccaagaatcctgactctagtcaccttctcacatggtatcccgaccgcaatagacctctgctcctccctgagcatagtcccggtcctcaccattgactaaggctgacctcaagtcacctgcacacaatcagacaaaacaaccgtttctggacacagatatcacaacctgacccacattagtcacacgcactcacaccaacatccacacatactttcaaaccaaatctttgattaaatcatttgcatagccaattgttcatcacaaatattaatcataaaaatgatttcacaaaactatttaagacaccatgtaatataacataaaaaaaaagaagaggtggtcagaagtacttctttctcataaaattttgtctcgaagatctgatttcctgaacaaagatatgttttcctttgtacaggacagtaggacacgtatagacctaaatgaacaattgaaaagtcaggcaagaaacagaggccgagtttagtttcaaaatttttcatcaaactttcaattttttcatcacataaaaacttttctacacacataaactatcaactttttcagtcacatcgttgcaatttcaaccaaaattccaaatttggcgtgaactaaacacaccagaaatgggccagaaactaatatcagaaaatgagttagacaaaatgtatttcagttttgacacatggaaaggggccatccaagtatccaagtaagatctttgctcgatacagttatacagaggcaacataacctgcaatcagcagcagtaatgcacatgaacaattgaacacagatgctgatttacctttgagttccagaacgagacagatgatgccacctctccagccatgttggcaacaacatccaatagagtaccaggaagcgcagaaaaggtgtcagggaacacacatacagacagaggcagtggtggtggtctggtggatgcctatcttgttgtcgtcccgtcccgtctcgtctcctccaggcagatatggctgagagctccagtccatgccgcgcacacgagctaggcacgcacgcggcacgctcctcgtcgtcaggcgacctggctgcaaatccaagcgggggcgtcctcttcaggtgttgttgcgagtccaatccagccgtcgcctcactctcccccactggtgcccttcggcgcggcatttcgtcaaacacctcgtcgccatgcggtgatgcatgcgcggtgcgcccgtgccgacgagcaacttggcaacaggaaacagtcctcctacgacgagtggcccagcactttcgaggcggcggcggtggacgttttctgcctcggatcagcttgcccgcaccgccgcacgccggcggccgcggcggcggcggacggttttgctcagacaaagacggtgagggtatggcccgtgggccgcctctccaccattctcccattcttgggccgtctaccgatctcctattctcccttggaataagttcaccggaggtccctcaacttaacagcgagaattttcgaggccctcaaccataaaaccagaaatctccacccctaaactatacaataccgttcactcaaggtccctaagcagtatatatgggtggtttcgctgacgtggcatcctagtcagcaaataaaaatttaaaaagtgcgtggggcctacatgtcaactgcacatattctttttcttctctttttcttttccttctcttctcttttctctcctctctccttttcttcagcgagggaggcggcggcaggcggagcagcggagggcgagcgcggcagcagagggcgagcgggcgcgagcgcggccgcgggcagagaagcgggcggcggggcgcgtcacgtcactagacgtgtccatgagcctccttgccggcgagctctcaccggccatcgccaacctcacgtagctcgagctactcatcaacctcacctccaacgccttctccgggagcatccccgatggcctcggctggctccggcggatgtggtatctcagcctatgcgacaacgcgttcgccggcaagatacctgacgtgctccgcaattgcaccgccctcgacgtcgcgtacctcaacaacaacaacctcgattgtcggcggcgttccacggtggctcgacgcgttgccgaatctcatggtgctccggctcagccacaactcgatctccggccacatcccgccatcgctggcgaacctcacgaagatcgtgcagctcgagttcgaccagaaccttctggaaagttccatccccgacggcttgccacgcctcccagcgctccgcatgttagccttgtcgcagaacagcctcaccggagagatcctgccgagtttcttcaacatgacgtcgttgcgaggcctcgcactcgcgaacaacgtgttccgcagtgagctcctagccgattgacgtgggcgtgcgcggaccagcacattcctccaagttctaaacgcagatcaaaccatacaagtgtaaaacttcatcaccgaattcgcatttctatctactccacgattcggacgtcaactagcgatagcactgtagtctgtaccacgagttcacgacccgacacctccaggctctatccctaacccgagtaacaaccaaaagaacccaccaaacctggacatctcgagcgattcccacacagatctgcgagggctagcgaatctatcgacactacataaatcagagtaagtccaaagaagcaccttgcggcggaggtgctccttggggatgccggagaccatgcttatctcgcctggcttgatctcgacgagggcgtcggacgctgccgcggagagcatccgcgcgggcgcgggagacgatgagaggagcgcctgccccagggaggggaagctccgcaggagcggggcgtccatcttgtcagagccgtacgccgaccgatgacggcggcgcctgggagttcttggacaacctgaccaactgcaacgccttggctgagatattcctcgacggcaacatgttcgccggcgtgatgttgagctccatcgtggttccatccgccattggccgattggcgacctcacgcagctactcaagctcgaccctgagtggtaactcgcagctcgttgcgcgccgcctgccgcctgccacgcccgcctcctgccctcctctcccgctttttccccacgccccgccgtgcccgcacccgcatctgcccgcctctccaaagaagagaagagaaaagagaatatgcagctgacatgtgggcccaagtactttttttaaaaaaaattgctgactaggatgccacgtcagtaaaaccgggcaaaaatactgccgagggacctccggtgaatggttttgtatagtttaggggtgaagatttctggttttgtggttaaggggccttagaaaatctcgctattaaattaagggacctccggcgaacttattccttctccctttcttgggccagtggtccattttgaaacgttaaatgtttcatccctcaaaaaagaaaaaaaataaatttcacaaactaagtataattccaccaaactattacaaaacggcaggttgatgtgttggagtatatcataatcacagattgaacattatgtgtactatgtaaaactacatatctactctctctctccctaaatataagggattctagttgtaccaaaatccttatataagagattttggttgaaagtgacaggacggagggagtataagcgtataagttagtacggattaataaagttattatttttacaaagttagaaagctatagttttattatgtttgtagttttgtaaaaataaaattggtaataaatctctagttttgtgatttttttgtttaagcaatccctccgtttgtaaatatttgacaccgtcgactttttagcacatgtttgaccgttcgttttatttaaaaacttttgtgaaatatgtaaaactatatgtatacataaaagtatatttaacaatgaatcaaatgacatgaaaagaattaataattacttaaattttttaaataagacgaacgattaaacatattttaaaaagtcaactgtatttagaaacggaggagtatatattttatttttttaaaaaaaaatacttaaaagaaagaaaggcgtctcttggtggcgtggcgggccgcgcagctgctgcactccaactctccaagagagaaggaatcgcgacttcgccgccgcggccgcaacaccgacttcgccggcggcggcggcgatgggcaacgcgcaggcttccgcctcctccaccagctccccccgcttctccatggcgtccaggtagtaccccctgggcatcgagagagccttccccgttctcgcagcagccacttcaattccccttactcgattctcccctcgcgatctcactcgctctcgctgtctcgtctcgccgcgcagggccttctcgaggcaggagctggacgacctccgcgcgctgttcgtctcgctggcggcgcagtcgcagaccggcggccgtgccatctcccgccccgtcttcctcgtgagcacaccaccacgcgtccgttaccgttgaatcgaggttctggatctgggaattccagtttacggaatctgacacgcgctgttgatcttcgctcgcaggagtatttcgggatacgtggggcgctcggggatcggctgttccagctggtggcgagggagagcggcgggggtgagggggtcaccttcgaggactttgatcgtctccaaagtgagttggtgcctttctttctcctacttctcaattcattcggtccgttttgttgttcaattaggtgttgcaagtgtgagttttagtggattggacaaatttattagggcattcttgcttgatttcttagtgctaggagctctttgcgttcaaagacaaatgtgcttcgtgccatatattgttcgaagtttagctagaatttattagagaaattcgataatttgacacttttctgttacaaatttgctttaatttacatttgtgcggatgacatgtgtgaccatctgggtgaatgaaagtggcccaggatgtcaaataattgaagcccattttaagaagtgccaaattatcaaatctctcaatttagagaattatgaactttcatctctttctttgcagttttttagctttgttgcatgcatgaaattgttagttcgacttgatatcatgtttcattaacagtgtcagtgtactagagccttggattctgtccaaaatggcaaacactacagcaatggaaattgttttgcttaaccatacttcatagggttttatctttgaaaccttctacctctatataaatttagtccatgaggtgatgtagtttatgtaattatttcttgatttatcaacacaaatgtctctacccagtgttctagcgtaaaatggatatatgccatattttttatggataccaagtgctttcaaacattttatttttattttttttcttgttaggtaatgttttctttgtacaatctaccatgtaggcaacatacgagagaggaactcgagatgaagttgatgaattcatttatcaactatgtgatgttacaggagatgaagtcttagaaaggtactgtcgactgttctcgtatagactggtcttctcatggtgtgtactgtctataaatttgttgcactcttctgatccaaattaatttatgtgacaagaatttcttctttgaagtattctatcaaatacttagatttattttgtgttaggttttattattagctcttctgtttttttatgatccgtttactcttcttctttttatgaatggtcattttacatttgcctttgctgtcctggattgccaggtctgatctggaaactatcttggcatctattcgtgaaaccatattttcagaaaataaggaagctggggaaggctcaaacaagaggacatttgaagcatttatcaactctgcagtattttcgaaggatgctgaaggagtcgcaaggaagtctatgtcgctatcagactttaggagctggtgcattctcattccatccttgaggaagttccttggaagtttgttgatgcctcctgattcaggtctgtttttccattctgtgtattccctacagcagcaatttgaaaagaagtgtctttactgcatttttaatagactcgactgcatagtctaattaatttgtatgatcaagtatgataattgtgttaatcggactagcattatgtttatctcatacacatattattcctcatttttagaatttaccctgttccaacttccaaccccactcaaatggtgagtgtagcttttgtgcagactacagatggtgtttaggggataagcctctctttcacaagtcctgcaataggaatttctacgtccctcacatgtaattatgtgtataggcaggacaaaagattagaagaaccccgagaccatagaaatcaaagagtgttaagacatcattttctcttacttctattctgtctatttctcaaacatgcattgtttccggtcatgcttggaatggacatgtactaggcctgttttagggtacatatacatctggaattacataacctgcatacttttattatcggttgagggagattaacaatggacgtgttgccaagaggtcatgcattgagacgtcacagcgcatagctaacttgacagaggcttagggatttcctgtgaacatcccaatctcacaataacaaaggaagctaaaatggatcaacattcaatctaccatccagtttagtaagtaagaaacctgtggttgattcaatattttcatgtgtacaacaaagccaagtcctgcaggtgaaatgaatatgcgagttaacatagatctttttcacttcatttggtaattgggcagtttctagtgggcatgaatgactgaatgagtctgaatggtgtcaactgggcacatggtgttggcatgattgcaccagtctgctggaacaagatggacagttggtgtagactgtaggctgcctgtagagggccttcatcttagaacattccaccgttattcaaagtgaacctttgatcaaaatcaccacaatgcttgttattcctcattgatatgatcctactgtacccttgcttgtaccttttgaaacagtgtctctattggttaatttgcatgcgatctttgattatgctatacctttttttagtgtttaagcagtctaaaacaattcttcatgaaaatatgtgaactctgaaaagaccatatctaacctggatatgtatggtgtatcatgagcatgatttgtgttattctgtaggcagaccaggcttccaagtaccagcgcttcattacctagaaaacatctccccagatttgctacttttaaataaagagtatgcttggcatattggaggtggtttttcacaacaggaggtgcaagaatggaggcttctatatcacagttctcttcatggacaaagcttcaacactttcttaggcaatgtaacgtgagtactcttaaatattggtgattccaactactctgtttgatataatatacccatttcaagactatctaattctaaataaaaactacacctacaaactaaatgtcatgataatcctttcgcttggtctatcatatctgatataccatcatgattttccagtacgtgaataatccctgggaatgtttgtcattttataggaatggagatgcacagactgttatcatcattgaagatactgatggatttgtttttggtggatacgcatcacatccttgggaaaggcacagtgatttttatggtgatatgaaaacattcctgttcaagttatatcctgaagcatccattttccgccctacaggagggaacagaaacctccaatgggtatgctctgttcaatttcatgctctcatatgtatctatgctcggcatgtcaaatttaaaggagtaaaccttatgtatttttttccagtgtgccgtgaacttcagctctgactccattccaaatggcattggctttggagggcagccgcatcacttcggttttttcctatccgcaaattttgatcaagggcactcatttacatgtaccacattcaccagtcctgccctttcaaagacaaataggttcaggccagaggtaattgaatgttggggcatacaaacgaagggggcacttgatgaaaaggcagagcttgtcaaggggac

SEQ ID NO: 70831 - DNA, 7251 bp, Oryza sativa
caagagaaaaaggggacatgacaaactccgaaacaacgaacggcataatgggcatcgatgacagcatagcctgacaatcactgcacttgcgaaagtacatgtacatctatgtatatatatgcctgtaaatagtagataacatttttggcatgtccaggatctaccatatagggctggggctaagtaaattatgtgctgggccaaattattattggaccaggagatattgatttgtccattaatttcttcttcaatgggcacacggattgtaccagtgcagggtaagctatccgactcagaaaatgaaattacgatgtacattcatcatctgcatgtagagccacagccaaaatttaaatttcaaaacttgatttttagagtaaaattcaaagtttatttttcagcgtggacttttaaaccttaaaaaaaaacttttgctcataaattactttttagtagcttagttcacttctccatggccgtaggtccagcaaattttaaaaatccgtttctacacagaatttccacagccaaaatttaaaatttaaaacttgatttttagagtaaaatttgaagtttttttatcgtagtttatttttcagcgtggacttttaaaccttaaaaataaaacttttgctcataaattatttttatagtagcttagttcacttttccattgccgtaggtccacaacaaattttaaaaatccgtttctgtacagaatttttcgaccatataataattgttcacctacagttccgaatactgtagcatatcactaatctcactaaattctcgttaaaatctcatctacgtatgtcaaatatttgtgagcgccagaatttgaaccctaatgggtgaaatcatgcaactatgattccaccacatcattgtgtttcccccgcaatcccttttcgtttgttctttccaccgaaaatatatttcaggagcacatcatgtagatctcagattaaccaataatatgacctagatctggcttgaattactatgtgatgtggggccacataattctacaatgaagatgctcgaggttcaattatgccatattcgggcaaagatcaaattactcctatttcattttgatatgttcaactaacagagcgtgaattatcaaacatatctgaatagatcacaataatttagatatctgaacatagcaaaccataattacatgtatctaaacacatctgtgttccacatgaccagcacatctcatttcgggaatacaacaaagtgtacaaaatgctgccgaatttgaaccatgcaatctcctcatgcaaaccgaaggagatatatcaacttatcatgaatcaaggaccaccaatcaggagggcataatgtgcacaagaaagctctctacagatgacatcctaaccatatttgtgaagaatttgcagtgcatgtgagattcgtgatagaaagatactttgcatattggccactttgaaagggacaacacctaagaagatcactacatgctagacctaaacatatgtacattgaccaccgatattatttgtgccagcatatcgcgtgaagttttgtattgcacaataataactcatcaaagcttagtacactagttcttctctcagaaccaacaaggccacgttatcaataaaaactcatgtagctagagccagggccacggccagcccctgagctgatcactcagtccgatctgatcagacccaactctcttcaatcatcactgaaacatgcatatgccccccattaataacaagatggacccaaacacagaactctcaaggaaaatagaacatgtatacttatgctcctttcacatgtagtctcatctaactactttacagtagacgcgtttccattatctatgtgcctgtatggcagggtccagcttcagtttcacctctcttagagttgaagccaactaaatggtttcaggttcataaaaaaaaaggagtgaagtagactagtgatctaaaaatgaactagaggagtgggttagggttcaggacgctccatagctctactccgaacttcgcttttggagttagattttggagttggagccttaacaaacatatcgtgcaactaaagcatttcatcttgccattaatcttgatataattttatgcatgatttcttcccatatgttaattcttcataatctaaccaatttatgcattattccttctgtcttcaaatacttgttacaatgggtactattcatcttcaaactgtcttatttgaaggaaatgaatagatatttagagtgtgttatatcctaaatataatcatgaactttcatacatcatgatctaaccaggggcggagctagaacgaaaagaagagagatgccactcgcttgctttactctattttagactgatataagtacatgagtttagattgagggggtgcatatatggtgaaaataattaactatagcttaaaaaaatttcttgaccgagttcttgggcaccccctctcctacctagctccgcccctagatctaaccataaaaaaatattaatggtagggagtacaattcaccccatacttgggccctgtttagttcacaccaaacttcccccaaactcccaactttccatcacatcacattacatccaaaactttcctactcacataaactttcaactttttttccaaactaccaactttccccaaacttctccccaatttcaaaaactaaacacagccttgcttcagccagagtcggggcagaatcccaaatgctcagaatgcctacctacacattgcaaaacacatgcagatgatcagatggtgggttgagtggcatgcagagtttggagcaccagcaccttccaccaccttggtccctactaattaagttccctcctctgatatatctcatccctatctccatcaataactgtacgctttattccattttttttcatctactccatgagtgacaagatgatgaggatgatcaaagcatatagatagcatcatggcaatttgcaaaacattataccggtacttccaccacactcaaaatagaacaacttctaacctttaaaatttgtttcaaaatacaacttctccacttatatacattctcttatcaatcaatcataacattttaccattaaaattctctaaatatctctctcttcaacaaatcataattttcaccaatttaatttcatcaacttttttaatagtcttgtttaaccctaaaactacttagaagtatattttaagatggaggtagcagtagtagataccagtgtggcttgcaaggacagaattgggtaaagtgcatgctaggggaccagggcccatggagggcctgcctgacaaggcgatctgcatcggcaaaagcctagctagagtccagagagagagtggaggcccacttggagatggtgacgtcaccaggcatgcacacgaggttcaggtgtcaccggacaaggggacccacctgcaggtgacgagaatcattgatcatcacgctagctagctccccgctgctgctggtccgaggcttcacccaaactacgtcactctagctctagctagatcgatcatcgatcagctcaaggaaagagatgaaagaaggggggtaatgtagcagtggttgatccgtggatcagtctgcattcaggttactgattgggcagcagcagagagagagaagcagcagtacaagaacggtgtgacgcacgtacccgatgcatgcatccagctgacaagatccaacgaggcgtgtatcgtgcatcagcatgcacagtggttagcctggtggtagtactttcttcgtttcaaaataaacaaatttaatatgaaatataacatatgctagcattgtatgttcgtagctttagaatccatcacatctcttactaggttagttcctctccaagaagaaaatccactataaaatggtactacattcgtcccaaaacaagtgcagttgtggatatccgtgtccaacgtttgaccgtccgtcttatttgaaaaatttatgaaaaaattaaaaaaattagtcacacataaagtactattcatgttttatcagtttctaataagagtcaaacgttgaacgcgaatagtgtaaaactgcacttattttaggacggatggagtagagtactactagatcggatcaacatagttagttcacacaataatatattactatatttgttttcagaagtaatatctctatctttaagtgtaacttgtttagattcgtaatagtagaatgtatataatacaatcttatgtttgacggaggaagcagtaaacaaagaagccacaagaggtaagcttatacgtaccgtagtgactgaggtggacaattaatcaccgtttccagcggcattatgcattgcaaagctgtgacgatcattcgcgcgctgtgcaaagtgtgtaccccagcagcatgcgagaaacttgatggcgttttgctccgaggtccacatgtacagtagagatcggggacctcatccatcaccttcacatcacccctgtgtgtggcccgcgcgcgtggaggagagcgctgagctaggctggaccgccggccggctagccggggacccctgcctccggctcgccggcgcggcggcacgtggacaccggcgcccggccccagccagttacagcacgcgcgcctgcaacctgcatgcctcctcctcctcgtcttcgtcgtcgacaacccgcctaacaacggcagcagcaggggaccagagagagatatatgtgagatcaattcatcaatggaggagtctagctaagcaaacataatgcagcttgattaggccccgtttgggtttgctcaagatgataaagtacggggcacgcagaaggagaaaaccactaacacgtgattaattaagtttttattattattattttaaacttgagaaatggatttgtgtgatattttaaaggaaaaagtacgaattaccccctgaacaattgtggtcggccgaattacacccctaaacttgaaaactggacattttacaccctcaattatcgaaaccggacaaataacccccctaaacactgttttgagtggttttgactagaaattacacacgtggcgccaatgtggcaatccagtcagcaaaacaaaataaaaaaactccctgagcccacttgtcggactaattcctcaacccaatcccttccgtccggctctctcttgcgcatgcgctcggacaaggaagccgtcagcggaggcggcaggcagccggcggtggaggcggacctcgcccgtgcagtgggtggtggaggcataccgagcagccggcggcggaggcgggcctcgtccgggcagcggtcggcggagacgaacccggcagcaagcggcggaggtggacctcgcctgggtagccagcggcggaggcgggcctcgcacgggcggatggtggcggaggcgaacctggcagccggcggcggatgcgggcctcgcttgggcgactggtggcggagacgaacccggcagccagcggcggaggcggacctcgcccgggcagctggtggcggaggcgaacctggcagctggcggcggaagcgggcctcgcctgggcggctggtggcggaggcgaacccgacagccgatggcggaggcgactaacgcggagctcgggctgcaggccggtgcgggacgagggtgacggcgatggggccaaggcggcggtcctgatggcaacgacgaatgggctcctcctcttatgctcttctctctctctcctcttcacgcgcgccgcggcgccggcacggcccatgtgggcgctgctccagctctcgaagatggatcattcggggtgttgtcgcagccggcgcgtcgctccacgccgactatccgccatgcatctcctacctcaccttcgccgccagattcgtcgacccccgcccctgccacgacaccgagtccgagatactcggcacggtctccaccgacatccacgccacgagcggtgacggcctcgtccttgtctgcttctgtgactcccgcaaccacgtccccaccgtcgggagccgcggcggcgagctgatgcgcgagtggtccgcgaggaggcagtcacgcgagcgggacagtgccggcgcctggtcggcctctgcctccatcgtcggccgccactgcctcaaccaccggttgccccggcgagcttctcctcagccgcctgccgcccgggcgagctccgcctccgccgtcgaccggctggtccaccttcgcctgcagagccgcctgcctgagcgtgcacgcgggagagagaaagagagcgaccggggaggcggggagagagaggggtatgaccggttgtaggatcgaaatgtcgactagagggggggtgaataggcgatttaaaactaaatgacacataatcaaaactaacctaagttgctaggcttggtgagggtgaactctaactaagcaactaagttatgttttgcaaacctagggtgatagtggctcaattatatctctaggaaagtaaatcacactcctatgtcaatgtttagcaatcctaggataatatgatctcaagtatgtctctagaaatgtaaattgcacaaatgtaaatgcgacaatcaaatgagacaaggagacgagatttttcaccgaggttcggaaactcgccggtttcctactccccgttgaggcgagcccaactctaccgctcaaccacgaagccaccgcacgcccccttcgtcaaagggtggacaaggcgggagccggcccacggagaggactacccaagcctcgatcactagggtagttcttccttcactccgaaggtggtgaactccaaaccactcacaaaccggcgccgggcctcctccacaatcttctcggagaggtcaccgggcaactcctccacaagccgtctaggaggcggcaacctccaagagtaacaagcaatgacccggcgtggagatgatcaatcaagtgccacactaactctacaatggaagcaaatgcacttgactcttggctagatcaaatctctaacacactagatggatgaacacaaagcttaagtgggtgtgagagaggtgtaaggggtgtatgcaattgaattgggtgccaagagagtccccttgctgctggtgggggagtatttatactcccacccaccaaaactagccgttgggggcgaaatcccccaatcattgtgctctgccggtctgaccggaggtatgtggccggtcagactgtgctattctgcaacggatagaaaactagcc

SEQ ID NO: 70832 - DNA, 9692 bp, Oryza sativa
gagattattgattttgatattgggagattattggcaaagtggttttggagatgattgaatttttaggtgatgaacaggagattgctgacagtgtggactggtcagaccgggcagtggttgccggtcacatcggctgtacgtgtgcagtcagaccagccagcccgcggtctgaccaggccacattgtgttaatttcggttttaggttgtttctttggatatctagtggataaatcatgtttatgacttctagatggatactttgcgtatgtaatactgttgtgtgctaacaatgagttaagttggagagagcttgtgcttggatatggtttctttgttgatgcatgtgtaggtgagtcttgatgccttgggagagcgttgccggtgatggatgatgagtcaacttgggagaagatgacatccgaatgatcaggatatcatgcgggatgctaggctaaaaatcaataaatgtgcgtatgggatgcagagttgaatttggagggagaccgaattcggtacaattacagtttgtaagtttgtttcttgtacgggaaggtttccttcgggattaggagttattgtataaggttggttaattcgatgctttaggctacctacctagggtatgaatagtgagggaggcctcccggtatcgtttttgagagagttgagtttagagaaaagttagggtttagagtttcattgagatttttgtgaggagtgttgttgttgcattttgaaaacacagagagaagtaataaattttcaatctatttcgagagatcttcgatttgtatttgctcgggttctgcggtccaaccggcgggacacatgccatcagactggcaggaatacgatggtcagaccggtggcaacgacaggtgacagcggtgtgttaggcggtcagaccgaagctactacactgctcagaccgaaggtcatcgagcggtcggttcggcgcatctactctagtcgaaccgatcgccatcgaattgatacaacttttaattccgccaaaagttttgctttttagtactacaaccattcacctcctttggttggcttggtatttactgttcaatcctacaagtggtatcggaaccttgttttttccattagatttttatcgatctagagttttagccatggctaacatgcttacaactaagccacatgttttcgatggattggattttccttattggtgtgaaaagacgatggaatcttacattatggctcaagattacgatatttggaaaaatcttgctaatgctgatgagattcctgatcaaattaatattgttgctttaaagattgagtttgaatataattgtaaagcatgtaatatttttctcagtggaatttctcgttttgactttggttgtgtttctcatcctcaaactactcgtgagatttggattgttttacctaactttcatcaaggtacttcaaatatcaaggaacttcataaagatcttttcaaaaatgattacataaaatttgcgatgaaacctggtgagactttggatgattatcttgctagatttaacaaagttttgagtaatcttaaatctattgatacatcttatgatactaattactcacaatatgaggtttctcgttactttttaaatggccttgatatttctatttggtagatgaaagttatatctattcaggagtctattgatatgtctactttgattttagattcactttacactaaacttaaaacccatgagaggaatattcttttttgtaaagttgactttaaatctagtgttttggtttctccttcgacttccttggatattggtgcttcttcgtcaaattctaccgctcttgcttctataaatgtcatatccgatgatcaacacgagcaactcgaggaggacttggctttggctattgttggtatttattacgagcacaaaataatctacaggcgcacatataccgttgtagctttcacccaacagtattccagggtattgtatccacaggaaacgtgtgtgaacaatctaataacagaattcatccaatgacaacaattaaatagtaggccaaagatagagatgattcctatgggttaattatctaaattaagtttaggtaaaactctatcaatcgctttcggcacaggtttacccctagtctaccaaggagactctggcctacaactctatgttgtacttgaacatggaggattacaaaggatggacagggttatcaccacctgctgtctacctctacaacccgtgtagcacacagcaaataaaggtaacctctagcttagacatcatgtccacgctattaattactaccctaatctcggatccacatagaagattaaggtactctacctaagagtgatgaacccgtaatgatgagaatatatcttgcataaataataaaagtaaataccaaggagatcacaaatacttatcatctccagccctcctccggaacacccctggatgaatgtcgacatctccggtgctcctccgaaccaccccctcccccgagagaacttcgacatttgacacactcctttcagagcttccccacactcccttccaatattctaattctactagagagtagcctaaatgtataagtgagttgtactccacttgttgtgttgtgccttgagagtaaatggagaactcattttataagacaactatgacggttactagggcgataaccatccacaaccatcattgggagagcatcgtagtcccccacgtggcagcagatggcgaggggagccgatgtcagttcagctgaactaggagttcgatcgacccttggatctaacatcttcagtcgcgtagacctgaatgcactcctagggtcggtgggaacctccctaccaaagttgggcctaagaggccacaatggtggttcgatcgaactcctagataggttgttttcagccgcactggtctaaatggcctcctggggtcggtgggaacctccctgccaaggttgagcccgaaaggccacaacagtggtttggctgaaccatttttggcccttctcggccaccccttttgtcaggtcactgtccagtgggcccccatgacagtgcacgagggttttgctacggtttgtgggccctccaaatccatgtactcgcgtctgattagccggaggtttgttttattgcatggcggatggttttcgtccataattcacctacatacaaatattcagcaagacttgtgaaaatggtcagtaataaccactatctctaagtttgatattccattttatattctttcatttgtttttatgcgtgcattgattattggatttgctacttaaggaccgtcaacaacacctcacacttatcctttactcatctttgagtaaagctcatggatataaaaaatagagcaaggacttcctgatctcctatttcctgtactctctcctctttttctacagtttgtatgtttgctgctgtgggagggagattcacttcacacgcagtaggatggatgcgtgcgtgcatgtgcaatgcatgtgaaagagcatgtagcctagtgattgcagtgacctgagtagcggtcgtgagttcaaatcttcataggctaagtttctaatttaaaaatgttgtatatatcggtcgtatttgaacataaagaccgataaaaaaaattactcttctctaaaaaaataaaaaaagtaatgcttaggcaagcggggtggggggtgagtgcctgtttggttgatgccctcgttagcatgccggagaaatttgcatgcgtgataggcatataagatgcggataaattgcctggccaggcagcctgacaccttgcttgtttggttgtgcacctctgcctgggaggaaaaaaaacatgattaggatctagattggatctgctaactcacatactagttgaatgacaaatcttggctttttaccgcccctccaaagaattcaacgtaatacccagttttttttaacaacttgcatacatcaataagaaaaaaagaacagaaaaacacatgaaaaaattaatccccaaatccacgcatctatcataaccttcaacgattcctcccagctagttgccaattgattcaatgaaacaaaccgttgaagccttcagtgtcttgcatccggcgtgggcgtgtggctttagcgcatgcttctgtgaaatcattgtcatgattaatatttgtgatgaacaattggctattcaaatgatttaatcaaagaattggtttgagagtttgtgtgaatgttggtatgagtgcgtgtgactaatgtgggtcaggttgtgatatctgtgtccagaaacggttgttttgtctgattgtgtgcaggtgacttgaggtcagccctagtcaatggtgaggaccgggactatgctcagggaggagcagaggtctattgcggtcgggataccatgtgagaaggtgactagagtctggactcttggaggtcaactttggtcaacggtggggatcgggactagactcaaggaggagttgaggtccagacagtcaaggataccgggtgacgaagttggatacaagatggcatacggtggatagacatcgtgtgggagagatcttcgcaatgggcttcatgaggtatgcgtgcaagtgccggtattcgcgaagggaattgtaaagttggagtagtatatggtgctacagtacacgaggtactgtagcatgcaggtatgcatgcatgtacggtgctgtgcatgtatgtgtgatcgatacatgcatggtgaagcatgtatgtgtgcatgaatggttggccgagcagcaggagagcggctcggtgggcctcggtggctgttggcggcatgccaagtcggcccaggagaagcaagggcccagctggcagcgagtcggagacggtcacgcgtggacgtcagcttgggagcgaatccgttttagatttctggtgcggccggttgtttgctgcacgtttggaaattgtaaaacgtatggaaactgaaggatggagtcctattgtgtataggagttctacacctactttgagtaggggatttttgtggtataaatagagagggagcgtgaggtttcctgtatcgctttagagagcaatagagttgagttttggttttgggtttcgagtttagtcgaaatttttgtaaggagtgctgttgttgcagtttgtaaacacagagagaagtaataaagtcgtcatccactttaagagttcttagatttgtgtttcaccgggtttcggcggtctaaccggcaactcaccggtggtcagaccggcggcattgcggcggtcagaccggcgggagcgaggcggtcagaccggcggcggcgacaggtgcggcaagcgacttcggcggtcagaccggagattcaacaccggtcagaccggcggcatccacttggtcagaccggcagatcaatctcggtcagaccgacttccgtcaatttcgagggtaacttttatttccgctaaaagttttcgatttttgggtataccatccattcaccccccccccctctggttggcttagttcttgtggttcgatcctacaagtggtatcagagccttgttttcttctttggatttttattgatctagagtttttgccatggctagtccctctaggttttcaactaagcctcatgttttcgatggaacggatttttctcattggtgtagtaggatgcaatcttacattatggctgaagattatgatatttggagaaaagtttctcatgcttatgtgattcctgaagctattaatactgctgctgaaaaaactgcttttgaacaaaattgcaaagctcgcaacattcttttgagcggtatttctcgttcggattatgatcgtgttgctcatcttcaaactgctcatgagatttgggttgctttgagtaattttcatcaaggaacaaataacattaaagagcttcgtcgagatctttttaaaaaggagtacattaaatttgagatgaaacctggagaagcttttgatgactatctttataggtttaataaaattttgagtgatcttagatctgttgattcttcttatgatgctaattatccacaatctgagatttctcgtcactttttgaatggtctcgacatatctatttgggagatgaaagttacatctattcaggagtctgttaacatgtctactttaactttggattcactttatacaaaattgaaaacacatgagatgaatgttctttctcgaaaagttgattctaagtcgaatgctttgatttcttcttcttcctctttggatgttgatgcttcttcatctaagtcgtcttttcttgctgtttttaatgccacatccgatgatcaactcgaacaaatcgaggaggaggatttggctttagttgctaacagaattgctcgagctatgaataatgccaggaacaggaaaagaggtggtccaaatcgttgctttgagtgtggttcaattgatcatcttcgttcgcattgtcctaagcttgggagaggcaaaagagaagacaaagatggtgagaagaccaacaacaataagtccaacaacaacaagtcaaagggttcataccaagggaggaagatggagaatcttaggaaggcttttcaacaagtttgcgccgccttcgagccactaagtgatgtagatggtgaaagtggagatgatgataagggaaataacgtctccgatgtttgcttcatggcgcgtggtgaatctgacatagagtatgaagataatgaggtgaatgcttttgaggaagctattaatattttgagtgcaaaaaataaaaagtgtgagaagatgtataaaaaacaggaatttatcattgaatctcttaaatctgaaattgataggttaaaatctcttattcctaatgatgatgattgcgaaaattgtgagattttaatgaatgagatttcaaaaattagagatgttaatgctgcacatgatttgaaaaatagatcttctcttgcttgtagttttgctttgcacacacgcactttggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagttgaaattgaaagatgctttaggtcgtgttgagtacatggaagatgttgtgaaaaacaatgaagtgctttcttgccctaaatgtcgtaaaaacaaaggtgtcatgatagattgtgaaaattgtgctaatttggaaaaagtggtttcttatttgaaaaatttttgctaaggttttctgattgtaaaaagaacctcaacatgattttggatcaatcaaaggttagtacacataaccatggtttaggttttaatccttatgctcataattctagacatcctcctgttgtgttaggtgctgatgctacaagtggtgagattttggttaaacctgatactaacaaaactgtgtttaaatctgctggtatcatgtctactatgagtgcatcttcttcaaaatccaatgttgtgcatgtaaaatctcctgttgttgctcatgttgctaaatctactagtgctaccaatgtgtctaatcatcgtgaaaattatacttgttctttttgtggcaaagatggagatattgttggtttttgtttcagattagctcataaacagaaaaaggagagagagattgcttttgcaaaatcaaagtggcaaaaatctggttttccctcgaggaaaccgatcagaccgcagtgggtcccgcggtcagaccggctgaacagcctcggtcagaccgaccaccggtcagaccggtggtgaagcctcggttagaccggcccccagtcagaccggccactgtacctcggtcagaccggcctcggaggaatttttctgaaaattctaaaattgattttgcacatggatatatgcctattgaatcttctggtcgtgtgtctcagtactggattcctaaatttttattatcatctaaccccagtactgaggcttcgacttctgcttgtgtgtaggctttggtggcaaggagaacgtgtagatcatggattccggttgttcgcggcacatgaccggtgataaaaattggctctcctccctaaagaaggcatctaagactgaatcgattatctttggcgatgctgctacaagtgccgttctcgctacaggtatggttaaggtaaatgaaaaatttgaattgaagaatgtagctttggttgaggacttaaagtacaatttactttcagtttcacaaattgttgatgaaaattttgaagttcactttaagaaaactggaagtaaagtttttgattcttgtggtgattctgtgttgaatatttctcgctatggaagagtgtttaaagctgattttgaaaatcctgtttcacctgtgataacatgtttggttgttaagtttgataaagatgtgatgttttggcatcgtagacttggacatgttggttttgatcatctcactaggttaagtggtttggatcttgttcgtggtttgcctaaacttaagaaagatcttgatttggtttgtacaccgtgtcgtcatgctaagatggtttctacttcacatgctcctattgtttctgtgatgacggatgcaccgggacaactattacatatggacactattggtccggatagagtgcaatctgttggaggaaagtggtatgtgttggttatagttgatgatttttctcgatattcttgggttttctttatagcaactaaggatgaagcttttcaacacttttgtggtttgtttcttcgattggatcttgaatttcctggttcttgaaaagaattcgaaatgataatggtggagagtttaaaaatgcttcttttgaacaattttgcaacgaaagaggccttgaacatgaattttcttctcctcgtgttcctcaacaaaacggtgttgttgaaagaaaaaattgtgttttggttgagatggctagaacgatgttggatgaatataaaactcctagaaaattttaggctgaggcaattaacactgcttgttatatttcaaatcgggttttcctgagatctaaacttggaaaaacttcttatgaacttcaatttggacatcaacccaaagtttcacatttgcgtgtttttggttacaagtgctttgtcttgaaatctggaaatttggattattttgaggcacgttctactgatggattgtttcttggttaccccgcacacactcgtggctatcgtgtacttattttggggactaacaaaattgttgagacttgcgaagtttcttttgatgaggctagtccaggtactagactcgatattgcaggtacactgtcacaggttcagggggaggatggtcgtatttttgaagatgagagcgacgacgactacgacgacgaggttggctcggccggtcagaccgggcgccaggccggtcagaccgccggcacacctccggtcagaccggctcatgaggagcggttagaccggccagggtcgtcgggttccggtactgttgatgctgatcgagatagacctccagagattactacttcgactagtactgatacagaacgtggatcaacttcagaagtggctactcctttgcacatttaacgacgacatccaccggaacaaattattggtaatattggtgagcgg

SEQ ID NO: 70833 - DNA, 10249 bp, Oryza sativa
  unsure (1)..(10249): unsure at all n locations
tcccccccccccccccccccaccactacagtctacacaacacaccggcgcaccggagaaaagcgcgaggcaactaggcaagccagccacgcatgtagccggccgccaggcctgacacatggctggctgcccagctaggcgcggcggaccactggctaacggatggtcgcgtcctggcgatatcccactactctgacgatatggcacagtcacaggacactgtcccgccgcagttacacgtaccgatctgctctacacggagtactgatctgcagtccagccggactgtgggcgcgttaaagtaggccgagtttagttcccaaactttaaaatccaaaaacgtcacatcaattttttttatccacacaaactttcaatttttacgtcccatcgtttcaatttcaatcaaacttctatttttagcgtgtaattaaacacatccgtagtgtatagagaacacagtaccccgttacaggatcgggatctgtcctgcagttcgtactctgtagagattagagaacctactagcatcacatgagcagagcactggctacacacaccaaatttgttctgcacgccaagaaatctattgccgggcagtgaatgagactttcgccgcaccgcacgcaccgctcgtgtagtcgtgtgtgacagtgtgagcacgggtatcacaccagccggctatgccggctatacgcagtgctgtatagtggacgtcactgcgtcaaccatattcgaggcatttagcggagggcgacgtcgagacaggtggatgacccaacatgaccaacactccagcgccttctacgccgcacaagactttggagttgaatggcgctaattgctgcgaagtggagctcgggacctcttccagtttctagacaggtcacaagtactcatgatatagcggtggaatactcccgtgtacagttacttgtgtggcttccactcgcaggggatcgagcaagaactccgtgaagagttactgttagccagccgggtgcccgggcagcgggcaggcaccatgtggacgctacagtacgtaacatggttacagcgaccgggtttttactgaagcttttcttttcccttcttctctgtgactgattcgtctgataaaaggctactacttactagattttgtctcaacaacgaacttgcacttgcagtcttgcacatggcaagattcatgttcaagcaacaaaactacaaacgtgtgtcgttcgcaccaatgtttctgaggagataaaacgccggaatgcagcaggaggagcggagaacgcgtgagcgagagggataaactcgccacgaaacgtacgtaccgacggtgtcgccgagatggaacttcttggaggcggcccaggctgtgtagttggggctgcccatgatggtccacccggtcttgtcgcccacctcgtacacggccgccgccgccgtcgccgtccccgcccacatcaccaccaacgccgccgccgccgccaccgccacggccatggccgacgacaccctgctcgccgccgcaccaccacccatgaccgagagcgagaggagtagagagcgaagtgcaggttaggacagtggcgagagtggcacaaaccggccggttaaataaaagctccgcaacttttcgatcccctcgtggggtcgtggtcgtgtctcctcccgaaaatgcccccgcgccgcggccaagctttcctttcggcgtgtgtcatcgccacggtgtgtcagtcaccgcgcgagcgactcgtgggtaaatttctctcgccttttatcatcgcggcgccgactgcgtgtggtgtggcggtgtgggggcgtcggctgtttgttgccgcttgcaagcgttgaatcggttgtgcgaatgccgagattgccctcgggcctcggttgtgaacttgtgatgttggcgcagtatggcctgtagctgaggcgtgatccttactccgttgacaacgtacagcatacgggatctctcgctctttgttccagcaaagatttttgtactctactacctccgtcccaaaataagtgcagttttacactattcacgttcaacgtttgaccgtccgtcttatttgaaaaatttgtgaaaaaattaaaaacatttagtcacacataaagtactattcatgttttatcatctaataccaataaaaatantaatcataaaaaaatttcaaataanacgnacggtcaaacgttgaacatgaatagtgcaaaactgcacttattttgggacagagggagtactactttggtttgtcggattggatttaggccctctttgtttagggttataagccaacttataagtcgaaaagtctaaacctaaacaaacaagcagcttttccgtttggcttttttaaagccataagccactctaacactattaagccaaaagttaggttagagaagtttttttggtttatgtgaggtagatatatgactcaactactaaacttaggacattaaatccaccggcttataaatcatataagccaataagctgacttaaaagtctaggccaataagcctaagcctaaataaagagggccttaatgctcgagatatactaatactactccctttgtttcattttaattgacgctttggacaatgacacgctctacaagatatatctttaaccttatttttctattataatatatacaataaataaatgtatgtttacttttattatagtgttttgaaagacaaaattatatatgtttttctagtttctttatttttaaagttattggtggtcaaaattataaaagtttaacctcaaccttatccaaaacgtcaattaatatagaactagagtgagtactgtcactagagctatattttttttccttttctttattcgagagtttacttttttttttttttgaccagcgtccaaaccaactcactcgagtctaacgagtacgagagacctgatctgtgcggtcgtgaatccgtttgaaaccgagtctgatgcttgtcggtgctaaaacattcggcccaacttacttgggctaacttgaaacggcccattattgatcagttgggcccaagcccacgtgagtccccgacagcataaacccctcttctcgtccctctcctcccaacctcgcttccttatccacaccaatccgccactcccctccgcggcaacccccccgcgctccgccacagaagccgacgccgacgccgcgcgcgtacatgccgccgctccacgccgtctcccccgcggcggcggccgccccgccgcgcgcgctctcctccgccgcgcgcgtcccgcagcgcccaggtaggccgccccccttcctcactcctgctgctgctccgcgcgaggctttggccttggaacccactggaggccgccgaggcatatcgccatcctggaaaatgcgtgacgcctcgttggttgctgtggtttgggttgatcgtttcgctgcggtcgtaactcgtaaccggcttgatgcttccgttgtttctccggttcgcagaataaggtggtttttgtggctatgaacaacggtgattgtatctgtaatagtatagcatctaacattaccgaacaatctcgttttggtagttggatatgcctttggttcaggatttcatggccagattaagtttaacgatatcagcaagacgaaatgcttcaaacttggtgggggtttacagtgtgttccccccaaagctgctggggtttatattttcacttagtaaatactactaaacatcagaaaataattgccactcgttagcccctaatgattttgacgcattctttaaaagactcgttctaatggggattgtctagcattcttgttggctgcccagaatccagacaactttggtggtgggtgttaagggcaattgggcaccctgagtgtctgccggtgaatgaaccatcattctaccaatggctctgcagcagtcgaataagaattcgagagcatcttcggcggggctttgacacggtagtcacgctcgtggcatggacaatttggaaagaaagaaatggccggatattcaatcagcaacaaaggacctgggtggacatcgtgaagggaatggcggcagaggccacgctatggcgtcaagcaaaccaagccatcccagctctgatctttaggagggaattttgtagccaaaacagaccgcgagacgtacacctttgatttcctgcttgtatcctgtctcagtcccatgctgctttgtatttgactgtaaataacttttattcctcttaatacaaaaatgcgctcctcgcgtattcctatatgcatggtctcaccagaggatgttgtgcttgacaggttgtgttccagaacgcccaaacattttaagctcctccacaaacttcatgagtctccgtgctggaccaatgcgcttctatagcaggcctcttattcttcaaaactcggacaagaggcaagctactttggatttaaatatttatcccactgatcgaccctccacattaagctttaataacttgtgattatcatgttatcagagcagtattgaggcatgccactattgaagaaattgaggcagaaaaatctgtcattgaagaccaagctgtaagtgcaatgcatcttctcactgaatgggtattttgccttccttttttgtgccttgggggctcactagctgcagatatgcatcttcagagagaaaggatggaaaaggcaattgaaacagtccaaaataacttcaatactgtgaggacagggcgggcaaacccagctatgcttgacaggattgaggtgtgaggacttagccttgttcctttttctgtttgtaagtaactcttgcatgatcacatcttttatcattacactcaatgcatactttatcattccatacacatgctactgttgtgtgcttttcttaactgaacctatgtctgggctggtatttattgtggctggctaataacaaacacaaacaaggaatgaaactattgctcaaataccatatgcagactgtttggataatttgatcgccttctgtaactaaaactagagcaaaggattttctttaggacagaaaattgtgaaaattgaacatcctattatgccttatgtgtgagaattttgttacaggttgagtattatggaactccagtgaacttgaagagcatcgcacagataaacactccagatgcaacttctctccttattcagccatatgacaaatcctcgtaagctgtttattattcccacttcagtgttggtattgagttttccatcaatagtgttgacacaatgacactcatgcggtgcagcctcaagctcattgagaaaacaatagttgctgcaaatctgggggttacaccaagcaatgatggagaagtgattcgagtcactgttccaccattgacttctgaccgcagaaaggtaatgctttagaatttcatctgtgtgaattatgtgtggttacttggtaattctgggtccataattccatatggaaaattttgtttggcaagtttgtacgttgcgttttcttgccatccaaaacattaaggattagctgagcagagctgtattgttcctgagaacaaaaaataaatgccttatgttcattgaagttacagtattttgaacttcaaaactttgcattcaaacccacatagacacctaatttgtgtttacaagtatgttaacataaacaaggccgatgttctatacaaaataaggtctctaaaatgtatgagatcaccaggtatcacctttactgatgtgggagtatttgtcttgcctcaaacaagaaaagtagaaattgctttggacatgccatgcacaaaagactagggtatttcataaaagacctttatgatggattatccagtaagctgtgatattattgaattgtatttgatgaattgatgtacaactttcttctatcttccataaacacaattgttatttagtatacaaccgtagcgatcaatctacaccattaaatctaaacctaccatgatcgacagcataaatttttctattttccccgaaaaatgtgtttatttctaggacttgagagcccccttttgccttctcttagtactaatataatacatgtagttggttgaattgcggtctgctatagctttcaaacaggttcaataatattcatagatgttttccattgattataaaattcctgccactttcttatccatcttagattcaatctgttttggcaggaattggcaaaaactgttgctaaattagctgaagaaggcaaggtactcttaagcttcacctttcactgttttttactgaaacattctttttacatttttattgtgatttaatgtttttatgcctcaattttccagcctattatttttcttgtgcacccatactagtatgattagtacagcactttagcggtctgattgactctgctaacctgcatttggcatggtgctggtactgcttgtatggagtaatgtagtgcgaacaatagtcgatgtaccgtagcatctggccagggaagacatgaggaagacttcgtcttcttcagcaggaatatctatttccctaattgattaaattaccttcctagtttaaggatttgctatcttgcatctgccagttcagaaagccctcttttttgtaataatggcattgtgatcgttttcattaagcaatatataatctataaacagctagttccatatatttcccctgtactaatctaacagcctcatttcttccttggcgagtaaagtgccctgccagcgccagcagcaagatgatggcgggtggcctgccctcattagctattactgtgcacataacagccatattagtttagtaatactgaatgaatgtatatctgaattttttttatgatgcatcagttgaccagatacttagcacttcttcaagtccatttctgctgcatcttctatgtgtattagttaggaaggtggagcatagtatgagctgtagtggaagaggctttcacaaaaattgtttgccatgcaccctttgctcttggtgctgcacaaatttcaggagtaccatatgattgttgctttgttggttatttatccaatttcttcaaaaggctgaagcacattgatagttttcagaagatgcttttactttatagaaaatatgcttgcttcttttttgacgcctatgtgctgccttctcattgttgagtagcttatacacacaaattttcactgactgataacatattcatctccttgtggattctatgtaatatcgattattaatatgactaacttcttttacaggttgctataaggaacataagaagagatgccatcaaagcttacgataagcttgagaaggtcacccntctcagttaataatactattttgtgggtgctattgtacctcgcttttttgcagtgaaattaactgctttcacatgcttacataggaaaagaaactttctgaagataacgtgaaggatttgtccgctgatctacaagtaaggattccttgcctttccttcacgtggtttagtgaggttcccatgtcctttcggaatctcatctattagatacaggtatgcaacatgaactgacatcgtgtacaaattatgcagaaagttactgacgagtacatgaaaaagatcgaagctatccaaaagcagaaggaacaggtaatttggccctttcattggtctttcttcagacaagatattccttcatgttggacacaattgcatgccccaaggataaatggcttgtctgaaactagtatcagcattgctatcctgtaatcctttaatcctccagaaccataggaattgactcgggcttgtttgatattttcattttcaggaactcatgaaaatttagacaccaggttttaatcttgaaattggtgagttcatcttcctgcgaagtagatgaagccgaagaaaacaatgtcctcagctaacacggtgaattatgcggtcacagatttcttgagccttttccatctttctgatggccggcattttgccggatgcatctttttgggctggagtgcaatttcagacaatgttgccgtgtccttcattttcatttttgtaattattgtgtgtactccgtgtaaaagtaggtcttgaccttatccttgttctaccgctacattgtcaatattcctcacgtgaattaaaatgctacagttgtgaatttatcgccacgcactctgaagcatcaactactggtgccatattgccagttatctccatgttcagtggatctcagttttgtcagcagtcaccgacatctggaccttcgcacattactctatgtcatcgcacggactgacggacaatagcaaaaaggccatttttctttcttaaacacgcatgccttcatttacacgcgcgtactgtacactcataaattcattcctatcagcacacagtatatttctctaagcacatactagtatgaaaactgaaccgatatgttgagttgatgaagttattactataaacgtttcacatcatctactattgagaaaaataattagaaaaatcgtgaagttttgaactcaaggttttctcaatggatacctttgaaaattgtttcaacctctaaccaaaacagccaagaaatatatcactaaaaattaatacccatccacataaatatgaagggcgccccaattagaatcaaaggaaatagagaaatttctcgtaataagatcagttataaataagagcacatgtgttaaggtctagaacttgaagctggaggggtagaatcattcgtaagaaacttttttttaagtaaagtgcatggttagcacctaaacttgttcatctgtgttacttttaactagagtagttacctaaactcccaaaatgtatttttacatcaccaaacttgttaagtgtgtcattctggtccaaaataaccacaacaccttcgggatcttacatagcgctgacgtcgcatgccacatgacatttattattattattattattattattcctttttctctcttcttccttcctgtttgtatggcaaaagaaaggagaaggtagaggagaaggaaaaaaataaaaaaaatgtggttgaaatatccaggtaatatgccacgttagcgccatcgtcaccacatagtatcctagaggtgtcgtggcaatttggaattggattgacattctttaacaaatcacaaacctaaaatcacaaacctaaaaatatattgagagttaaaaaacttatataacgcatgaaataaatttaggaactggtcgtacacttttttattattatttctgaaaaacctcggtgagtgagattagatcagttttttttagtttattcgaagattatagatgagttaatgcgcctgtaaacctcagatgtggttggaaaggatgttttgttttgacacgaccaggaaccaaccggctatacccggtcaaggcctcccataggccaatagtccgatccactacacagcgtgtgtcactgcagcaccggtgtcgagtcgacacgtttcacgccgacaacgaccagcctgcgataattacggacaccgatgccgctcctgcagtacgctgggggcccctctgaccccgctggataccctgctagagtgggcaggtcactgggcccacggcccaccaccaggtgggcctgggagcagagcaagtgggccccagcaggttacagtactccacggagtgattgtaactgtacccagcactagatggattaggggatgatggtgtgaggttagcaactgttctgttcttggtcactactgtagtactaatccatcagttattacagtatcatgagaacaatgcatgatgtctctgtccaaattgtctttttcttttaaacgagagggccgcattactgtttatccaggatctaaaatatcaaagcaacaatgaaatcgagcagattacatgaactttcatcctttttaaaaaaaaatgatcctttttagaaattcctttttatagataggttctcaacgtcagttttattggctctaacctctctagtacatctcaactgttagggtgtgagcgttagcatcattagcgccgagaagttaggcctcgagcccattcttgaaattagctttttcatcagcaatccaattagacaaaaaaaaagatcatcgggacaaggagcaaaacatttgcggattgcggcatgcaaaccaagcaatctaacaacccagcagtaacgaaactcgtgcaagaaaaaacccaaagccaaaggcaagacttggggg

SEQ ID NO: 70834 - DNA, 3350 bp, Oryza sativa
ctaattgcacagattgcgactaatttgcgagatgaatcttttaagcctaattgctccatgatttgataatgtggtgctacagtaaacatttgctaatgacagattaattaggcttaataaattcgcctcgctatttactgccggattctataattagttttttctattagtgtccgaatatcccatacgacaccctttataatactcgatctgacacaccaaaactttacaccttggatctacacaccccctcaatgtgcatgcatgcacagagaaaacaatagcagaaaacttctagggattagtagtgactacgaggaccaggagttgtacacgcaacagcagggggtgaaggaattggggacaaaaatttgcatcaccccattcatgaggttattggaaattggagaagggggatctctgcgcaggtccaatcttgatcctatttcccatttcaatgttagaatattttgacgtttgggaacttggagcccccggcaacaccaaggcagaacaggtaacgccaaggtcacgtgagataataataatcatgtatttgctccaattttcctggagctagttaggccagggtagaagaaaacataatgtttagatgatactggtatttgacatatgatctggatgggtgatgttgtgcttattgcacataagaagcaaattatataattaatggagccattacctattaggagatccctttaacaccgttatgattggattctggacaaaaaaacgccccatcttgggccctccggtttctccaaaggctgacaaactgaataatacttggccattagtatacatcagtgagcacacaatgtatctgaccatgtgatggaatacttgtctccaaagaagcaagcaaagcgacattgctgattttatcgttaatattttacagaatctgatacagatctgtcgttaaaaaaaatataaagaacagatcatattatgttctgtattccaatcctccagcagcaagaggtgcccccccaaaatgccctaatgaaatgataaagaaccaccactgatcttacttattactattaaggttatcatccacacaagaagaagcagagtaatgaccgatggctttactcccacgcaagcacacacactccttacaagtggaattgtgtgtgtcctgagcagggtaggttgtcctagggcaaaggtttgaatggaaacaatatcttacagccaattcaattcattgtgtgagaatccaaccaaaaccagcttgtaacttgcaagtcttgtcctcttaaggggtggtcagcacacattcaatgagacaggcctcctgacaaaaccccttgattgtgttgaatctgagatcaaagaaatggctggttgctagtagtaggagtactctactccatggctgtgcatgataattagagcacacagcccatacacctcaaatgtcacatctctcacaagaggcctctaccctgaacaagttattgcctactccctctgtccaaaaataaggcaaactatgggttttcgtgtccaactttgactgtccgtcttatataaatttttttataatttgtatttttattgttgttagatgataaaaaatgattaatattttatgcgtgacttgtctttttaatttttttcataattttttcaaataagacggacagtcaaacgttagacacggaaaccaaggtttgtctttttttgggatggagggagtacaccagctatttcaagtggaccacaaatataaactgctgccaatctatcaatccaccccttttagctagtaaatctatactaaaattccatgtctttctccacaggttaaattgcaatgcaacaagaacaagcctcctcattcattcagttccaaatgaacagtgggatagacttgggttccttacccaggacttccaaagccaaatcgaaatttggtgccctgcagcaacacaccaggaagctaaaggaacctggacctctacaagttaaaatggggagttaaggacagtggtcatacatgcatatgcataggcccccaaccacccatgcacatggaaagcaatggtagggtctacccccctggatggctgtgattaggccacaatggccaggcaccaacttttaagtaccaccacctgatcattcctcatcacctacactcagactatatattctaacctcaccacctttgaaccccccttcactttgattcttcctgtctacctaggttaaaaaaactccccatctctctctctctctctctctctctagagatctagcagtaatacatgcatacaccaaaagaacctcatgtactagtagcaaatatcaatacataaagctctacacttctactactagtatagttggaaggctataaatgcctagccatgatatgtgcatggttctctacacaacacaccatcatcatcttcatctcctacctcctctcctctcctctcctcttctccactacccaacttttgctcccaacacatctttgtttcgatcgaccgatcgatcagctctagctcagccgcagcaatggccatgcaccctctcgcccaggggcacccccaggcgtggccatggggtgtagccatgtacaccaacctgcactaccaccaccactacgagagggagcacctgttcgagaagccgctgacgccgagcgacgtcggcaagctcaacaggctggtgatccccaagcagcacgccgagaggtacttcccgctcggcggcggcgactccggtgagaagggcctcctcctctccttcgaggacgagtccggcaagccatggcggttccgctactcctactggaccagcagccagagctacgtgctcaccaagggctggagccgctacgtcaaggagaagcgcctcgacgccggcgacgtcgtccacttcgagcgcgtccgcggcctcggcgccgccgaccgcctcttcatcggctgcaggcgccgcggcgagagcgcgcccgcgccgccgcccgccgttcgcgtcacgccgcagccgcctgccctcaacggcggcgagcagcagccgtggagcccaatgtgttacagcacgtcgggctcgtcctacgaccctaccagccctgccaattcatatgcctaccatcgctccgtagaccaagatcacagcgacatactacacgcaggtaactaactaaacacgcaattgcatatctagtagtagaaactcaagaacaaattaattaagcactttgatactataattaacatgcaactacagcaagtgattaaagatcatatacctttcgcggtggaacaatttgcaggagagtcgcagagagaagcagacgccaagagcag

SEQ ID NO: 70835 - DNA, 3587 bp, Oryza sativa
ctatggccaagagtggtcaactcctccatcccgcaatcttcggttacatgcgactaacaactcagtacactcaagcataggctacatcatctatggtagcatcatctttctttgatttgctagcaagctaagggactttgtgcaaattaacctttacgacttggtgtgcatataaccgttgctgtgccaactcttttgaacacatattgttttaccactacatatcttcccccaagtaaatgatgcaatacatattttgaatggcgctcatgctggcatttggactcattagagagactcattgatgagattttccgttatcacttagccatgcttacactgttctcagactcttatagtcattctatagctgaaggagttcaactctttcatcttgtagtattccgttactcgtgacccacaactcactatactcaagtgtaggctatgatggaaaaggaggcctcttcactcgaaacagtagcatattttccttttggttgttcgcaaactagtgcataggaggggatctcgccttggacaattagatagatagttaggttagtcattcgagccattgtatcctccaccatcaccacacaaggtggtggtataccttgtttgtcaacatggtgtatatatataaccgttggtatgccaacttatctatacacatattgttttaccactatgtatctttccgtagtaaatgattcaatcacctataaatgaacgacactcttgttggaagttcttgctgggatttgggcacattagagagacgctttgatgagatttttcgttaccacttagccgctccaaccccattatcaacctccttaatcgaacgatgtcctagagctcaactcttccgcagtcttcagttacatgaggctaataactcacttcattgaagtgtaggctacgtcacctaaggtaagcatcatcttcctttaatattctagcaagttggtgacctttgtgcaaattaacttgtacacatagttgtgaaccgtcttccctttcgctgatctcaagcatttgggtttatttcctcggagtgaacatttgatgtcattgtcccttgattgatacctcatatatcttggtgacagtcaatgggaggagggggggggtcccatcttgtaggtttagtcattgaagccattatattgcaatctccaccgtcatatgtggctttgcttgtaatgtagctaaataattacctgaagtaggttgtggtgaagaggagaagctaggacatgagttctgctctatttggttgatggctttcaagtgccccaagagggtccttatataggggttcagtaggtggagaggtcaatgcttctcttaattcggtgttgatgcaatgcaaaataacaaggctccattcatcccctcccccctctctctctcttatgtcattcatttcctagttttgttctctctatatcttgtgattaattctaagattaatagacatatatctgcacataggggtgaaaacggtcacggaaaatcctgatcgaccgatgctccttttcagtttttaccggccgagcaatgtgcagatggtcaccaacgaaaacaaaaataggaatggtaaaaaaacatatggaaatttaaacggaaacatttttgctgcataccgaacgtttctgactttatcgtgttcgtacggtaattacttttttatactatgtaattatcgtagttctaaatacactaatatttatgatatatttctttaattgacccatggtttagagagacccgtcgatttcttaaccagacccttaacttgagtacaaggttaaaaggatataatttggaaccttgaatttatattatcatattatatacttttgcaaagctaaatgtgctattgtacagtttaatattttcgatatttattatcggcttctgattgataccgacatgtttccatccgtattgtccctttccagtttttcgatatttcctgtattgttttcatttatgtctttaccatttttgaaaaaatggttttggaaatggttgagatgttttccgaccgttttcatccttatctgcgcattacaatgatctatataagttggctgtgtcatcctctcatggatgtagatgctgggttttttaatccattaattaacaaaaatgtatcatacgtacattctaaatttgaaacaattaatatagtttttttcagatgaactttgattcatgaacaattctaatacaaatcatgtatgcaaatgatatactacctttctttttcaacttgacatttttgaacattgacacatcaatctctgatacatatatttgattattattttaccgtatcatatttatcaaaagaaaattattaaaaatataactatacttcaagacaaatctagtaatttcacatttcaaactcaataatttcatgcattaatgactacagattttggtgtttaaatgcatatatattgtaggatgtcatctgtcctaaatacaaactgtcatctaaattgtaaagtatgaattttatgctattaagttaagacactttccaatattagtgagccacaaaccagtctcatatgaatatatttgatcattactttatcatatcatatatttctcgaaaggataatattaaatatatagccacacctcacgacaaatctagtaatgtcacttttttactcaataattttgggcattaatgatataagatttcgatgtttgaacgtgtatattgtaggacgccatgtgttctaagtaaaaactgtcctctgaaatgtaaaacatgaatcctgtgatatgaactttaagacactttccagttatattgatgagccccaatccagcctcagatgaatacatttgatcattggtttatcatatcatatatttatcgataggaaattattagaaatataactacacagcaggacgaatctactaacatcactttccctctatttttcgtttatataccaactatatctttctttcaacatcacctatttctctattgatcaaatataggcggatgttttggtgaaagccattgggaggtggtcccaccttgtagtaaattttatagaaatacatattttatggtcaaagttgcaaaaaaccacacacactttgacattggttacttaactacatatattttagattgaagtttcacaaaactacaccatcaatgaacgggcccacctgcaagatgacgtgtctgttccacctaggatgtggacttgggagctttatcctaggtggaacactcataatgccacgccagcatcctaaatatatgtagataagtaaccatgtcacctcatgagtggacccattcgttgattgcgtagttttgtgaaactttaataccagaatatatataggtaagtgtcaagtgtcaaaatgtgtatgttttttttttgcaacttgaaccacgttggtgcagttttatgaaatttactcttcttttttaacttgatatttttttacaatgacacatgagtctctgatacatatatttgcccattattataccatatcatataatatgaaaaggaaattacgggtgc

SEQ ID NO: 70836 - DNA, 12155 bp, Oryza sativa
tgcttcttttgaacccaaagatgtgtcacatgcattaactgatgaatcgtggattaacgccatgcatgaagaacttgaaaattttgagagaaacaaagtttggactttagttgaaccaccttctggacataatattattggaaccaagtaggttttcaaaaataaacaaaatgaggatggtttgattgtgagaaataaagctagacttgttgctcaaggttttactctagttgagggtttggattttgatgaaatttttgctcctgttgctagaattgaggcaattagacttttgttggcttttactgcttcaaaaggttttaaattgtatcaaatggatgtgaaaagtgcttttctaaatggttttatacaggaggaagtttatgtcaaataaccaccaggttttgaaaatcctgattttcccaatcatgtttttaaattgtctaaagctttgtatggtttgaaacaaggtcataggacatggtatgataggcttaagaactttttgcttgcgaaaggttttacaatgggaaaagttgacaaaacgctttttgttcttaagcatggtgataatcaacttttcgttcagatttatgtggatgatatcatctttggttgtttgactcatgctttggttgtagattttgctgagactatgcgcagggaattagagatgagcatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaagctattgatcaaaaggagtatagaagtatgattggttctttgttgtatctaactgcttctaggccagacatacaatttgctgtgtgcttgtgtgcgcgctttcaagcttctcctcgtgcttcacatcgtcaagcgatcaagcgaataatgaggtatttgaatcatacacttgagtttggaatttggtattctacttcatcttctatatgcttaagtggatattccgatgctaattttggaggttgtagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatctactttgaaagattatggtcttacttttgagaaaatacctctcttttgtgataatactagtgctatcaatattgctaagaatcctgttcaacactcacgcacaaagcacattaatattcgttttcactttttgagggatcatgttgagaagggagatgttgaattgcagtttttggacagaaagttgcaaattgctgatattttcactaaacctttggattctaatcgctttgcttttcttcgtggtgaattggaaataattcatccttttggcatggtttgacagggagtttgtacctcatggttttatcaagcaacaatatgacaatgagaaaaattaagaaaagagagctttatttatgcatatggtattttcttgtgcatgctaccaatactttgaaggtttatttatctctagcatagcttgtatgtattctagtcttttcatgagatttagattttgcttttaagggatgatgcatgacatctaaattctacttgaattaagaaaatatgcaatgttgatgctagcatatggtttgttttataaatgctctatatatatgctttattgacttgttattcctcaaatagctttaattgctcattgtgaaatagagaataaaaatatgaaaaaaatgaataccgaatccttggaaacagtcttgacgacgaggacgtattcgatgtgagcaaaataatgggtgccgaatccctggaaacagtcttgacgacaggcacgtacccggaataaaaagagaaaaaatatgagcaaaaaggctcaagataagaaaagttcaaaaattctcttggttattttgtgctcaaggttatttgagaaagagtgataaatgcaataggtatatgtgtttagtgtttattcttcaacctatgtgcttgttaagatgttgcattataaatcgtctgaaatcatgaatttttgattgttgattcaagcttaattgtaaaatgtttggttcatggttatactttaatgcaatgcatgcttgttatattatatatgggtttatcttctttttattgcaacacatgacttgatatgctatatgtatgctaatctcttgaatattaatgaacataattcctatgcttgatgaaatcattgtcaaaagggggagaagtaattgtgaaaatttttgtgcaaatttttggagaagcaaggtgaaattttggagaagttgttgagaagagcatgtttttagttcaattgggaatttctttcttttaaaaagggggagaagttttcttttggatttttgagcacgatgtgtacatttgtacgaagtgtgcttttaccactttcgtttttatttttccaaacaccaaaacattttttataagtttgccaatgtgttcatcaagggggagattgtgaaatcattgtcatgattaatatctgtgatgaacaattggctatgcaaatgatttaatcaaagaattggtttgagagtttgtgtgaatattggtgtgagtgcatgtgactaatgtgggtcaggttgtgatatctgtgcccagaaacagttgttttgtctgattgtgtgcaggtgacttgaggtcagccttggtcaatggtaaggaccgagactatgctcacggaggagcagaggtctattgcggtcgggataccatgtgagaaggtgactagagtctggattcttggaggtcaactttggtcaacggtggggattgggactagactcagggaggagttgaggtccagacggtcaaggataccgggtgacgaagttggatacaagatggcatacggtggatggatatcgtgtgggagagatcttcgcaacgggcttcatgaggtgtgtgtgcaagtaccggtattcgcgaagggaattgtaaagttggggtagtatatggtgctacagtacacgaggtactgtagcctgcaggtatgcatgcatgtacggtgctgtacaggtatgtgtgatcgatacatgcatggtgaagcatgtatgtgtgcatgactggttggccgagcagcacgagagcggctcggtgggcttcggtggctgttggcggcatgccaagtcggcctaggagaagcaagggtccagctggcagcgagtcggagatggtcacgcgtggacgtcagcttgggagcgaatccgttttggatttctggtgcggccagttgtttgctgcacgtttggaaattgtaaaacgtatggaaactgaaggatggagtcctattgtgtattattgtgtataggagttttacacctactttgagtaggggatttttgtggtataaatagagagggagcgtgatgcttcctgtatcgctttagagagcaatagagttgagttttggtttagggtttcaagttttgtcaaaatttttgtaaggagtgctgttgttgcactttgtaaacacagagagaagtaataaagtcgtcatccactttaagagttcttcgatttgtgtttcaccgggtttcggccgtctaaccggcaactcaccggtggtcagaccggcggcattgcggcggtcagaccggcgggagcgaggcggtcagactggcggcggcgacaggtgtggaaagcgactttggcagtcagaccggagattcaacaccggtcagaccggcggcatccactcggtcagaccggtagatcaatctcggtcagaccgacttccgtcgatttcgagggtaacttttatttccgctaaaaattttcggtttttgggtataacaactattcacccttctctggttggcttagtttttgtgattcgatcctacagcttccttcacatgcttcattccgacgactacagcaaggaagcaaagcagcaggatgaagggatctggcgaaggcagatgattcacatacaaaaatgatggtggcgagatggcggcggcttcgacttctcgggatagctacagcgagaacaacggcagtagcttctcgagacagctgcggcggctgcccgcacggcaacaacgcggcggcggctgctcgcgacggctgcggcgacaacgcctgcagcagctttgtctggcgacggcttcgtgcacgcgtgcagtcgaatggaatcccctcgttcttcctgcgtggaagacggattacagtagcaaactgaaatcgtggatgcgcccggaccttagccgaccaattatctatctatctatcgatctatacttatacttatactaattggacactttctacgagctctcacgttatagaaaaaactatccgtctattaaaggaatcatgtaatcatagccgtacatcttatatccaatctggtttaacactgtgggccaccttttaatggccatctaatgtacgtaacgtcgtcgccgatcgtatctctaacgaaagaagagacggggattctatcgcgatcacacctgcgaccatctgggaaaacttttatcagcgatggtacgtagatcgatgctccagtcgtccttcatggcttcatcgttattgctgtaatggatttagagatcactgcaacgttgtgaattgttggtagatcaattaggttcgcaccctttttttctttcgtagtaattttcttcaactcaatctatctggtaaatcgatctccgtcacatgtgcaaacgaaagcaaaatgatcagaatctaaagaggtggcctgatagcaggtttgcaggccgcggcaggcagtaatgaccccaacgatgaggcaggcatgtaccttccgttttcttattctgatactaattcgctctccttccgtcagcatcattatttcatttgaaattttttggtaagcattatttcattttattttattatatctagaaaaatcaattaattggtgaatggttattgcacaagtatgttcatgatctttatttttttatgattttttttatcaatttgccacattaaattctttcactattatcgatcgtaatatactatactagattagctatatgtatatgcgcacattctttttcctggaacaaccttgcaccatagccattgtcagttgtgttgtgagataatttttttgaatactacggattaggtgtttaaattattaattattcgagtaaacacatgcaattttttctggtgtctctttggctaaactatctatttgtacatttaactaggctccctgaaagttagcaaatattgttatagccttccggtgactatggagttcaattataaagatttacatccataaaaaagttgatgccatgtacaattaaaaaaaattcaaatcgataaaaaataattaaatgcaattgaatacattaaaacaaaattacatattaggtacaacttatctattacaatttctagactcataatttaataattatataaaacacaaataatgaaattagaaaaaggactcagttgggtgtgtttgccatagcttcggcttcagctccatctctcctgaagttagagtccaatcaagcttcactaaaaatgggattggagctggttgaagtagtctaacaaaatgaactagcgacataaagctgggttttcgcaactccactcctgacttaactcctgaagataaatttaggaattgaagccctaccaatagacccttatcaattctaaatctaaataattcttaaaacatgggaatgccataatttagactacacattttacaattattaatttttaatttggagctgttaatcgaaccaacagttttgttcttaaatacttacaaagtaggttccatacatttactaccgactctttagttcctttccaaaatttaatagtttctaatttcataattaagaaatatggttctatttcatactttcaactaagtaatttcatcgtaaattaatatcagcatgtagccatcaatgcaaagcaacttttttaccaagtctttacaatttataagatattttatatatatggttaaaatttaatatttatgtcatgtcaaccatagcccgtgtaacaaacgggttagcgactagtccaggctaatgacacgcgggaggacatctggccaggcattggagtacatctggccaggcatgggagcaagagctccaggaaggtgtgacatcccggctcagggcttaataaaattattagaatactcatattaacaagtaccaaccaaacagaccctaatagcacgatattattttctcccaccggccgatccgcagagagtattctccatgttacgtgtattagtattttgttcgtcaattcctattttattcacgtgatgcatgatatttgactgtttatctacagaggcccgcgatacaatgtacatacatacatataatcaaattcacctttcaacgtacggacatttctatttgtcataaaacaaaattgcaatgtcatcgataacccgaccttagctcagttggtagagcggaggactgtagtttgatgcggattaatccttaggtcgctggttcgaatccggcaggtcggaagtttatttctttattttttttgttgtgcgaattattttatgtacctcacgaaaagaaaaaagcaagctatttttgtaatatttttcctgcacttcttttcgtgacatgacttttaagagcaagcccagtgtgtttggctgcttcgctgctgtagcagatattcgcaattgcttcgacactcattttggaagagccgatttgactctcctcgatagactaggatttgcttgcccaaacctcattgccaaataaatacgccttttctttttctaaccaaacaagaataatgattattcgtcaccatctgatgattaattattcttgtactttagttacacctatataaagctcaattcccatgacagtttttgtcttattttgttaacctccactgatccaatgcttaattaaaataagctttaccggtcaaataaatgattcataaatagaaagacatgacgattgaaaccagtgacacatcctgaaccttattaattttttattggatacatgtcatcataaattttacggtttaaaaatatgacattactattcatatatttagaattatgccattacaattttacataaattcaagatatgccactacatacctgttcatcgtattttctaatattttaggaccaaattgcccctatcctccttccactaatttcttgttccttccttcctactctctccagtggggcttggcgttcgtctcgctggcgattgagctcaacgtccccctcttcagtgctacttgtcgctttgtccacattcgcctcccactctccggcactaagagaacgacgaaatctacggccacgaggaggcacaagggcagtgagctcagaggcagggagatctagggcgacgggatcgtgacagggagacgcaggggcagcacgtgtccctctcgctagcggtggagcttggtgtccctctcactggtggcggagcttggttcttgttgtccctctcaccggtggcggagctaattggcgtccctctgtccggtgctcctcatcgctctgcccacatcctcctccctctctccatcgtgaagagtacgacgtggcctacggtggtgtggaggcacagtggcagcggagagacggggggtggtgggctcggcggcaagacatggtggggtggtgtgctcatcgaaggagagatgctggggcatgggctcctcctcctccccttgcctacagttgccatgacgatggggaccgtgttttccttgaaccagatcttacatgttgagaacgacaattgtgcactcaagttcctgtgccacttatgtgatggcaagcgaggggaggaggaggccgacgtaggtcaaaggtggaggtggaagaggtggctatggtggccagaaaaaaaatgcactgaaaaagatatggaaagaaaaaaaaacagaaaaaagaaaaaaaaaagaaaaccgtgcgccaaaaaaaaaaaaacccgcgtgtcgcctgcgttccccgctccgcgcgcgaaagtgtctagtggcacgtgtcctctaagtgcttaacacttgcaagttaaacatgaattgtattgattttgtgtttgtttgctgattaccagttgcaagttaaggattattgtattaaaaaatatgtgttgccactgctgaaaatgccaatgaaaatgcacttgtatgttttatgtacgagaatttacatcttactttgcttttaagcaacacacattactatgacaaaattcttcaattaatcttttaagctttgtaaagatgtacatttgtatattgcactatcacatcataaaggtactgcatgcgcagttgcagtgcaattagatatttcacattattgaaatatttactttgaagacaaataaatcttattgatggttctatgtccttacgagaaactggatactatgcaaacaactagaattgcaggtcgcatgtacattttaactgagcacaccttagctttacatagtgactacaatcgtgtgggataatattaggacaatgctgctggtagccttataactgtcctcagtcagggtaaactatattgacaattcactcagcaagcctaaacccataagctttgttgcttataaattttttatcctattacgtctttatattctaaactgaccacttttttgctggtttagtattcatagagttacatcacgtcattgtgtttgctagtgatgatctgaacgttccatgaaaaccatagggtactctttgtggcaatactattttggccacaggagcaccttcaaatgtttgggcgtcaataatgtgcacctgcaacatagaaacatgaaaaaaacaaattcaaattcaaatttgaatctgtgtgtcattcatacagaaaatggcgtgcgcatgtgatatgatgtaacaagcacttgcctgtgatgtattagacctctcgtcatgtacaaaagaaattatccacccatcatcttcgtgtgagccaccaactcttggaacaaatgctgctccagagaagaattgatcttctccaaacccgtgatattctgtctttattagatcttcagatgtctggttcatgacatgaatgcagtgagttaataatataagataaagattggttggagtactgtagcaagtccatttccaatgtacctctgcaattacattatctgcctcttcaagacaaagttttgcaaggcctccatatttcaggattactataaaatacagaaagaactatcaatcaaggtgtgatgcacaatcatatttcttgtgaaatatacttctaatccatgccatggacctccagatttgataaattacataaaaactgttttctttaactaatacctttctcattaacgccgtaagagctttccaaagaatccaccacttgtgcataggcataactatgatgcaagcctgtgtagtggtcattgatcacagggaattccatggaaaactcagttccacttaaatattgccctgaaacagcctttgtcttcgtgtttaatctccactggtataatcgagagaaaaattcttcattaattccttgtttcacagaacacttagaaggatcagagagcaaatcatttttgtttaggctgatccgagggcctggaatgatggagtcagccgcacgaaagcccctgataacaacctattttaccaagataaaaaaatgagattcatactggatatgcttggtaatgatggatagttgggtaaaatcagaattactatgctaatgcaactacaagtatatggaacaagctttacaaaactataaaaatactatacctcatcaccctcttcaaagcagttgataaaatggaacatgcagaatggttcaacgtcaaaccacataactgattctgcatcaccataacggggcataactcctattcttgcatagctgtccttctcaaacttgatcaacctgttccaggggattgcgttcttatggtttgcaggtttaagccaagaatctctttaataaaataaacttgagtgaaatacttactgattgcctctgataagtctactgatgtcgatggtaagaggtatgtccattattatgttgtacctgcattagtagaataaaatgtgtaaattgaacttttgctttactggagactgataattaagtagaatatgttgaaatagattgtagtttagtcattaaactacagcgaagaggctctgattggtacccggacatacttaacagtaactcctatgtcatggcagagtatacatctgtccagtttgaggtcaactttatgttttagttgagttccatcagctgtcatgaaataaaacttcaattggggtcaaactttaaatttaaccttgatagagaggacagaagtaaattctaactatacaattaaatacctgagacaactccgaccattaggaaaggcctctttgcatctgaaccaaaaatgactagctctcctgatccaggagcaacctacatccatttgaaccaagtgatttaaagcgatttaaatgataaaacaaaatagcactaaaacatgattttactcagaatgtgaagtcatgtgatgtatcatactttgcagttgttcataactatatatctatagtgtatgatgttcaaataaaaaaaatattctacattatttatttatatgtatttagttgtggtgagctcctcatatgtttgtctttgcagttaaatggcaaagatgtgccatatagcgaaaccacttgctattctgcaataggcttccatcctacgtgctacacatctcattgcgtgacaatatagtccataggcaataatgtgccatatttttggctcgataatcttcttattgaataaaatttccagagcacagatgtaattgaaacaatctgatgattctatttgaagtgcctgggcacctgactttgcacatgtgtttttccaataaccctatatatatctataaagtgtatcccactaagtgtgtagttaatgttaattctttcttctctcataaagccacataaccttaattatttttagcctttagatcattcattaagggtgcaaattgcatctcttctctctaaaagacatcatatttataacctttagataattgatcaatgtacaaaatatgtaagcatatgaaataaaatcgtatagtacgtaagaaaattttaccatatctcctattttaacacacaattcacccgcagcgttgctgcggggtacccatctagttatatcttctgcctataaatgcttcaattactgattcctattgctcatgtagcttacagaaaatgaccagccatacctttgggtgagctgtgaaaggccttttccattccccattaatgtcccagctatcacccgtgtcgagattctgaatgctgatttcctgaggcaggtggttctcagaaacagcatacacctttccagcatgctcaaatacattggtgttgctgatgttcttgttcactttgccaaacctcatctgcattgcatataatttatccatttcagattgtctgaaaaaaaataacatatagtttattaggcttgtgaagtgttatttttacatagttgagaatgtaggccgcgacgatggctgcagagtcgcccatgatggcagggaggaaacatggcttctgtctggttttctcaatctttaatgtttcagattgcacatatcgatttgcataggagactgaccaagtatctgaactgttctttgtgaagtagatggcatggagcatgccctcgccttcaacccatatttcgctggattttccgaagattgagacggtcgaatggagggctccaaacagtggattggaacctgttgagattttccaccattagcttattattatggtcagcaattctcatgtactgcacacagttatacttatttgttgatactgta

SEQ ID NO: 70837 - DNA, 1260 bp, Oryza sativa
ccaggacccatcaagatcatggcacttgaggcaatgagatttgctacaataacaaaagtttattttttttcatcttccattgaatcaaagcaaagagaggccagaaactaacctggatatattagtagttgaggacatgtgtgcattagccgcgggccacgtagaatagacatcacattgggtattagtttacatcaaccagcgacaagccaccacaaaaacaatcttcgaagttcgtacatcttaattaaaccaacaccattcctaataataaaggtgttgtatatatgctccccacgtccatcatgccgttcaaggctcttggtcatacacacatacatctgcatgatcctggcaaatataaaaacgtaagtacgtggcctcatggaaaggaacagagccacacggaataacataatgaggagcattagcatgtgtccccttatctagagttttatctgaatatacaattctccataagataccaaattcgttcatgtgcatggagaaacacaaacctgaattatcaaacgattgggcaggtgagctgcatgattgaagcttgtaggatgaagaacctgctgcgtggctccctagctccgatcctcattgccacctttaaatatgatgcacttggggcaacaattcacagccagtgcatgcatatgcactgtccagatgctatgccttgcctgcagatgggtaccagtttagtagttctgatctggtgtgttcctccactcttcaacagatacgtacacagctatacaactgaaagtacagtacactgcatcatttcttcttggtcaatgttttgacaatgatgcaattgtcaatgactatattatgtagtatatgtttaactaccatcagaatcagaggccctgtttcataattttcaggcaaatccttccactgagttttataagatgcaacgagattaatgcatgccctttctttattttcaagagtctagtatttcacaagagtagagacatgcatacatcagctgaagttcagaacatagtagtacaaggtacagacaacctatgaaacatgaactacgaaatttctcttttcgaagattaagaaagagtcgaaatatcttgaaataaataataagcataaccttctacatgatataagcataaccttaatgaattaactaacttctttttaaataaaaataaaaatagaaaatctggcctcttagcattctaaggctaaaaatctagtttaaagttaaaaaaaaccgtcttt

SEQ ID NO: 70838 - DNA, 13337 bp, Oryza sativa
ggaccgaatttctcggtcttggtcttttcgtttcggtctttttttgcccactcctacctcaaggaaatgctatggttgcaacgagtccgaacacttcatcgccgaaccctttgaaatgtaaaacacgaatcttgttatatgaacttaaggcaatttcctttcatatttgtgagccccaaatcaatctttgataatatacttgaccattactttatcatatcatatatttatcaaaaggaaattattaaaaaaaagctataactagacttcatgacaaatctactaatgttattttttgtgcacgataattttgtgcattgatgaattacgatttcaatgtttgaagcatatattttaggacgccacctattctactagtttattttgtgagagaactccaatcaactccagagtacgcaataactaaaacacgtcccttacaaagtaaaatttatactacgtgttatatgttttcaaacaactaataactttactaataggcttagtaggtgacaaatctactaatgtaattctttatactcaacaacttcgtgcattaatgacttaagatttagaaacttaaatgcatatattgtaagacgtcatatttagttataaatgcaaattaactctcttctcacaagtcaaagtggagatatttctcaaggaaatgctatgattgaaacgagcccgaacacttcatcgtcgattgcccgaaactctaccctctgaaatgtaaaacacgaatctttgttatatgaacttaaggcaattttctttcatatttgtgagccccaaatcaatctctgataagtgtacttgaccattactttatcatatcatatatttatcaaaaggaaattattaaaaaaagatataactaggtttcacgagaaatctactaatgtcattttttgtacacaataattttgtgcattgctgacttaagattttgatgtttgaatgcatatattgtaggacgtcatatgttctacatacaaactctccacattgaatgtaaatcacgaatcttgtaggatgaacttaagatattttcctatcatattgttgagccccaaatcaattcagataaatatatttgatcattactttatcctaccatatatttatcgaaagaaaattattaaaaatataactatgtaggattgaacaacaagaactaagccaaccagagaggggtgaatggttggatatcaccggccctatgcacctggtctgatcggtcccacacaaagaacaccacttctctctatttttccaactatatataccaactatatctttctttctatatcacctatttccatatcgatcaaatataggcggatgttttggtgaaggccattgggagggggtcccaccttgtaggtttagtcattcaaaccattatattgcaatctccaccatcctacacaaggtggtggttttgcttgtaacatcatatatagttgttggtgtgccaactcataaattcttactagtgataatgtttttatcactacataatcttcactcggttaagtctcaatctttcccaagtaaatgattcaatcacctcgaatgaaaggtaattttaccaaatgtagttgttagcatttggatgtgttcaacagatttattgttctgctttcctcttatcactgaactgtgccaacccttcttttagactcttagtcatactatagccaaaggaggtcaactcttccattgtgaatatttcgttacccatgactcacaactcactatattcaagtctaggttattatggcaaggaaggctcttcatttgaaatggtagcatatttgtctttgagttgtcaacaagccagtcaatgtgagggatcttgcgttgtacatttatataggtagttaggttattcatttgagttattgcattctccaccatcatcaccatcagtggcagagcttagtggagactaacatggatgatggtccccctagtatattggatgaaaaacttcatataggtagcacaagttactaacttcctttcatatgttggttactatacttgcctgtttcattccattggttttgggttcaactcctcccgaccccacccccccctcgttttttttctacagattgccctctaatgtgaaaaaaaatatgtctttaacactttcattgtttttctataaattgccatctaatgtgaaaaaatgcctttaacacttttaatattttcctctgtatattgccctcaaatgtgggggaaaatgctttcaacacttccaaaaaaaaaatctacagggtacgtgaaaaaaatgccattaacactttcaatatttttttctctatagattgcactctaatatgaaaaaaagagcttttaacacttcctatttttttaaactaatggtattgtttatgttatcggtactatcaataatacttaactttattctttttaccactgcatatgtttccccagtaaatgattcaatcacctataatgaattacgcccttactagaagttctcgatggaatttggatgcattagagagacatattgatgagattttccgttaccactaagccataccaaccccttttccaccctctgtaatcgtcctatggccaagaatggtcaactcctccatcctgcactctttagttacacgcgactaacaactgaatacattcaagcataggttacatcatatttctttgatttgctagcaagccaaggacctttgtgcaaattgacctttgtcgccttagcgtacatatatataaccgctggtatacctatattaaatggcgctcatgctcgcatttggacgcattagagagattcatttataagatttttcattatcactgagccatgccagccctattctcatactcttatattcatactatacctgaaggagttcaactcttccatcttgtagtattccattacccgtgacccacaattcactacactcaaacataggctatgatggcaaaggaggcccttcactcgaaacagtagcatgttttccttttggttgttcacaaactagtgcataggaggggatcttgccttggacatttagatagctagttaggttagtcattcgagccactgcattctccaccatcatcaccatacaaggtgaggtataccatgctcggttagtcaattccttaatgaacctatatgtttgtcgacttagtgtgcatatataaccattggtatgccaacttatctatacacatattgttttaccactatgtatctttccctagtaaatgattcaatcacctataatgagcgacactcttgttggaaattcttgctgggatatgggcgcattagagaaacgccttgatgagattttttgttaccacttagccgcaccaaccccattaccagcctccttaatcaaacaatgtcctagagaggtcaactcttccgcggtcttcaattacgtgaggctaataactcacttcattgaagtgtaggctacgtcacctaaggtaagcatcatcttcctttaatattctagcaagccgggaacctttgtgcaaattaacttgtacacatagggtcatttgatttatgttcttcttaaggccctacacataaaaaccatcctaggtcctctggtttgatccttgcataaagttccactgcacactacaccctccgtcacaaaaataagttcattggtgggtttttgtgttcaacgtttgaccgtccatcttatttgaaaattttatgaaaaaattaataaaaacaagtcatgcataaagcactattcatattttcacatctaataacaatcaaaatactaatcataaaaaaatttaaataagacggacggtcaaatgttacacataaagaaacccacaaatgaatttattttgggacgaatgattgtattttctggtccacagctgcacaggcttctgatttcttctggcctttgtagccttgatgcttaagctcagatcctgactgtttctgcagctggcatcaacatataattgggtaatgatgcccttgtttatgtctctccaatgcgtgtgtcggctgtgggctctgcagtggtcacccatgactgcacctgccagagatgcccccctccgctgttgccaacaatatctgtgacgtccactcgttctcagccgtcagatttcgatcagaccatcactttcttctcagccattacatgcacacactttcttctcacaaattacacacattacatgcacacacttttttctcacaaaattagaaaattacacacattacgtgcacacactttcttctcagccattaattaagtattaacaccaactgtcttgcaaattaattttctcaagaaaagggttgatcatcataggggcaaaatcaggtttaacaatcccggttttggttataaggggtatcctcggttttcacgccgttgttaaactgataaaatctgaataaatcttataaaaatattataatttagtttgatttcttttgaacttgaaataaaaacgaacgattcgtgttttcgaccctgtccaaaaagtctagattttgataaggttcacaatcccggttttggatataaggggtatcctcggttgtcacgccgttgttaaaccgataaaatccaaataaatcttataaaatattataatttagtttgatttctttcgaactttaaataaaaacgaacgattcgtgttttcgaccctgtccaaaaagtccagatttcatgaattccacggagatcgtaaaccctgcacaatattcactctactgtttttttttatcaaaagatagtgggggagtcccccatggttaaaatgttatataaataaaaaggagacagtttatgtacacactctactgttcttggtgcaagaacaggacaagaacagagtccaccattcacaaacaaatacacaagtactctctcttgactgaatcatcattgctgatatgcaatagagggaaaagtataatggtcactgtttgattagggacaatgatcaacttcttaacctaaagtcttatcttgcacttctttaatggaaaaggggggagggggggggagttacaacttactgctgctacaagaaccattaatccaccaccacataattaattccccccctactaaaacacacactcacacaccaacccataacaataaaaaccccaacataaggtgacacaaccatttttttggttttttatgatgaaaccaaagacattaaaagaggctctactactactataataatgatgaagaaatccggcatcgtccagtggatgatccaacggctgtcactcgtccactcatgcatggatcctgaggtaaccatccgtgtgagcatccactggacggacatggctggcggcaatggcggtctcctcctcgtcggcggcagcggcatcttcattttcttctcacaaaattagaaaattacacacattacatgcacacactttcttctcagccattaattaagtataacaacatctgttgcaaattaagtttctcaagagaaaggttgatcatccgaggtcccagttttggttataagagatatcttcggttttcacgccgttgttaaaccgatgaaattcaaataaaacttataaatatattattatttagtttgatttcttttgaatttaaaataaaaacaaacgattcatgttttcgaccctatccaaaaagtccagatttcgtggaatcgggagatcgggaatctagagatcgtaaaccctgcacaagattcctactgttcttggtgcaagaacaggacaagaacagagtccaccagtcacaaacagatacacaagtactctctcttgactgaatcatcattaatggtcactgtttgattagggacaatgatcaccttcttaatctaaagtcttatcttgcatttcttcaatgaaaaagggggagttacaacttactgctgctacaagaaccattaagccaccaccacgtaattaattcccccctactaaaacacacccacaccaacccataacaataaaacataaggtgacacaaccatttttttggttttttatgacgaaaccaaagacacttaaagaggctactactactataataatgatgaagaaatccggcaccgtccagtggatgatccaacggctgtcactcgtccacgcatgcatggatcctgatgaggtaaccatccgtgtgagcatccactggacggacatggccggcggcaatggtggcctcgtcggcggcggcgtcttcacttgcgctttccgccgcgcttcttgtcggcgtcggcgtcgacgacgacggcgtcctggttctgtagaaggtcgacaagggagggttgcttgcagttgatgcaggtcgggtagtccttcttggcgaccatgcagtacataaggcaacgggtgcaggcgccgatcaccatcggcgacttgtccccggggctaccgccggcggagctgcggccatccgacgacacgcacgacgtcgccgacgacgagtcgctgtcgtcgttgccgtccacctccatacccaccgccgacggcgacaggttcagctgcagctccaacctcgcccccctcgtgctccagacgccgccgccgccgttcccgttgctccggctcatgcttccctgattcacaaatcaagatcatacatgtaaatagaacaccattggtagatatacaaaaacgaaagaaaaaagagatcgattgtttttttgctcgtgaacaagaacagcgcacatcgatcaagatcgatctttgtttggtcatgaaaaagaagtgcatatcaagattgattttgctttttgtttttttgctcatgaacaagaagagtttatgaagaactagaagaacaagtcaatcaagaatcaaataacaaagttgctacctgaaggttgtggagaagagaggagaggagaggagaagagaaagaaatggacactgctctatttggttggtggctttcaagggccccaagagggttttatataggggagttcagcaggagaggtcaatgcttccctcactttggtgttaatgcaatgcgaaaattcatctcccccccttctctgcttccatatctttgtgattaattctatgaatactaaccagatatctgtgcatttacagttatctataatatctataataaattaagtataatatgttttaaacttgaaacaacattttttttcgagcgttgttgcggtacagcggtcggtaccagtaccgcccggtaccaaaatcctggccgttggatctgacccgatccaacggctggtagagtttgtactgggcggtaccaattctgtccctggtgcagtaccaagtggggaactgaggtggaagggcaaaaacgtaactttgtgtgcaatgagaacagactattaccctagaaatcccgatccgccgccgccgtgttcctcttccatgtcgtcgccgtgtttctcttccgctccagcgccgccatgttcctcttccgccccgccgtcgccgtgtctgccactgccgtgttcctccttcggcgccgcgagattggcctctgtattgtccgtgaaagcggaggcggaggcgaatgagccagcggcggagtatgcggttgcagcggctgaggagccgctccggtggtggcgccggagtaggccgtggctgaggcacgacgaaggaggaggcggcgggggagaaggcacacccattttctctcacgatccttcccttccctgattcaacggttggatgatttttggtaccacattctgctggacagtaaaaaatctcttttttttttcaattgaactttgatcataaataattctaatacaaatcagatatactacctttctttttagtaaattttatagaaatacatatttttatggttcaagttgcagaaaaccacacaaactttaacactgggtacttaactacatatattttatattgaagtttcacaaaactacaccatcaatgaacgggtccacctgcaagatgacgtgtctgttccacctaggatgcggacttgggagctttatcctagtggaacactcacgatgccacgccaacatcctaaatatatgtagataaagaaccatgtcatctcgtaagtggacccattcgttgattgtgtagttttgtgaaactttaataccagaatatatgtacttaagtgtcaagtgtaaaaatgtgtatgtttttctgcaacttgaaccccaaatgtgcagttttatgaaatttactctttcttttttaacttgatgtttttttaacaatgacacataagtctctgatacatatatttgcccattattttaccatttcatataatatgaaaaggaaattacaggtgcactaaaacacacccagagtacgcaataactaaacatgtcccttacatagtaaaatttttgctacgcgttatatgttttcaaacacataataactttactaataggtttaataggtgacaaatctactaatgtaattcttcatactcaataacttcatgcattaataacttaagatttagaaacttaaatgcatatattgtaagacgtcatattttgttataaatacaaactctcttctcacaagtcaaagtggagatattcgtcatggtaagggtgggcatttggtttgactgaaaatttcgttatgggtcttcggtctttaggtctttaaaaagtaaagtaaagactgaatttcaacgcaaaaatgtcaggaccaacaaattcggtctcagtcttggtccttgaccgaaattcaacaacattttcatatacgcaaagaaataatggaaattttcaacacaaaaatcacaaaaaaaatgtaagcacatatgagtaaagactcttactaggttgcatgcctagaagaagtagggatgtgaaaattagagtttaatcgtattaaacttagtggattgtaggttgcatttagacttttttttgttaattcggtttatttggttaatcgaggaaaataaccaaattgactgaacaaaattgggtctttcactacctagaaccaaattgatgaccgaatttctcagtctcgttctttttggttcagtctttttctgcccacccctacctcaaggaaatgctatgattgcaaagagctcgaacacttcatcgtcgattgcacgaaactctacctagtggagttgaaactgtttgattgggctccaattctaggagaggtagaaagctggagcgatgtcaaacaacccctcaatctccagtaaatatatttgatcattaatttatcgtatcatatatttatcatataatatgaaaaggaaattacaggtgctctaaaacacacgcagagtacgcaataactaaaacatgtcccttagatagtaaaatttatactacgtgttatatgttttcaaatacctaataaatttactaataggtttaataggtgacgacaaatctactaatgtaattcttcatactcaataacttcgtgcattaatggcttaagatttagaaacttaaatgcatatattgtaagacgtcatatttagttataaatacaaattaactctcttctcacaagtcgaagtggagatattcctcaaggaaatgctgtgattgcaacgagcccgaacacttcatcgccgattgctcgaaactctaccctctgaaatgtaaaacacgaatattgttatatgaacaggcaattttctttcgtatttatgagccccaaatcaatctccgataaatatacttgaccattattttatcatatcatttatttatcaaaggaaattattaaaaaagatataactagacttcacgacaaatctactaatgtcattttttgtacacaataattttgtgcattgatgacttacaatttcgatgtttgaagcatatattgtaggacgtcacctagtagtctactagttcattttgtgagagaactccaaccaactccactcccattttgagtggagttgaaaccatttgattgggctccaattctaggagaggtggaaagctggagctatgtcaaacaacccctcaatctccgataaatatatttgatcattaatttatcgtatcatatatttatcgataggaaattataaaaaatatagctatacctcaccacaaatccattaatgtcatcttttgtaccttgaataatttagggtattaatgacttaagattttgatgtttgaatgcatatattgtaggacgtcatatgttctacatacaaactccccacattgaaatgtaaatcatgaatcttataggatgaacttaagatattttcctatcatattgttgagccccaaatcagtctcagataaatatatttgagcattactttatcctaccatatatttatcgaaagacaactattaaaaatataactatgtaggatcgaacaacaagaactaagccaaccaaagaggggtgaatagttggatctcatcggccctatccacttggtctgatcggtaccacacaaagaacaccacttcgccaattatcatcaaatatcaaaaccaattatctatcatgctaattgttcatcatgaattaataaatcaaaacacactttgatttcacaaactaaaccttacgactaatgccatgttttttactccctctgtcccataatataacctagaaccggatgggacatttcatagtacaagaatctagataacctctcgtctagattcattgtgctatgaattatgaaatgtcttatacggtcttatgttgctatattatgggacggagagagtacttaattagtaagtgtaataatgacttaagatttcgatgtttgaatgcatcatctattctaagtatacaaactccctattgaaatgtaaaacatgaatcctgtgatacgaacttaagacactttcctgtcatattggtgagccccaaatcaacttgtcctgctggtgattgccccctctgcttatccaccatgctattgccaatacctgtgagtatgtttacaccatgcagcagttggcaatagctgtatgacagtgttaacatcttgaatgccctttatgaacagaatttatggccacagctgattctatctagcaaagtaaatgtgcatcaatgtgtcactggttatgtgaataaatagatcttaaataggagatgtgctactttaggtaaatagtgtctttaattgaacggcgaggtcgtacatatgtctttgcagcctctccttcaatgctctttacacttcaatgaagttataggaaactagcagcccattaacttcaatacttcatttgatgtttcacaaggtgcagcttgtgaaatgacatctcaccagcaagcttttagaaccctatcgcatctatgcttgatttcttttactgctttttagttggttatttttataaatgtaccgcttaaatttgctgatgtaattggggctctgctcgtttagtcaaagaggagtttattcttgccagtttgctctgacaacgaagctctatagcattctagggttgactccgagtgtatcttgcaggaaccaggacgagacaagcaacaataccagtactctgaataacttgtgctcacataatatagctccaaaaaatatgtatgtatgaaaaacctagatctcatttttaaagaacaagtaaaattaaaatcatacatattttaagtgaagtgtatctgacctaaaagttgtaaacatgagacatggaaattaaagattagtactttcaactttcaatcaccatcatcaggtaaaaataagaagcatctgcttatctgtagcatatatttaagctgaattaggctcatctcaaaggagggaaaaattacccattcccaagggatttaacagttccatgtgaaattcatgcttggttacttagagggatatcagtatcagactacttatatttctatcaaatgataattgtcctcaaacttagcagactcatccatggtggacatatgaggtgtcaaactcttgttcatgttatatatgcaatcttttcagtaagggaagttatatatgtaatctgacggtgtaagcattagatagaaaagaaggtaatagttatgttgttcacaaaaaagtttaaaaattgtgcacatgaaccttgataaccttatacatgaataaatataacagagaagagaatttttgttgtctaacggattaataatcagatatgcatataggatttgaccttattacatacataaacaggaagttctcaaagagacaaggtagtaattgttttgataatagaggagcactttacatggactgtgcaccaacagtagacgatcaacgaatgcaaccttatatgcattgtttccttttttttcttttgagcaaattctatgtacatatcttaacatcagggcaattgaatgatggtactcagtactcagtacccaggggatttgattactgtacagacaacatgtgcgatttaaacaagtatggactgttattgcacgtgccaacttgaattatatattcgatgaggattaggattttaatttaaaagtatattgtagaccatttattcatagattcagatatttcacaactaagacatgtttcaagatctgttctgctatgtgcaactaaggaaaaaaatgtgacatgccggattctgatgagtttcaaactgcagaatgaagttgcttgcaaactgatatgtaatgctcgaaataaaaaatcgacaagctaaaaataataataatcataccttcaggtctgatgatcaccagaactccagatgacaattatatgaaatctgtgacacaggtgagattactgatgttagctgaaagcctgaataaagctctgagtaagttgtgtaaatacgcacagatcaatgtacaacaaaaatatgtgaggatatatatcaaatatatattatctatttctctgtacttatcaattacttaaagtaaatagaaatttccaagaccataactaatcagatcattcaaaccccatggctgctgttgtcttgtggaaggagagaaataagagaagggtgatcacaagtgaggacaaatcagcatagcaggtggagcaagacaaagctaaatccttaacagaagatagaacaaacgatctacaagtggaagttgtgtatccaacgcgctgattttgttttgctactgacagaagaaaaattgccatttgttggattatgacatttcacactaaacagaatgtacaatatagcatgattggaatggaaccctaactgcacttccagtgtgctggtgcaatacagtctgttgaggtttatttatattaatttccagt

SEQ ID NO: 70839 - DNA, 676 bp, Oryza sativa
aggagaagaagggagagaaaaagaagaagggagaaaaaaaattccatgtcatcgtccacgtggcgtgccacgttggtaagaccacggtcaaacgagactttggaccgggatgatacaataaaccaagtttagggatctcgacgtacgttttacaagttcgtggacctaagtgaaacctcacgacaagtttaaggaccgctgctgtattttactctaaatttaatatcaatcatcatatttctaagtcctacatttcttctccagattttagtacttaagggaagggatgatgagccatagtaatttataaaaaaatacaaatcaaaacaattattaaacctatatccagaatatatcccggtagcacacataatacatcaagctgccactcaaatgaacaagagtacatattaacttttgctaaaaataaaccatcccttaattcttacttcaagatcaatcacaagaaaattgcatcaaattaaagcatatcatcataaatcttgagcactactgattaaaagaatggattggcccaagatgttattagaaaatttcagaggttgcagagttggacaaaaaaagatggtttcagcaggggttctcaccaacaaggagtagtgattgaccgtgaaaacgacgaacacatagtgattgatggtaagagaacctcctg

SEQ ID NO: 70840 - DNA, 655 bp, Oryza sativa
agaataaatgggctaggcccaatttatttctattaaaatctcaagggcccataataaatgttaaagtaataataccaccttgggaattaaaagcgtagtatctcaacttaaaaggcagttatcggaggctccccgttgaccggttaaagtgggggtcggatagccacacgcgcgcgcgccgagccgagccgaggctgtggcccggctctctctcgatccttttgcaacggttaaaaattcactccacgagattacttctgtaacgggcgagcgattcaatactgattgatcgtgtcgttacagaagcgaatcctcctcgtgcgctattaggacgagacagagaccgacgatcagcctctccacgaattctccattgtttgttctgatcgcttgcatgtacaagtgattgggacgagcagggcctccagaaccacaccctctcctgagatctgcacgggtaggcgggtgatcaggtttttggggagtgcttccgcacgactgctcgcttcttcgtcgtcgttcggttctatctacattgcgcaatgtctactggtggtggcacacctggagcctctccacaaattctccattatttgttctgatcgcttgcacgtacaagtgattgggacgagcagggcctccggaaccacaccct

SEQ ID NO: 70841 - DNA, 1423 bp, Oryza sativa
atttttgaataagacgcatggtcaaacatgtgagaaaaagtccccggcgtcatctattaaaaaacggaggtagtatattctatgccaatagtgtcacctatatacatatgttagtgaattatagggaagtgttctacatccaaaatagctgcttactgctaatcatatctgccatgtggctatttactggctttctttttttggtaattgatatggtccaagtgttcaatccttatcgatgagatgttatgtatattgtcaggcttatggagttcatatgaatgggtatgttgagaaggagggccagaaatttctttggattgctaagagaagtgatacgaagcagacctttccaggaatgcttgatcatcttgttgcaggtggcctggtgtgcatttccatcactctctttttttggtccatcttattagcagtaattatttttcagttatcatcttgttgtagtaaattatgaaactttaaaacaattgcatagggccttttgatgccttcattccttcgtaaaaaattaaaggggaactgtgcacatatcagaccgtaacattttaagcttctagttgattattgtcagattcagcctaggattgacttggctgaagtgtctggttagtggtcactgggtaaccagttgttccacttggtcagcgaccaaacttcattttccactataatatttataatgcatataatctccaaaaaatttaatctatgataacatttcattctcttctgaacgttgtggtcataaccagctacatcagatatcaggaacagaaagtctcagcatactttgggcaacataaacatccatgttcttgctggattttgttttacgtgcaaatgatgtgcctcaaatggccttaaactcttggccatatgattcttttgctcctaatgttttggggcatcccgacaattatatacctggtaatctgatgttcttggtaaagcttagatgagaaatttcagctggtttatggggacaataaattgtaatatcatacttcttatttatactgatgtaggctgcatgaacaggtggccactttagggttcatataaaatttctctaaagggttttaatctgtcttgtatgtcaaaaagtcaattcaatcaaacaggtagggatgctttagtctcaaatgtgtggctcagttcttctctctgacctgttttttttttttttctgttgtgaaagtgaatagctagctattaacttacattgatggtacactgattccccttgaaaacttttagccatatggaatctcctgtgaagagaatgttatcaaggaatgtgaagaggaaccaggcatcccaagatccatttcaagcaagtaatatgaccgctgttgcctgaaaaattataaatttctctgtgatcttcatcgtgtttgccgtg

SEQ ID NO: 70842 - DNA, 1283 bp, Oryza sativa
ccggaatcgccccccgtgggcggtcccagtgcccgccgctggcttcttataccccctaggagggcggatccgcccttcctatggagggcacagccggatcaaccgcggtagtcggtctccgtgccccccgctcgccgccgagccccatagggcgccggatccggccttccccccgccggatccgccgccgttcccgctgtctcgccgcaggcggtcgccacagcggctccttgctgtggtcgcccgctccctcctagcggcagccgccgcgcctccttgcttccgccgctgctcccgccgtctcgccatcgcccgccgcctccttgatgtcgccgcccgttccctcatagctgccgccgccgccacgcctccttgaggccgccgccgtcgcttgcgtcgtctcgctgtcgcccaccgcctcctgccgcggcccaagtgaggggggagagagagagggaggactccacggcggtgaggaggggggagcggtgaggagggggagctgcggtgaggagggatggcggtggcgtcgccgctcgagggagtcgccggcgacggagggatggccgaggagtgagaaagtgagagactgagagagatagagagagacgagagatctacagagagagaggagataataagtgagaggagaggaagagaagataaggttaggtgtgaaattttgaacaggtagagagggaaggaagagggaccatttttacaagcgggccatttaaccgtccgcatgcaaaaattgattttttgcttgtggctttttagattttaaattaatttttatgtcactatattaactcatatgaaaaagtttgccaaaaacaaagttgtagaactcatcaagatctacaacttttgttttggtcatttttctatatgactttgtttgaacagtttgaaattgaatttcaaaatatgacaatttcaaataaaattttcaaataataaatgatttcaaatagaaatgtcattaacaacaaagtggtataacttatcaagatctataacttttgtattggtcatttttctatatgactttgtttcgacagtttgaatttgaatttaaaattatgataatttcaaacaatattttcaagtactaaatgatttcaaatgaaaaagtcataaataacaaagtggtataactcatcaatatctataacttttattttggttatttcttcatacgacaaagttatttgtaacactgttcacaagatgtacatctcttatatagttttataaactatagagagatatgtaaattt

SEQ ID NO: 70843 - DNA, 3096 bp, Oryza sativa
ttcttgctatggctcatggcggggatcaaatccctggtagcggtgaaacgcttgccagtcagcttgctattgttgcatcatagtgttgaagtttgcaacctgtgcatcaacagactgttgccattcccgtgactgtaccacattatcctccaaggtgtgttgttcgttccctgcctacagttcaagtgtatccatcctccgggtgagttctcccagatcccctcgagaggagacagcgacacatccaagaggatgaaggtggaccacttgaattggaggagcgcgagtatccccagtgcagctcctacggctcatgccatcggccgtcgctggcactctgccaggacgaaccaccagcgtcccaatagtccccatacatttacactggtggtgaagaggaagacgcctcctgaggtgcttctctgtacattcgtcatgttaccctgcgtgggacatcacgatgcaactccaattggagtggaatggttagttctcggcaattacacaaatgaaactccgggttaggtaaaggaatcttatttgtatagccgggaaacaaaaatataagataatcatttggaccatgtttgagtatgtggcattgaactaaataggcctcatcaacataagagcgggtgataggaatacttgcttataaagcatagtcccaactcttcatgctgaacgagtcaccaaagaaatacactcaaaaggaccagacaacttcatattttctaaccattgcttgatcatgggttgaacaggtgaaactttgattttttttttaaccatggcatacaagaggactagttcgtcttcacaaactatctggatatcagctctaagaaacaacatgaaaccaagcaacttatgcaacagccccaaggtaggatgatggatgtcactagttctaggctttttagaggatgagaaacctgaaatactttgccaaaacatacgcttgttaaaaaccaagaaatgcgttcctgaaattaactttgcatgttttgtcaaagcctagatgcaagctaaggtctttccgagaaaggtgatattccttgcggaataaccagaaagtacaccatcgcctacctctagcaaggtacatagaaactgcatggtaagcaaacaggaacccagctcatctacacatgcaaatttatcccatccaacagcacgtcaaacagtatgaaactcagcatccatacctatccttttcaaaaggtcgagttgtatgcttaggtctgagcacacgttcggtccttcagcatatgataggcttgcatttcccggtcgcccacgaggtcgagatcggagttgtcgtacagcctcggtggaacgtacgcctcctccatggatgcatccgcagaagaaggtgtactcggcttttcgtgtcggcttgtccgtgagcttgattgtctcttgaatatgcccggaagtcgtttcttcatagctacaacaaagagcaagaatacaagactactcggacgggggttaaacaaatacccaccgattaacattgcaccgaactaaagcaaactcgtatatgtaaagtgtctaaactaaatgcagcaaattgtgtgaatttgaggcaagcttgcaaaactttgaatgaattttgagaggaaggttttgagagggagtgagaatgagttagagtggtgtgacttccctctcccagccgagctgcttatatagtgcatggataatggctagtaatggcatgtgggccccactagccgctaccctaaagaaatttgcagccagccagtgccatgcaggggttcggccgaacccctggtggacccaaccggccccacatttagccattgggttccaacgactagtgtggtggtggccatgcaaaattttgccaaaaattttattttattttgctgcgtttgaaaaattcaaacatgctttgatgcaatggaaaataaatatgaaataactaccaatttacctgttggcaagggcgacatcatttcaagtctgacgagcacgacagtacctccgatgcatttagctcgataaggcacccaattccggaggtaaaggagcaggtgttttttccttaatctgccacaccttctttgccttaggtgcgggcaacggcctcttcataactgggaacgcaggttgaccggcctatattcctggcttcttggatgccggcttaaggtattgacggttcctcgtttcttcccgctacaggaagttcatcatgaaagtgttgagactatccgtccttcggggtttcactctaacctccttgtgggttcggtccgttcttgaactagaccatggagcaatgctccatacttggtctccttgtggacgatatccgttgttgttgttcatgagcatgacgtccttacaggttttcggacgatccgtcccagagtgatcgtcattgccacagacctcacatgccatttgaaaagtcgaaggccttaacggtacccttcttggcgtccttctcattgttgtccattctcttcataaggagatccaattgggcggcgagcatttccgtctcgttgacggtgtgcataccgcgtttgactggtttggagtcgttccttgctccaacctgtatttgtgagcctcttctcaatcagatcgttgacatctctgactgtttttgagaagaattgtcacgtcccaaaacgactctaaaatatatcccttaaatgatgcctagaataattaaaatccatgtgaaagcctccaacaattaaaatgtgcaaagttaaaagtcaaataaggcttggaggatttttgtaaatttcctaaaagcctaaaatgcgtaaataaattttagtggaattttcagagcacaaataataattattaagaaataaacaaagttaaaatgattttataaaaagaaaaaccctaaaagtcccccttccctcccttgggccggcccagcccatctctcctctccccccccctctctctctcctctccccgcggcccactcggcctctcccggcgcgcgcgccgctgatgggcgggcccgcccgccaccctcgctgacgggtggggcccacccgtcatccccttcctcccgccgctaccgacgcctccccc

SEQ ID NO: 70844 - DNA, 11828 bp, Oryza sativa
ataatcttgtcaggaaaagtaaagccttcctccctcttgctgctacagcgccacaggtgctgtccatggtccacaccagtcatacgtgattgttttgggcctttattgcttgctctaggtaatattcatgattacgtgttgtttgaagttgaaaatactataaaataattaggatagtgttttacccttttttttacgctgagacatgaataaataccagctcatagagcaagtcatgttatttccagaactgttcttttaacaccgatagacaatacagtaccacaggtcaaaaccagtgagtcactgaccataaaaatgcagcacaaatggcccatgagtttaattcaatacctgagcatttgatgccttctcgtgttgaaaagctaagacaaagcgagcaactttgaagaatgtagtgatgtcagatttctggatagaatgatgctcctttacgatatcatcacagacagactgcatgaggactggcaagcactgtgttatcccaagctttacatgaaaatggaaaatagtagttctggttggcaaaaatgaaatggctaagtaactcactcaccattgtatcctccagataaaaattgttccaggaaatttcttatcatctccattgtgccctctctcggtgtgtagagaagctcattatcccaggcaatccttttctggggccctctttggacattacgtattttccttaggctatttgcagatgcggagttggggttccctttgcacaaggatttagatccgtcctgttagttcaagtgaaacaaagtaaacaaacagataattatctgcttatggtgcaggattcaatttgtagcatttgataacatatggtaccactgccgtgcatgtaaaaattccactgattgagtgatgctctgagtttcgttgcctgaacatcctctttttcctctcttcctcctccatcattaatctcaatgaatgtactgatgtatcgatatttccttcaacatgttcctatggaatatgactagagtaagcatgagtgtttcaattaagaactaaaggagtgtctcaggtgatctacataattaatgaaacttggggaaaggttcagagaaaataaatacctttgaacctgcagtagaagctctagcaatcaattctggatcccggcctaagaaaaggtaatgaaagatttccaaaagaagaaggttttcctgctggagataaccagatggctcatccatatgttgagtcagcactaatattagatccatcacattctcttgaaacatgagctctaaaaagctgtcagctagacagagcaactgggtagcttctccagatgccttctgacccaatgtgatttcttgaatagccaagatgttgcggaacaaagtaagcaccaactgaactagtttccagtcatcttctgtgaatgaagctctggttgccattgtaaagtaaatcataactactcaagttgcaagagcagagaaaatacagcaaactaaataactgaagaacagaaagaatatataagagaaataaataaagctcatttcaagtaggagaggatagacaggggtgacatgcagtaaattgactaattgtgtatcctggtaagtgtgctccactctttcagtaccaaagaatcatgagttactttatggctttatgctatgaaatatgtaagttagaagattatctcttcttgacagagtgggtttcctgatagaaaaggaataataccatctcttgttaataagaacagtaaaatataatttacctttccaaatggtccagtggatcttcaagaagagacacaatgacagccatagcaacattgcgcgtcagtgctgccttcagatcccaaagatactctatctgttgtgcaacattctctgatgacggctccacaggcattgtaaggaataccagcactttcacttcaaaacagaagggagagggaaaacatttaatctcatagtgctgcatcgaagtattaatccaaataaaggcatgatacttaattatttgaatgagaaaaaagcatataatgaggatatagctgaatgcaaactccatgtctgcaattataactttgaacaacaagataatactagagttttccatacacacaaccataacattctcacgagatgcaagcaggaagaaaggtggtatgcattcttatgccaattatcagtctctctagttaaatctaaaggatagacctaaagtatcattaaaagattcaattacggaagttgtaactagcaacaattgtgaaaaacggattgtcaaagtaggcaggtaggtgctgctgctgcttaggaaaaaaatagcatataatctagcagaacttagctgttccttatatgtaagaatagaagccatcaattatgtaggatacctaatattattagagatgttacagccatataaaaaatgcattgtattctcactttctcagcaacagacacaagatatatattgagtacaacacaaatgtaacaaaaaaaaacatgcattaacaattagtacctagccacgcaactgtgcagggaatttgcctagtttctgataaattggtaagcgaagttgaattggggacagaatcagtatccaaaacagcgtgtgagtcctgactcattcatacatttgcttccacacatcacattcgttatttcgcaaagttcaaaagtacaaattggtttcataaggaagaaacctatggactgaaaagaaagactctggatcatcagactatgatttaacaaatgggcacagaatgtgagcaatgtttgtttaatgatatcaattctaaacactactacactggcacgaagacaacgaggaacaatactttgtttgttgacatcatttcgtcaaatcaagacaaaaaaaaataagtgcacatataagctatccattttcaatcaacatatgtgacaaactccccgggagattgttcgaaccaaactcattatgtgacctttcggaaatgctggaagcgaaaacgaaaaaaaaaaaaagaaaaccagtttacctgccgtgatcaccaggttgcgatcagcctggtaattctcaatgatgggcaccagatctctagatgcgattttccacttgcaaacctgcttgaaaacctcccgccgctgcgggtcatcccgccgcaggaatctctgcagatccttcagattatctgaagaagaagaaaagaaaaacgcaaaaacagatttagcgaccactgcgtggcggaatcgaaatggagccggaaccaaagcagcttgcggggagaggcgcggaggcgatagataccgaggcagtgctcgcccttggcgtagcccacgacggcgccgccgtcgtcctcctcggcgccaccgaggccggcgcaggtgagcgagagcgccgccgagtccatggcggcgctagggtttaggcgaccgagcggtggtggggaaatcggatcttggaagggagttgggtgcggattgcggaggagaaccggggaatcgctcgaggggagggggaatggatggatcgctcggggtggggagagaacgggaagatgagatggcggcgcggggaagacgaagggattgggggatttttcccgccgatgcgcgccatttcgggaggattttcccgcgcttttttccactttgggcctttggcccatgggccggaaactgtgaaacattttgggctatgtccatactttacatctgaaaacccgagattgattatttcttcgtaataacatacggagcagtacttaattttttaaggcaaaatttgctataggacacttaaaaaatacgtaattagctgtgggacaccacaaagacgtgaatttgtctaaggacattataaaaatatagtaatttgctgcaggacactgaacacattaaaatataatatccattcaattgatgagagagaaatcacataaaatgacaagtttgcccttatcttcctttccctttcagtttgttccgagtttcgacgctcacttgtggcaagctctattggcttgcccatggtggacaggcgctcgcgcatagtcgacggtgtggtcatgtggcatgcctccggtaccggccttatccccaccccaatccccccgctgaccgcgtgcgcgcgtcgccgagacgttcctaggtggcggagctcccatggatttcggcgacaaaagccgagctaaaaagtagtcagagagtaaatgatactaatgaacaactagatgaccaaagattcaaaattatagtttcagagaacataagctaggcttccatagaactcttttatatagtactgatctgtgatcactagtcactacacacaccaagggaaggagagaaaaagaaagattagaagcagagacatattgctatgtcgaagaaggtaaaattaaaagcagcaagaaagcagaggaaggcggctggctaagcttggatccaaaagttcagagatttgctgcaagcccgcaagagcaaggggtgtcttccgccgctagcggcgttggccgcgagcttgatggacgacggcagcgggctgcgcaacaacgcgcgcggcggtgcggctgctccaggtgcctccctgcgacgtcatagtagatcatgccagaaaaatccagcgactggcaccgctcctccatcagtatctcctttctccacacaccgtccttcatgcggaagctcagctccggcctggcctttctccttctcgacaacgacgagatagccttcttgccgttgccgcctccgccgcctaggaaaggcacgatggcgcgcgacgagaaggacaccgcgatccccacccgtggccgcaagtgctaccgtcgcgccgcccgcccaggaaacccggggccgcgcccctcctagcctccacctgcccttctgcgtgctgcgcgtccgctctaggctccaaacagtcgccgtctggtaatggggtgatggattgggggaatcaatgaaggattgggtagaagaagataatggcaaaaatatcattttttatgatttctctctcatcagttgggtggatattatattttaatacgtttagtgtccagcagcaaattatcggaattttggaatgttcttgggcaaattcatgtctttataatgtcccatagctaattacgcattttttgagtgtcatgtagcaaattttgccattttttaatacacagttgacttttgatataacatttgaccactcacttattcccactaaatcctatagcttaacatgcaaagataccacatcatcatccactaataattattacatttaaacatcatgcaagcatgtatattatttataattttataatttattagattttatagctttttaaatgtaagcatgtagtataatatttcaatatgtctcttcatctttattttaaaatatcttatatatccatatagttaatcctaactcataatttagttaatatgctctatctcttctctcattaagtcatatcacatcatctatggtctaaattatctccctctctttcttctcttattaagtcatatcattttaattatttttagcccttagatgattaatctatgattcaaactatcttactccttttcttctctcataaagccgcatcaacttacttttacatttaaatcatcattcaatatactattcaaatttaaattattataaaccacattaacttacgtagatttatattatctagctatcttacatattacttttacttagtgctattatactaaactatcgcagcaacgcgcggggtttcacctagttaataaagaaaatatattacttaaatttttttaataagatgaatggtgaaacatgatgtaaaaagttcaaagcatcatgtataaatgaatggatatagtactaattggcttgtgttattttgcgatcatagttggtttcattttaatctaggaaaaagggttacattccaagttgttaagaaaatgcttgacattggaaaatttatccaataaagagtgtcttttcatattagggtcaccactagacctccatcctaaaagaatattgttttggttattttgttcagtaaagattgtatttctgttcatcattttttttccttattttaacccccgaaccaattgttctcctcctcctctttgttttcttctctcagattctctctcaacattaataaagatactaatcttttaactcctaaactttatctttaactgctccctcagtttaatattataggttgcattgactttttttagtcaaactaaattgattaaatttgaaaaaatagcaacatctaacacaacaaaatagtttcattaaatatattttggtgatacgtttgttttgtgttaaaaatattattacatttttctataaacttcatcaaacttgttaaaagatttgaatagtcaaaacaatgtatgacatggaacagagtgagtagaagatagtttcttacggatggagtacttccaccatcccatattgttaggtattttccatttgtaagccaaacatctacaaatttgaccgtgttaattggataatgtgttaatatctgtaacacaaaattagttttgttaaatccaccatctagtatatttttctagtatatttattttctattgaaaatattgttacaattttctaagtttggtcagactttacaaattttgatgtttgataaatctaagatgtaatgtaatatggaataaagtagtactattctttttttaataaatgatggtgttgactttataatagtatttggtgattcgtcttattaaaaattagtgtaaatatgctaaagtataagccatacataaagtttctttaatgataaaacatatcaaaacaaaataaataacatttttataatttttaaataaaataattagtgtcaaaaaggttaacggttttattattttaaaaaaacttttaaaatttaaaagtaaacacttcctaaacttatgtccaagatacgaaccttttggtcatgtcagctaggctaacatgcaaaaccatactgccacatcggtctcgctcatgtggcaacgttatttggtcacaccggtttggttagcgtggcaacattatttggtcacgtcattgttaacatcaaaatttgttatgtttttttagtgaattcggttaagaaaagaaaccgattggatatgaaaatttatatagataaggttgaatttaagtaggagtcctgaaaaccacagcaagacagttttatatttcttttagtatatctcttaaataggtagaactaattatttccttttcttgttatgaaatcttatctcatgttcaatatggacatgtacaaacccaagagtataaatatgtacacccatggtctctgtaatctctcatatcaatatataaattttggcgcatcgcctacttttaattttggcgagttcttagtttcaagcggagctgcattatttcattcgctgatgaggaactacgctatgccaactttgattgtaacaatttagttagaactttctcgatttagtccaatattctaattagttgctacaatcgctgcctatcttgatataccggctttaatttggctaaggattcatcggttcgacctcttggtccaatctgatatatccatcgcatttgtgtagatctatcggctaaatagttttttcttattatcgtcaatcttatatgtttcggttaggtctgatctattatattatattgctgctaattagtttaattctactaagtcgataggtctttatgcaacatttatcggagttcgtagtgatgagttatctacaatttctgagtgttacatcggctcatgtttaattcagtatactcactagttagatatctctttattaactttaatcttgtgctgtctcggtttgatccgatctatcgaggttgtttttaataaggaacgacttattagtgattatacattgcttagttcttagccgatggtagcataagttttgatatttatctattcaagtttacatcggacccatagtcgttgatctaaactttgttggcatcggttgcccttgctatatcacattgaattaactgacgcgccctgaacctcaaatttagaatctgcactggagttaaacagatatcctaggtctctgtgtgttggataaattttgagccggcaaccatccttgctagcgtggcaggataaaattatcacgcccgttacgggtagcatgtgagtgtttttttccataccagatgggtagacaagacaaagggttcaatttttttgaaaataagttttgaaatgttatttttaaaatttaaaattaaaagtttaaaaaataataaaaaaaaaagttaacatcatcgtctatcaaaagaagggatgttgcttatgtcactacagcctatcagaagaaaaagaaactcagttatcgtagtaaagtattccctacattctaaattgatctacatatagtttttttagtttattcctaaacgatctacatatttgtgttcatttattaggtttgttcgttatttgtgcattgaagtaaatggacattgatgcatgcatctatgcacacatgtatttaataacccacatgcaatatcttgatttgctattggttaggaaatagtggggatggtgcatgtattgagtttgttgctagaataaatatagtatgagagagttattagtttttcttggtctttgtgtacctatgaaatatgtagatcaatttagaatggagggattacgaagtagtaggagtgacactcttgtcaaagtaaacagtaaacagtaaacgccactgggagtcggtgacgccactcttgtcaaagtgcttaacactttaacagttggattagcaaagtacaagtagcgccaccgaatctagcatagcaaccatcccccttccttcccttccttgcttcttcctcctcccccctcccttttcatcctcaaccaccaccaccaccccgcgcgcgacgccatgctccgccgctagcccacaccctccccccacccaggcgctcggcgaaatgtcccaccgggcgccaatgccggggggctcctcctccctctccgacgccctcgccgccgccgcgctccgcgacaagcccgactcgctcccgccgggccgcctctcccccgtctcccccctcgtccactccaggctccccactcccacctcctcctccggctcctccggctccgctccgccgaggcccgcgcggcgtggtggtggtgactaccacggcgtcggcgaggggttcggcccgctcatctacacgtcgtgctcgtcgagcgcgggtggtggtggcggcggcgtcggcgcgagcacggccacctcggcgctcgccgccggcgcgttccccgcggggaacatctgcccctccggccgcctccccaccacgccgccggttccgcctccccgtgccgcccgccgcgacgtgcttggctccggcaccggcaactacggccacggaagcgtcgtccgcgcgcgatgtgccgctccagtctcctcctccgaggaccacgcgtcggcggtcaggatgtccgcggcggcgagcgcccaggcggaggaggttaggcgcgccgggaacgagcagtacaagaacgggtgcttcgaggaggcgctccggctgtacgaccgcgcgctcgcgctgtgccccgacagcgccgcgtgccgtgccaaccgcgccgcggcgctcatcgggctcacccgcctcggcgaggccgtcgaggagtgcaaggaggccatccggctcgatccgtcctacggccgcgcgcaccagcgcctcgcgtcgctgcaaataaggtgatcactgtaccgtgaaagttgctttcatgttgcgtgctggcaattcttcgtgttgcattgtcggtggaaacagtttatctcctgtgccaacgcataactgcctaaatcgattagttctaatcgaagttgaatcgcttaatattatatttttattgggtaatcaaagttaactgatcaatatggggagggaaattgtaatctaatctcacatttagtgtgtgaggacatttcttctgagtaatatatttcccccttcccaaaaaaaaaaaaaaactgatcaatatggatattgtgctgctgaaatttggttgtacttggtggcacgatttcgtggagtggagatctctgcttcttatagcttaatttggaacatttcgcatcggaatgattgaatgtttcgtggaatgtagtttcggattgcaaagaatgagaagaaagggaaatttaccttttatagtagtgactataaaagctaacctggtgacatacccgttgctattgtatttgctgatgcctatcactccatttttgtttttccagtgatagtgggtgttgggggtgggcaggatgtcatggtcattctattgctttagtccctacatttgtgatatttgcttcttatccatgtgcatttttggatattgtcttactaaatatttcaggcttgggcgcactgctgatgctcggaagcaaattggcatgggtggcctgcagccggacattgtagagttgcacaaattagaagcagtggataaacacttggggagattcgctgatgcgcgcaagattggcaactggaaaagcgcgctgagggaatgcaacgctgcaatcgcggcaggagcagactcttgtgcaatggtcaagtatcctccgttttatttgttattgcctagtcatgctctgcttgaagaatgttatttatatattgtaccaactgcagctctttgcttctagagcggaagctcttctccagatcaatcaacttgatgaggctgatttggcaatctctagagcatccaagcttgattgttcatcctcatgctcccaggacatgatgttctgtggatttcagtccaactcatatctctactatgtacatgcccaagttgacatagcttttggaaggtaatttggcaaacatagaagtccatattcctgcttgaatatagattacatctatcatatgatgtctggacattacttttattttcaacttatggtcaccgtggcaaatacaaatgcataacaaactagattgtaaaaatcattaagagaatttattctaaaaataattgttctttgcaggtttgatagtgcgatgtcatcaatggagaaagctaggaaaatagattctggaaacgttgaagtgatggccatgcataagagtgtgagaactgttgcccaagcacgaaccttagggaatgaactttttcattctggaaaatttgcagaagctttcctagcatacggcgaagggctcaagcatcaccctgcaaattcagtcctctactgcaatagggctgcttgcatgttcaagttagggcaatgggagaagtctattgaggactgcaatgaagcccttaagattcaacccaactattggaaggctctcctaaggcgtgcagcttcctatggcaaggtaatactttgctcaatcaagatgcttttatgcacatgatgattgatgctggaagacttatgttgtgcacactatttgcttctttggtgattagattgaacaatgggcagattccgtgaaagattatgaggttcttaggagggaacttcctggtgacactgaggtagcagaggggcatttccatgcccttgttgctcttaggtcatcacgaggtgaggatgtatccaatatgaagtttggaggagaggttgaagcacttgtaggagcagaacaattccagatggctacaaccttgccaggtctttgctctggtcatcatcgtatctttcttccatatcatcagcatcgaa

SEQ ID NO: 70845 - DNA, 18892 bp, Oryza sativa
  unsure (1)..(18892): unsure at all n locations
caatgggcttgtaactttgtttgggaccctggcccatgtggggcccatgtggggtgcgccccaatctggtggagcacgacccttggaccctcttggtagtcctcccacctctataaatagttaggtaccccttcagggtttcttgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagattgggccaacaacagccttgagtgtcgagaggaactcagggtacatcaaagtatgccatgtttaatccctaccgagctccacacataaaccttagagtaggaatcaacaaggcaacatttggtaaggaattcaggttgatacatttagagagactaagtgaatcatttgagaaacttggctttcttttacaaaatcatttgaaaacttccggaataagaagttgaataaagatcgggtgattggtgctctaattgttgttatgtctttcaaccgcccaaggcaaggagaagcagtgtctcgtgggaatcaggggtaagggtaagccaccgtgccaaatattatttaatccgagagagagtacatataccttgcattgccaaatattatttaatccgagagagagtacatataccttgcacctatatctttgagatatgcagcatagtagcaactcctgaacaacaaccaagtctttgtttcctttcatccttcactcgggacgagcaaaagttcaagcttggggggttttgttgaccgtcgttatcgattagttgcgaccgtcaatattacaaaaatagaggagaactagtgatgcttgcaatacatatatctgttagaataataatattccactagtattaggtatactaaccttttgcagagaatgacaataaagtggaggagaatcaacatcaactcagacgataaatcaatcggacggtgttgagaaccagacttatgtatgaatgggccaagaactcagaaataacatgacacattaggccaaaattcacaagtctacaatggaggacaacaaaggaggccgccagctgaagatgggatgggttgggccagcccatggttcggccgaaccatagggctcggccgaacctcccgtggcgccgatggatgcagggtttggatggatggctgggattgatccccaatggcagttggaggatattaccgaccattccaaccgtcacaaccgtcattacctgcctataaaaggagctcctcttctcacttcactcacacacttcaagcaatagctctctcatttctttcaagtttagtttagtagtatctagctggtggaatagaaatagggtaggaatcaggagtccggaagccttcggaagagttcgggtatggctctaacagctttccttttctcttttgtaagctttgtacttttattagaatagtcttctaaatacatttatggtattgaaatattttccgagtatgtgagtacctattttacattatgttcatgttatactgtggggatacccgtgaccgtccaggatttcgatcgtgcacagattgatatacagaacagctttcgatacatatacccaagttttacataaattattacataaaagataactaagacaggttttaggggccgacaggccaaacacactccctacaaacaaaagacccaaacacaaaataggataaaaacaccacaggcaacgcccgagagcagatcgacctagaacaagaactcgtcagcaccataaaattcttcccgttcctacgcctcctcagggaaaaactgatcgtctgaaccacattttatgcaagaggtgagtaccgaggtacccagcaagccacatccataataatacaaatagaatatatgcaaggcgtaccaagaagaatatagttcatcaaggaggtttcattacaagcctattataaatagtttttccctactttgtaaaacattttatttgcaaacagttgtaaattatcattttaaaatagtagcaatattaatcaccattcaacctcatcttcatcatattccatattttaatttaaaatctactcataccatgataaataggaatcacctaatgacatagcttctcaaccggaagcatggcacattcgaatgatttaagactcatctctgcagagactgcccagctttacccacctgatgtcaatagctagctaagctgaggacaacatagccgttcgagagtcccacttactactagttactgcctagtgggatattgatccatcctagcagtcgggcacttgttgggcctaagcaaggctagacggtcgttgctttcacgggttccaccattgcggatcatgtcaacctggccgaagccccttccacatgtccaccccaaacctgctcatagagccaccctacagtctttcatatagtgggacaatgtactaggctaagtctgattactcagtcctgtggatgggcgcaaattacatcattttccatggcataagggggtagtccttatatccggggaaagccaccaaaactagcacaggcccgtgcatactttaagtgtaaatatacactttccacaaaataattataacaatatgcacggcctcacacaccacaacatccatcttcacccggaattaatcttccatatcactccaggtgagtgactcatatcaaataacatattttatatcacctgacacgccaccacatgacgacgggtaaaccatgtatatgagtatatatatttggtggtcttatccactagaatattatcgtgaagtatataaatctacacctaggttatcaaaggacgtgatataacaatccatggatttggctaataataacaatgtaataatgggtaataactaaactaacaagtttattaaaaaataattcatatgcaaaataattttataaatactcaatgcataaaataactaagtggttctctactaggtttcaatatgatcaaagattggaactgtggcttgccttgtggaacgtgtccttcggaagcttcaacgtagccttcttggtccacttcagttcctgcgagtccagtgggatcttcaacgcgatctaacgtacgcacaagaagaaacgaccaaataagcctataagaaaaatactataaataagaattaaaataaatggtgaaggttggagccagaactgtggaaagatgcactagaagttctatggtttcaaataacaaaatatcactgtaaagcaggggtttatggtgtatacaagaatggacatgatgcagaggtttgggtactggaaaccggaagaaattgtgtctagaggtggccgaaccaaaggtgaaccgaacgaaaaattattgaaccattaaacagagccttagccagatttgtttagctctgtttcctgtcttatggttggattcaaccatgatggcacagtaccacgtactactgttcatcttcttcagtgagacgaacctaggggcaagggaatagagaacagggaaaaagtaggaaggtggatgctaggctgtgatgggtgataggtaaggacatcatgagcaaaacacgttctcaagggtcgcgaactcgatgctgttgttagttttcagagacgacacccacaccgccggaacaggagttccagatctggagctatggtgacaccgggcatggaagtggcagctctggtggtgaacgcgggcgggtgagcgcgtcaaaaggcgttcccggatgagaaggttccatttttgtagttagttgataaagaggacattctggacgtgttggccacggtaatggccatgacagcccatgggagcttcggaaaagctcgatacaaaagcggaaaaagagggaaaataaagaaagaagcctcaccgatgagtggcaaagttgatggcgtgctgttgtggcagaaaaagggccagcgacggtggatttggccagtgaccttggcggcagtttggagtggtttgagggcagggatgagcttgagtgctcggtgtttccagagaaagaagaagaaggggaaaaaggaagggagaaaagcctctcgctaagattcgcgcgacggctatcggagatcggcgcgtggctcgtatgaggcggcacgggcgagcgtgtgcgagcacgggaaaggcacgaggcggcacgcgtgtagcgcgagcggccctgagcggcgtcggcctgcagcggctcggctggagccggcctacctaggctgggccaggacatgggctagaacagcccaacacagagagtgaccaaggaaaaggaaatccggaatatggcctggattgcaaggaacatggcccgagcagaaacacagtgttctatttgaatttttggagagatttttgtatggaattttggtaggatattttttaataggaattgataggatttgggatcttagaacaattgcatgatgactccggtttaacttaaaataaacatcagctcttctaatgattttgggaattttctctaggatatctcggattttgtttggtgagggaaactaaacaaggttatgtgggagtcgtaaacttagagggaacaaaagaaatataaggattgggaggctccaattcgaaagaacgaagaacatcgactttaaatattttcgcaaaaaaattatcttgaaaaatctagtatgttacatatactgaatatacggctagcttatctaggagatgctttggtgcgggtataatgtttgcttatgcaattactctatgtcatgacgatgatattatagtagtatctggtagtttagacgtggtgtctagattacgggatatcattatttggggttatatattgcggatgggaggtgggccgctgatggtgacagctcagtacgggtattcctccgcgccggtatatagtcgtaagttaatttcctggggagggtattcctccgtatttagctccggctgtatggtcatgacggactgtcgtaaggaactcgatagtcaggggtggcttctcgatgtaccaggagggcattggatagagggtattagctagtatatcagttaactagaatgtatgtatactatgtatattagaactataggaatagattttctttctcttttctttccacttagctcagataatatattatgagaatgagtagtaatgcttgtgtgtcactctacccttggattatcttaacccctgcttagaatatgattatcacaagtaatatataaatttttagaatatgattatctctctctactctcggttgaaatgctacaatggtatatccgtgcgcttgcggatgaactctgtaaccataatataccagaagtatttctgcgccattgctggaaattatatttctagtaatgtcgttaaaaaataccaacactcgggttgccgagtttcttacgacaacctgtcataaccctccaaccgaagtaggatacgaggtgtatccaaccccaagaaattgtatataaactgtagggaagacgcccgtactaagctgtcactatcagcggcctgcaaatcacctagagaatatacccccaaataatgataagtgataacctaaaccacatgcttatgttactacttattactctacagccttgcaatcagtgccgagcatctgagtccccgagacataactctcggcctagccagagcagacttatgacccggtaatcagacattataccagcatcaatgcaaatcccagaaggtttaaccacacagattatactacttacaaataaactaagaatggtactcatactctatgatcgtaataaagtaccgaacttgtatattatattgataaatggaagtcttacaaagaagaaaggaaaagctatagaacctttaccgaactccccgaagcctccgtggacttggaactactctaactctactctactaacactaatactaactttgtagagagctttgatccttccttgagtgtgtgttgaaagtgaaggaggtgaggtccttttataggtaggtatgatggatgtagagtatgggaattgtcggaaatgctccgcaaccgccatcaggagttcatccggagcgtccacgccaaaccccaacctcaatggctgtgatgggggttcggccgaacaatgatctggcccaaacggcctaatttttggcaggctgactcctcatttgctcctcaatccaaaacatggaattttgggcttaattgatgatgtcttttgtgagttctcagcccatctatccataagtctggatctcgaaagcctctgattgattgatcgtctattttgttgtcgattctcctccatttatatgtgcttctccaacatagatgttagcagcatagtatatagtggaagtagatattttatttggaatttatgcattgcaagcatagctagtcttcatacattgggtaatattgacggtcgaaattggtcgataacgaccgtcaacaaaaccccccaagcttgaaccgttgctcgtcccgagtaaagaatgaaaggaacaaagacttggttgtttattaggagttgctgcaatgttgtatatatcaaagaaacagatgcaaggtatgggtactctctctcaaaacaaataagtttggcacggtggcttacccttacccccgattcccacgagacactgcctttccttgtcttgagcggttgagagacagaacaacaattagagcgctagttacccattctttattcaacttttattacgggagttttcaaatgatttttgcaaaagaaagcaaagttcctcaaatgattctctagatcactcaaagtgtatgaatatggattcctcaccagatttgccttttttattcctactctaaggttgatatgtggagcttggtagggatcaaacatggcatacttgcattcacatttattactaggtcaaaaacttagactaaaatagatgactaatactcaagatcaagatcgtgcaaagtgtgaatatggtggaaaaatatgatggaaaataaaatatggataaagaaaatgcttctcccttgtgcttatgcttttcctccaaaatatcctttaattttcatagagagggtatggctactttttctcctttttttccttttttttttcatgctccaattttgggagagcaagaatatattatttttctcatagccatacctttccctcttttttttttttgcaaaggatttttctttggaaaggaagcatggatgtagaacttatttgtggataatgatgacatggatatggtagatgatatggatgctatcttccattgtagaagcttagcatatgtgtgcatatgtgggtgtatgatcttgatcatagagcatgaaaagtatctacacaagtcacaaggatttgacaaaatttaatggaattacaagtaaccaaaatgtatatggcttaatcaatatgaatattttggctctggtaggaattcatatcaaatgaggaactttcaaaattatcattttgaaaaataaaacatccggaattcaagtcaaacttagaacatgattatttatagcaactcttatttactatctcatatctcgcaacaacctagactcagatcagcaaagtgcagctcacttacctcaggttcctggataattgtaggctacccttattcaaattttgagagagtacttaaccatgaacccatatatgagagatataaaacagagcaactattcatcatttcaacatgaagaactaagcatgtcttacctagcatattaaatctaacctatctttttggtatttttagttttgcaaatttttatgttgttttcaggtttataaatgcaatgcaaaaatttaaacatgtaatttgaaagggaaatatgcaatatgatacaagttaccttagtggggggagagacatctctcccccaagcttgcttcttgctatggctcatggcggggatcaaatccctggtagcggtgaaacgcttgccagtcagcttgctattgttgcatcatagtgttgaagtttgcaacctgtgcatcaacagactgttgccattcccgtgactgtaccacattatcctccaaggtgtgttgttcgttccctgcctacagttcaagtgtatccatcctccgggtgagttctcccagatcccctcgagaggagacagcgacacatccaagaggatgaaggtggaccacttgaattggaggagcgcgagtatccccagtgcagctcctacggctcatgccatcggccgtcgctggcactctgccaggacgaaccaccagcgtcatgttgcgggatttgggttcaaccggggacatccgcggtcgggtcccaatagtccccatacatttacactggtggtgaagaggaagacgcctcctgaggtgcttctctcgccattcgtcatgttaccctgcgtgggacatcacgatgcaactccaattggagtggaatggttagttctcggcaattatacaaatgaaactccgggttaggtaaaggaatctcatttgtatagccgggaaacaaaaatataagataatcatttggaccatgtttgagtatgtggcattgaactaaataggcctcatcaacataagagcgggtgataggaatacttgcttataaagcatagtcccaactcttcatgctgaacgagtcaccaaagaaatacactcaaaaggaccagacaacttcatattttctaaccattgcttgatcatgggttgaacaggtgaaactttgattttttttattaaccatggcatacaagaggactagttcgtcttcacaaactatctggatatcagctctaagaaacaacatgaaaccaagcaacttatgcaacagccccaaggtaggatgatggatgtcactagttctaggctttttagaggatgagaaacctgaaatactttgccaaaacatacgcttgttaaaaaccaagaaatgcgttcctgaaattaactttgcatgttttgtcaaagcctagatgcaagataaggtctttccgagaaaggtgatattccttgcggaataaccagaaagtacaccatcgcctacctctagcaaggtacatagaaactgcatggtaagcaaacaggaacccagctcatctacacatgcaaatttatcccatccaacagcacgtcaaacagtatgaaactcagcatccatacctatccttttcaaaaggtcgagttgtatgcttaggtctgagcacacgttcggtccttcagcatatgataggcttgcatttcctggtcgcccacgaggtcgagatcggagttgtcgtacagcctcggtggaacgtacgcctcctccatggatgcatccgcagaagaaggtgtactcggcttttcgtgtcggcttgtccgtgagcttgattgtctcttgaatatgcccggaagtcgtttcttcattacagataccaagccagcatacagatggcaccgtacgaagcgttgtatggccacaaatgccgaacaccactattgtgggaccaagttggggaaagccaagtgttcgggaccgatatcttgagagaagctgaagcgaaggtcaggaccattcgggagaatctaaaggtggcccagtctcggcagaagagttatgcagacaaccgacgccgtgacctggaattcgtagtggatgactttgtgtatctccgggtcacgccgttgcgaggcgtacaccggtttcagacgaaagggaagctcgcacctcggtttgtgggtcctttccggatcattgctcgacgcggagaagtcgcttaccagttggagctgcccgcctccttgggcaacgtgcatgatgtgttccatgtgtcgcaactcaagaaatgccttcgagtgtcgtccgagcaggccgactcagagcagattgaagttcgcaaagacttgacccacgtggagagaccggtgaaaatcctgggcgccatggagcgcaggaccaggaaccgggtaatccgtttttgcaaggtccaatggagcaaccacgccgaggaagaagctacttgggagcgtgaagacgagctgaagacagcccatcccgttctcttcgccagttcttccgaatctcggggtcgagattccgtttaaggggggtaggtttgtcacgtcccaaaacgactctaaaatatatcccttaaatgatgcctagaataattaaaatccgtgtgaaagcctccaacaattaaaatgtgcaaagttaaaagtcaaataaggcttggaggatttttgtaaatttcctaaaagcctaaaatgcgtaaataaattttagtggaattttcagagcacaaataataattattaagaaataaacaaagttaaaatgattttataaaaagaaaaaccctaaaagtcccccttcatgaatttgatctttcatgatttgttaggtattatcctagagatctatattgatgatattgttctcaaatcggatggtatggaaggacacatagcagatttgaggttagcttttgagaggatgcgccgaaatggtttgaagatgaacccacttaaatgtgcttttagtgtgtcggcggggaagatcttaggattcatggtgcaagagagaggagttgagattgatcctaaaaagatagagaagtttcgtgatttcaaagagccgacatgcaagaaggaggtccaaaagttgctaggtaaattgaattatttgagaaggtttatttctaacctagtgggtagaatcgatgcttttgttcctatacttcgcttgaaaaaagaagccgattttacttggggggcaaaacaacaagaggcgtttgaatagttgaagagatatttgtctactccacccgttgtgcgagcgcctaaagccggaaagccttttcggttatatattgcttccgaagacaaagttattggtgccgttttgatgcaagaggaagatggcaaggaatatatcattacatatttgagccgccgtcttttagatgccgaaacgaggtatgtttttatagagagactttgtctatgcttatactatgcttgtaccaaattgaggcattatttgttatctagtacatgcattgttacttgtcaagccgatgttattaaacacatgttgagaaggccaattctaagtgggagaattggcaagtgggcatatgctttaatagaatatgatttggcttatgaaccattgaaatctatgaaaggccaaattgtatgtgattttatagtagaccatcatatagatattgcttatgagggagaggtttgcttagttgaagttataccttggaagatttattttgatggtttttcttgcaaagaaggtcaaggcataggggtagttttgttttcacctaatggcatgtgttatgaagcatcggttcgtttggagtattattgtacaaatactcaagccgaatacaatgctttattattcggcttacaagttatggagatggttggagctaagtacgtggaagcttttggtgattcggaattggtggttcaacaattcgccggagtttacaaatgcttggacggatcactaaataggtatctcgattcatgtttggatattattgccaattttgatagttttgttattagacatattgctacgcgtgataattctagagcaaatgatttagcgcaacaagcatctggctataatgtgaagaagggattatttctgatattagaagagccggtgcttgattttaaatctttgtgcgaaattggcaaaactggagaccaggggcggtctgaccggcattgcacggccggtctgaccggtgaccaggggcggtctgaccggccgcatgccgccggtctgaccggcgaccctgagcggtctgaccggccctgcgtggccggtctgaccggttctgggcagaacgctggggggcacatttcaatcaatttagaggccgaattaagtgtgaattcggacatttgtgcccagggaacagaagaagattggagaattcctttgattcgatatttgaaagatcctacacttaaggttgatcggaaaattcggtggcaagcattcaaatatacattgtttgatggagattgtatcgccgaaatatagatggtgtcttgttgaagtgcttagatgaagatcaatctaaagtggctatgggagaggtacatgaaggaatatgtggaactcatcaatcggcccacaagatgaattggttgcttaggagagtgggattctattggccgaagatgattgatgattgcttcaaatattatagaggatgcaaggcttgtcaacggttcggcaatgttcaattggcgcccgccgtcatgttgaatcccataatcaaaccatggccgttccgaggatgggctttggattttattggtcaaatttatccttcgtcatcaaaggggcataggttcatgctagttgctacggattacttcaccaagtgggccgaagccgtttctttgaagaatatgactcatatggaggtaattgaatttattttgaagcatattatccatagattcgatattccacaaacattaactacggaccaaggtgcttcttttatgtctaaggaagtgaagagttttaccgaatcttatggtattaaattgttgagttcttctccttactacgctcaggctaatggacaagccgagtcgagtaataagacattgttgaagttagtgaagaagaagattgaggaacacccaaagaggtggcatgaggtgctttccgaagcattgtgggcgcataggatttctaaacatggtgccactaaagtcactccttttgagttggtttatggtcaagaagccattttaccggtggagataaatcttggttctcttagttatatcaagcaagatgatttgtcaagtgaagattgcaagacattgatgggagacaatcttgatgaagtcatcgacaagcgcttgaaagcattggaagaaatagagaaagagaagaagagggtggccaaggcgtacaacaaaagggtgaaagcaaagttgtttcaagttggagacttggtttggaagataattatgcctttgggtactcgatccaaggagttcggtaagtggtctactagttgggatggtccttatcaagtatgcggcattgtttgagggaacgcatattttttggagacacttcaaggggagcattttcagcgagcaatcaacgggaaatacttgaagaaatacttcccgagcgtttggcaagacacttaggaggtactatggccggtaattggattatcgtcctaagaccaaaacatgttctatgtttttagattcacgttgttcatcagacaggcaggggggcatatgtttacacccaaatttggcacctaggattaaaatagaaaagattgccaaaattgggaagtctaccggttttctccgagtggaccggtctgactgccgtgtgttggccggtcagaccaccggttgaaggccggtcagaccggcggtgtgtggccggtctgaccggcaggtccgagtctgactgtgtttcgtcgggtctcgaggtttccttgctcgggaaggcatgtttcgggtttcctttggtttctaccccgagttggacgtggaggagggcctgtagagggcaagactaacccctatataagggacatggacggttcattgtaaaaaatcaatctacaatcaatcaatcgaatcgtttttcatattgcttttagttttctcttagtttgtccatctttgtcggtttgcgccgtaaaccgtccgccgccgctgcgagagtgcgacacctctttgtaggtttgtcctgaaaaccttccattttgcccacgagacgggtagttatctagaaatcggctctgctagccggtttagttatcaaaacccatctaggtttagctctttgctagatcgaggtggttggcgactctaggatcaccgcaaggctttaggtgctgcgatcgtgcttgtcaacttgtcacaaaacgttgccaacagtaacaaatatatttagcatgtgagacattaacccatatatcctccacatgcagtaacactatagcatcattgtgaaaacggttttaaaaataatacatatcttgtgagatattgcttttcaaatattggtatttttgaactttagcactccttatgaagtaacagaatatgtaatttgcagtaacatgggtatatacatgcagtaacatggttttaccaaatgtataaaattgttcaaaacactcgtacatcaatcagacctcactcaaagccacctacagactttacctatagcccacctattcgatcttcatctcgtaaaactgacatagtaaaattacgattatcgtgcagtaacataactacttggaagtggtaacatgcacccattatgcagtaacacttctacttttgtgcagtaacaagtatatacttttgtgcagtaacaagtatatggttagcatgtgaggctttaacccatatatttttgtttcgattcctggtctactacaattttactacgatgttactgccaaaagtgcagtaacgtcctatgtgttctacagtaacgtcatgtgttactgtacttttacaacaatgttactactagagcatagtaacatgttatgagtttcggtagtgaaagatattagaattgataatcatattactttctcacaaaattcttgaaacaaatagcatcattagataaattggttagaagaatgttctttgaactatgaggtcatgggttcaagtcttaaatttggcaatttattttttatttttctagaaaagagaaaaaaatgtttcagggagaaaaaaaaacagaaaaaagaaagagagaaagatcaggaggagggagggggagcgagagagatcgggaggagggaggggaatcagcagagagaggggggaacaggagggagagaggggaggagggaggggaagcaggagagagaggggggaacaggagggagagagagaaaaaaaaacagaaaaaagaaagagagagagatcaggaggagggagggggagcgagagagatcgggaggagggaggggaagcaggagagagagtggggaagaggagggagagagaggggaggagggaggggaagcaggagagagaggggggaacaggagggagggagggatacggatgagaaagggagggggtatagaatagtcttaccatatatatatatatataaaactaataaaaatatttggatttttccggtcgtcacctcgagtccttacggtgatttttcatcccaccctcgaatcccaatcgcaagccaaaaaaaagaaagtccgaatcccaatcgctagccagaaaaaagaaagtccgattcaatcaaaagggcgataaaaaaatctattggtctgcttcgtccgtcgcccacatcacgcgtgccccctctccaaatcggaatcatcacaaaatcatcccctctccaagtcccaatccaaatcggaatcatcacaaaatcatctaaaatctaaaatagttcataggaaatcaacaaattatagtgtaaaacaaatcacacaggagggaggggcgagcgctactccttgccagacctccacgccgcctcgctgccgggagctgtcgaccggctgctgctccagggatccgccgaccagccgttgcaccgagagggatccatcgctgcgccggggatccgccgacccgccgctgggccgccgccgccgcctcccctccttctagatgcggcggaggggagggngccaccgcctcccctcccctcccgccagatccgggacaccggatctggcacacagggccgcctccacctcctctcccgctggatccagcggatgggagggcaccggcggcgccgccgccgagacactgggccgccgcccctgcccgccgcctcccctcccgccggaaggaagggtctgcaattcctatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtattgtatcgaaatatgaatcttttttcttcctattcggcaaagattactatttcttctttatttgggtctgtctcttgaacctcttttgcttaggttcaggcgatgtagtggacaaaaagagggaaagaaaatatggcgggggacaaattttttgtgaccaaatagaattgcttgacttgttcaattaagttcaatttagaacttacagaaattttgcaaaaaaaacggataccacctgcaattttctcgtcgctggtagagggagggagagcggaggaggagagaatgagagaaggcgcgcgggcgaaagagagaggattagtgcgagagaaagaaacgaggcgcggtgggcggaagaaacgaggcgcgcggctcccaccgctttctcgacgtatgcggatgcaaaagtcacggactgtgacttttagtcactcacggtgtgactttcaggtcatatccatccgtccgttcctttttttttgactaaaaaaattaaggttgcaatttgttattatgtgaaataacgatatctatatctatctactctatacctaattacaaaataagtaaggattccgtaaatttgttttgtctgtcgttatattattttttttcttccacaacgcggtttttttatctggtttattttccgtctgattggttttctctcaggttttttccgttcagctttttttttggcgcgtgggtttttatggtttgtttttttcccgtccgattggttttctctcagtttagggtttagggtttagggttttttccgtccgattgttttggatcgaaaaaaataactaactggcaacacaacaaaaaaacatgtatattattaaaaaaacagatcaaccaaatcaaacgaaaaaaatgagcgacccagaatagacctgaaaaaaccatgtttattattaaaaaaccagatcgggcaaaaaatactcggaaaaaaccatgtgtattcttagtgggtcacgatttttttgttgtgtttttttggtgggccctgttttttccaacggctgttttcgatcagttttttcttgtgcacacggaaggattgaatcccaaatagagttacctaatctctatctttacctattataaaaattgaagatgatttcatactcaccttaattttcatccgtcatctgtgttagacacgtataaaaccaaattggaccggaaaaaacaaccaactggaaacacaaccaaaaaaccagatcgaacaaaaaaaaccattgtattattaaaaaaaatcaaccatgtctattattagaagaaaaaccaaatcaaatggaaaaaatgagcgacccggaatagacatgaaaaaaccatgtttattattaaaaaactagatcgggcaaaaaaaactcggcaaaaaccatgtgtattgttataagaaaaaccggatcggaccggaaaaaatgagcgacccagaggtcaccgttgtcgtttctgtctctatcaataaaaacaattttgttagtcgcgttctgctgttcaggtgttcttcgttgccaatgtccaccatcaatagatgactccaattgttggacacatcctaccacagtccgcaccaccgtttgatcgtcagactattcacgctcatcttgagtactatgagaatatgagtatatcaatgtgcaatggtggtttttatccatcctaattatcattaaaatttataatcaatacctagcctaagaaacaattaatccgtagcgaagcactggcattttgctagtgtgtgtgtgtgtatatatatatatatatatatatatatatatatatatatatagagtatgtgttccaatagtatctactactagataaacgcttttctctcccggttcgcaaccccttttactctcaggtagcgaactgggagaaagaaactgggacaaaagatgacaatctttagtcccggttcaaatacccgggagtaaatattcatctttagtggctgagccatgtcccagttggtccccttttctttttttttcattgtttctttcctacttacaaggttaatccctgtatttcttcccaaatcgagtaggattcatatcccaaatcaaaccccaaatccccaaatcaaagtaacatcccaaatcattcacatcacaaatcgtaagttacttatacaaacaaatcaagtacatcacaaatccttaaaaaaaattacacacaaatcaaatacatcacagattatacatctcagatccatgtaatgaatcacaaattctaaaaagagaaattatacatctcagtgaatcacatattatcaaaaaaaaagaaaaaaaaagaaaaaaggggacatcgacaaaggagagggcgaccggccgcctccatgcatgcgcgccggccaccgcttgccacggccggccccgccggccgctgccgggctctggccggcctgccccccgccgccgaccgctggatgggataggacaggggagaggaggaggaggaggaaggggagggtggacgaggagaggggagttgaggaggaaggggatctaaggggtagaaggagaagggatgatccaatcttatctaaatatcttggtgaggaatttctcgtgtgg

SEQ ID NO: 70846 - DNA, 71823 bp, Oryza sativa
gtttagttcctaaattttttttaaaaaaacatcacatcaaatctttaaacacatgcatgaagcattaaatatacgtaaaatctatttggagaggcctctcgtttttgccttaaccagcgacacctgaacgtgtggagaaatctactatagcgtactacatgcatgcattttttagaagtctactacatcacatgtatgttattttcctcttcaaacaaagttttctctcaaattacttatccgacctacaatccgattacaccattgtgttcgttacaattaaatcttcacagtaagatcttacatgattatattacgatgaaaaaatatttatatttgtaaattacttttattatatatgtaagttactttttatcatatatataagttacttttaaatttgactaaattacttcttagatatataaaagtaaattcaatagagtctaaaagtaatttacatatattataaaagtaacttaaaacaaaacggaagtaactttgtcacgacattagaagtaaattcgttgtacggataaaaatatgactttatctaaaaataaaatttaatcagcacaaatcaacacatgtaagtttaacaatttttaaaagtaactttaatgttaactgaaagtaacttttgcatggttcaaaagtaactatatataaatctgcttaatcatcgattgttttttttcttttatttttagctgtgtagttacgtccaatgaaaaagggcattcattaaagttactttccttttgttataagttatttctataatatatgtaaattacttttaggctttattgaatttactttcatatgtctaaaagtaatttagtgaaatctaaaagtaatttagatatattataaaagtaatttatattttttcatcaaaatataatcatgtcggatcttgttataaagatttaattgttacgaatacaacggtgtaattggatcgttgatcggatgagtagtttaagagaaaattatatttgaagtatatgtggatagtgtctctcatagatggagtggtagctggtttagacaaatcagctaccactagctgtatagtcacatccttaaatatagattaaaaaaactaattacacagttaggagggaaaatcgcgagacgaatcttttaagtctaattagtccatgattagccataagtgttacaataacccatatatgctaatgacggtttaattaggctcaaaagattcgtcttacgatttccaggcgagttatgaaattagttttttcattcatgtccgaaaaccccttctgacatccggtcaaacatccgatgtagcacctaaattttttttttcgtgaactaaacatgccctagtacgattcacatgtccatgccgaaacttctttttttttaaaaaaaattattcacgcttataacacccgcacacccacccatatgaacacacatgcacaccctatctctataagcaagacatattgttagattgacgaagtcactatggatgtttcgttgtccgtggcaaacaattttagatggtttatttaatgttattatatccatatttttttaacaagtctatcttatatcttatttatattaaggaaaatacgaactagtgttggaaaaaaattacaactaaatttaacaaagcctcttctccactacatccattgcaatcatgtccgctctatgttgtttccattcttgtcgattttgccatgggtgaaggaaaggggaaatagagaactaagtaaaatctggacggacaccaattacacagtagcttttaaagaccacaatagtcatccatcccaaaaaatggatcatagaaccattgaaaaaacatcgacaagtctatgccccaatcatagatcagatttgctccttcgccgcaattcatctacgcaaccatagccctccaccagtactagatggaccaccggtgaagcagagagataaggaaagaggtaattccaaataatgttatcatcatctccccctatgtaacgtgccatggacacagaacccatagccaattatgcacccataaaagaaatcacagaggcaagatgatcaggggatcaacagtaaaagatcctccataaacaaccaccattaacgacgaggaaagaaagaaaaacttatttagggaaaaacctaaacaaactactagatccattaaagggtggatttcccttcccctctcgtacccgcgcgccatgttggagaggaggaagaaggggactagtggatgaaacaaggttttttttggcagcgctaagggaggctctatgcaccaaagagagcccaagttgtattgacttgacgtggaacaataagttttatttgggtgcatcttttttgttacggagagtttttttttaagtgagatatgatgagagaagagaattgcccttttatagtagtagagcaatggaactcatggaattggtttttcgaagagttttaaaacaagagtgataattaggacggtttacgcaattttatcttaaattcagtgctatgaaaatagatgcacaacggagacacgaatttttacgtgaaaaacccttgcgggaaaaaaccacgggcgccgaccggcaatgatcactatagatgaattggatacaaacgcaggggatacattgggctgtcgcaccctccctgtgcggcttacaaggaatatatataggagaaatctaggagtcctaataggaaactaatcctataatacaaagtcatattagataactaatccgaatatattgtgggcccaaaatttggatcacatatttaacaatctccaccttgagatgaatttcccttgtagcataaaaaaacttcaatctccaaacaaccttgtgatgagaaatcaatgtgctccaaaatattcacttcgactataatccataacacccttaatccagaagaggtagaccatgcttcaaactcgccattaggaacaaatcctgaatctactggtatgatattgtggaacccagtagagacgtgaaactgatgcacaaatttcaaactcaccatgggaataaaatcctgaatctgctgacattaatttctagaatcctagcagaaacgcgaaaaattattatgctcaaaacgaagtacttagatctccttattaaccttccggtttgttgggcatgatggtagcaaaattcgccggacaatttgatcaccttgtgatctagacaggagcgaggctccctcttgaccacttgaatgtgcttctctttttttttcagcatacttctcctcctaggtaaataccccgctgcaaaaattcacttggcataatgagaatattgcatctcaatccaaaagcagtagatcaaacttcaaagtcgccttgggaataaaatcctgaatctgctggtacaatttgttaaaccctagcagaaacgcgaaacactatgggtgcatataacgaagttgatctacgtatacaacctcctggtaaacatggcttgtgaacgtagcacaaaattgaacctgaattggattcacccaaacagaaccgaagcaccgcaattgaattgaatccctggtacgaaggggcatgtgcatgcagcaaaaaaccaacgtgaaattcaatacacgtgaacagtaacaaggctgagtgtatctgctgatttttctttccttgatcaacgtgctggagtagatggattgctgctttttctccaacacgctgcgcggcggcaccaaatcccgatcggagtcgacggctgactccgcttcgtaccagctaatcttatctcagcaaacaaatcaatctgacggcagcgatagatggaacgacgcgacgacacgcgcctgctactgccgatcagatcttgcgacgagcgtaccggcggctaaaacttgcagatggggtctccaagcagactaactcggcagccaagatggtagtagatcgatgctctgataccacttgttatgaaaatagatgcacaacggagacacggatttttacgtggaaaacccttgcgggaaaaaaaccacggacgccgaccggcaataatcactgtagaggaattggatacaaacgcaggggatacattgggatgtcgcaccctccctgtgcggcttacaagggatatatataggagaaatctaggagtcctaataggaaactaatcctataatacagagtcatattagataactaatccgaatatattgtgggcccaaaattcggatcacatatttaacattcagcatataatcacccttatagtttgatatatcttcaaaacatttcaaagaacaaatttcacagtttaaagaataggccatagatccagggacccgtatgctcagttggatacttggatgtggacagtgacgggttcgaatgaaatgaaaggccgaagctttaaattcagagtaaatccagctttcaagcccagttcaaaaaaaaaagaaagtcaaagcccaacccataacatagcccattcattctagcccatgggccgattcagtaagacgatcaggaagtctcctcgtggtgtcttcctctcgaatccgagcgagacattggccttcctgattcctcccttcctccttgctttggtcaaccgcgtgtgtaccgtagcgcccagctccggggggagtcgccgcgccgaggaatatccgctcgcgactcgcgaggatgatgacgacacggaacgaaaagaagcggggcgcgcgcgccgtcgctgtccgcggcagcgtcagccgcctcgcctcgcctgccgagcaccagcagacaccgcgagaaagtacaaatcggagtcggagctagcgccacccaccccgctgtcgccgcgctgaccccttccaccaccaccacccgcctcgccttccgccggcagcggcagcggcagcgccagcacgcggcggcggctagcggccggcccgctcctccaagacatggccgcccgcttcggccccctcctcctcgtactccccctctcctccgcgctgctcgtcctctccgccgccacggcgccccgtggccgtcccagccaaggtatgggagggttgtggattgttcacgatcgtgtccgtgctagagatttgttgttgttgttgctgctgcttcgctgaccaccttgttgcagtggatgtggggaggcagctgagggaggagttgtgggagagaaaccaagggcacgagatgctcaggtcgtggcgcgacggtgacccgtgctcgccgtctccatgggaagggttctcttgccgatggaaggacggcaacctcttcgttgtcaagctgtgagttccctgaatccctcgttctcactctcacgatcacggccatccattggtgctattcattcggctttgatgagaatttatttggtcgttcctttgaatttgttatatatgcaagtatgaatttgagttgaattgcaactaatgtggtacatactgatgtctttgcaggaacttttcttcaaagaaactgcaggggccgattcccgccgcgattggtaacttaacagaactagatgagatgtatgtttcactaatctttttattccaagtgtattcgtgctatctcagatgcttgttttatattcttattattaattgtgggtgcagtgatctgcaggacaacaacttcactggttctattccagaatctttctttgatctcacacacttgctgaagctgtaagtagatgctgttctttaccatttgctcttacaataaaaaaaatgactatgcacaaattccttgtgtcattctgggatatcaagagttttacataatttagatcatgctggtttcagttgatatacatctcacatatggacatgtcttattaaacatgatcatttgtccaggtcagtaaagtgcaaccccttcttgaacaatcagctacctcatggcctatctatcagcgtggaatttaggtgagatatctgttctgatgttcaacgtatatgatcttgagtggcagtaacataattgtactaaacttgcttatggaatataaaagctatggaggctgcgcttatcatagtccacctggagcttccaatcagagaatagctgttattggtggtgttgccggaggatctttggcatgcacttttgcacttggatttttcttcgtttgtttcaacaaacgtgaaaagaatcctcagaaaaaagactgctcttctacaagaagtacgcacccttctacacaagtttgttcccttatgcttaatttagatagtactcactctgtcccaaaatatagcaaactagtactggattagacacaacctattaatacatatccagattcgtggtactaggttatatcaaatccgatactaagttcatatattttgggacagaggtagtaggtgttttacactcttgcaagtctctttttgctgtttcatttgcatttatgtgtccgtatgtgcatttcgtgtgcatgcgataagaagccttcatttggtagatgaagccgctcttatatatgtctcacactttgttagatgaacatgcatggtagtaggccttgaaatttgagagccgtgtagtaaacaggtttatccaatttttgctctttgatggaggctcatcaacagaagtaggagctgcattcatcagttcatcgtgtcctataaaataaaatacacctcataatcacttattgtctaaatactcaaaacaccaataaattctttctataatgttgtatgcagatcctgtttttgaagaatgtagcacccacaaagctacaaactctgcagtacaacagttatcccttaaatcaatccagaatgcaacgtgcaacttcaaaaccttaataggggagggtgggtttggatcagtttatcgaggaacattagcacatggtgaagaagttgcagtaaaggttcgttcaacctcgtcgacgcagggaacacgtgaattcaacaatgaggtacagatgaaacctgcccctgctagtataaaggaatcttgttgtgggcttggggtgaatcaaattccaaaaaagttgttcattgtgttgcattctggtaaagaagctaaatatggattctttggccgtaaattcaagaacaaggaaatggtagcatcatcagttgtcatattgttgataactttgcatcaacaatcagttctgtttgaaagaatacattaataattagttgtttagtttttcagtatttatctactgaaatcattgttttatgcaaagttctgatcatcaatcaatcaattgacacagttgaggctgctttctgctgtgcggcatgataatttggtcccactaattggatattgctgtgaaaaggatcaagaaattttggtctatccattcatgtccaatggttctctacaggatcgcctctacggtatgaggtttcattagatttaatcactttcagtttaagacccttctttgataaataatatatttcttaggtgaggcgtcaaaaaggaaagttcttgattggcctaccagactatctgtttgcattggtgctgctagaggttagcatttagcactgtcttttttgtctggaaaggcctcatcccattgtttttattgtgattgaagaaaatcctttctgtgcaattcagggacataagttactctgcaaatgtctcaacattgcaaacgctttctatcatttcttttacatgatcgaatgcttgttttgcttgttcaggactagcacatctgcacggttttgctggccgctgtatcatacacagagacgttaagtccagtaacatacttctggaccacagcatgtgtggcaaggttgcggactttggtttttctaagtatgcacctcaagaaggtgacagtaatgcatcaatggaagtcaggggaactgctggatatttagaccctgagtaagttttttcattgctttcacaaaggaacaaaacttttctttcttttcttctatataacaatcaattatcaatgcatttgttagttgaaatgcctacctgtcttgttccctgcatatattatgtgattcaacatccggcttatcaattatgcgtctttctttcagatactattcgactcagtcattatcaaccaaaagtgatgtgttcagttttggagtggttctcttagaaattgtaaccggaagagaacctcttgatgttcagaggcctagggatgaatggagcttagttgaatgggtaagttctcattgcggaccaagtgaccaaccaccaatcacttatctatcaaaacaaatctctctcctcaaagaaaaaaaaagtgaaatctcatttgttcggacacctgcacaaaatgatttctagccactacaattctaacatgtcttaccctggtttgcaaatgtaggctaaaccatacattagagaatacagaattgaagaaatcgttgaccctggcataaaagggcaatattgttcagaggccatgtggagggttcttgaggtcgcatcagcatgcactgaacctttctcgaccttccggccaagcatggaagatgttgtcagagagctagaggacgctctgataatcgagaacaacgcttcagagtacatgaggtccatcgaaagcacggggacacttggctccaaccgctacctgtccattgataggaagatgtttgcttcgggttcagctcgattcgcatcatttgacgctacgaaagggcatttgcaaacgatgccttcgcttccggggtagtttggctgtgcaatggctattgtttttatgacctcagggggatgtcatgcttgtgttgaaggcatcaagcaacgattggcaagataaggatatggagatgctccgtaaactatacccatctgtacagatatcagaattcagagatcatgcagtgatgatatgggaaaagcttcacaaacagagcagttttgcctttgcagtttgtactgattcaatgcttctgaaagtgccctcatatactactctttggtttcggtcttagatcacttcattgtttcgattcctcctccttcagaaagtatagtacaaaggatgtaattcatttaatgctactatattgccttttgcaatctttcagacaatttgagtcgcagttatcaacaattggatgagtgcgtctttgttcaaacaaggattatcgatctggttcacttaaatcaagctgtactgttcccgatgtttcttcccaagcgctatgatacaggaagtgtcaattcaaatggaatggaacaatatggcgttactatcaaaatcttgtgatttcatctctgaaatattctagatatcttacacaggtaaatcgtacgcaacagaatcaaaaagaaaattgagaaagcaaaaacaaatgtgacaccatgcccacaaccccagccatgtgtactcctaaggaagaataattcaataccttcaaaaccaaacagggagaatgacacgattttgaacctttggacgagtcgccacgaaaaaaaaaagagcaaacaaggatcgaatgtatgtatttttggttctccattttgaatttatggtttgcttgacaagattagagttccaagctataatatggttcatagtatttttggttctccattttgaatttatggtttgcttgaaaagattagagttccaagctataatatggttcttatatgagttcattgttacacactttccaatttccagccactccacatagtacatgtaaaaaaaggcaaagagtataactgcaggtaaaggtccatcaaaaacctccagaggaaggtaaatgcttcagcaggtgacttccgaaggagagcatgagtcttgcgctcattggtttcttttcaattaatgttaatccaaaaacacttaacaagacacagaaggatgacctgagggtaaatatccataaaatctggaaagagcattgggtccatctgttcttgatataagcttgaacagtaggaggcatatgcaccaagctatagctgaaattggcaatgagttgtataggcttcctccattagttccttagcccaactcaaagttcgacgaagtattgattctgaacacaatatcagatcaattagttaaacaacagctaatctaacatgcaaaaggttaataaaaatccaaggaaatagctgggcatgaaatgccttacccattttcatgtgatctaaggtatgccaaataattcatgactacctttatcagcagatttgtctgccccaaaaaattcacgagtccctttatcagcagatttgtctgccccaaaaaattcacgagtccctttatcagcagatttgtctgccccaaaaaattcacgagtccctttatcagcagatttgtctgccccaaacaattcacgagtcctgttatcagtggacttatctgtgggggtgttgtcaaggacttgatactgacggttagtcatgtgccattcattgacaataatggctgaatcggtaaaatgagaactacttccctcaccatcagaaggaaatgacactgcaccatcagttaatctccgtggtcgccggacaggtctgctgctcctgcttgaagatgggaagtttccttccgcgcccttctgctttgtcccaataaagccacaagcaagagcttccagagctcgggttgttggtgggcggcttctggtactctgcctcctctgctcactcaatagcccattacaggaggcattgatgtctggaagacagtcatccatcctgttggtttcagaagaatgtatagatctatccattgtatgtgtattcttgtcagaagaaggcacgatgtagctcacagctgactcataatcagaaggcacttgtggaatattcagatcaataacatgcttatcttgggacttttccttgagtaccattttttcatcggtagggggcacattgtactgcttgtgacataaatgaatgttactcatgtcaaagtttatggtagttgatgagttcggaattgaaccccatatgaaaggcttagcccctgcgcttgcttcatttgatttagacacatcatgttgtgcggtgtcaacttgcttcccatgctgtcttttattggcagcagtatttctgcgtccagttctctcattcttacaagatactaacctccttctctttgcaacagatgctgctaagaaaatctggggctcaggagttaccctttgatcaaactgaaagtttatttcagtggaagaattagtagcatggaccctttgagtaccgacaggaagaatagttgcagttgaggaacaggcattattcattaagctgaaaccttgatcaaatgacatgtgaccattggttgatgtcattgtgcctgcgaaagtagaattcttctgaagtacatcaatatccatcctatcacctgttggtggtttacatttcttctcattgacatacttagcacctgtcttgttttgatttgtatttatatgttcataagactgagagctgtcctctgagtcagagtgttcttctgaactgtcactcccagaatcttctgaatgtggtgaagacatgtaaccatgactggcatctgtaggtagatttcttagggacctcaccttgcatggttcttctccttgaacaacactagtatccaccacagtaaatttcattagctctggtgaacacccaggttcactgggccgggtataacaagaagatttcttgtcagtaactgtgcttttctcaagttcagcatcatggatccatccattttcaatcttgaacccaccttcaccattactaccctcaactccaaattcaagcagtcttggttctgatgcaactttgcttaacacatcactaacagaatcaaaataatgatttcctctgacaagcttctttctagaaaatttctttacgcctggaatgaggaacactaaagcatgcttgccaactagagaagaatccttaggctgctccgagtgccaccctcttgcaagcaggcgaggccagacagcctcccagaatagatcattagattttgccttgcttagtctgaaatcaccagtcaaaaactttatgatgtctccagatgaaagcgatgagcaagccttgccgatagggatttctgcacgtgttgagataccatggtttctactaggatctaatgcaaatccagtcaagtcatattttcccttgccaattccaactgcctctacaagaactcgtgcgccaactgtggaccttaaggacaaaataaactcctcaaaggtagatgttccctcgttgaatgttttaaagacctgcaggacaccatatacctcttgagaaaattaacaacaaatataactcaatgcttggattctttgaaaagtagaatgacatgattttaatggttttatcatgaaatactagtgcattaatgctaatggaaggtaatcccaaagtgtttttagcataatgggaagtctagaaacaatgaaacataaatacagaagtgattgcaaacatcacctcacaacgcattaatgttcactaactcaaacatatctaacagggaatggaaaagagaaggtagtagttgagcacacctccaacaaaggatgttgaacttcccttgctataccagcaagcatacgtgacagcagttcctgctgtcttgtaccagaaaatatgcgcaacccaagtatacatctccggcttcttacttttctacatgcagcccatcgattatatgaatcagacctgaagaactctccgtagtaataggatagaacttctcccattgtcttacattgcaaaaattttgtcacctgaacaagatttttgccaaaaatatatagaccaagaagaaaagtttgtgcttcttcatcagtccaggaataatgtgtcattcctggcagaggaatataatcactggctttcccattttgtaagcagttaatatcttgttcagcagattttagaagtttctcatcatgctcatcacattcaactttacagcctggaacatttctaggaatatcttctgtgacgtggctattacattcatcttgtgaagaacatgaactgcgtcctgagaatcctgtctgctctttttttacatgatcgcttgttttttgggtccatgtgactggaatagctagtcccacaccaacaggataatcaaaaccgaaaattccactgtcatcaactggacatgaccttagtttcatgcgttcctcttctgttgctagatttggaatttccacctggtactcatcccccacacgtgggtacactcgtgtatcttcattaacctcttcaggacatatgggctctagaaaccgtggctgctcaacaagcatctctattgaatgctcttcaccatccttgatttcaataggatccatctaaaaaaagaatacaccagattgtgatccagaatggttgaacatatagctgagcaatacagtatgattatacaaatgagcatgtctacctggtactcttcatcattttttacttcaagatcatccatctgtaaaaaaaaaaaaacagtgaagtataaggagtgtattagccaactgttgagtggtcagtcgaaacccatgcatataacctgaacagcaatgtaaacccaggacaagtctgcaaacaacttggtatgaagattaaagggaaaactcatacctcaagcatcagtgagaaagcaaattttgtcattaacaaaaccaaattccagtccgatggacaactaaagctctaacatgtccaaatgtactgatttgtagagcacttaaagtataatgagtttgttgtattgaattatgccaaattccgtccttgaaagacatggtttttgtctttacaaacttgatctgacaattgaaatgcaagataaaaggcaagtacatttattagattttggcataatagataattaaaagttttatatatatatgacgggacggcaatataagagaactgcaattttaagattcaagaagcaacatagttagggccgatttaaatgcagcgtggttctttacagctcataagaacatgcaagttcaatattaggctactggtattaattattgaaaaaacaatggagaattccatgacctacaattgctagttctcaattatctcggagctagtagtctagaactcatgaacaaatgcacgccgcccatatctagacaattcaaaaaaggaaaacttttattgaggatcctcaggtgttcgcgcgggaacattggatggtacatttgatcaaaagatattcaaatacgctactagatccaaaacactaactaccttaatcattacattcctatcagcataacgaattacggcgcggaaagcaccaggagtgttcaagcactgaacccccaacccgttacaacaaaacgttcaaacctcccttgccacagagccccgatcttcgactacgcggggcaattacaacctcgaacgcatctcaaactattcccaaaacagttcatcaccacccactgcgcacatccacgccgccgctcgcgaaccacgaccgcatcgacatcgcatcccccacgcaatgcaatggaaaataatttacatccgcaacgaaggctctctgatccagatcggagggggaggctcacctcgcagtgcagcggggttagcacggccggggaccgaccgggatctggcgccgccgccgccgacgacgacgaccgctaccccgaccgtacgagggacacctgggatgggaagacgatgcgccgacctggaccctggagctcgataacgacgagcggaaaaaggaaacccaaaaaaaaaaaaaaagcggcgcggcttcgaaccagaccacgacacggccgcgcgtcgagcaggcaggcggcggcggcgcgacagcagagagagagagacggcggggtagtataccgcggatacgcggtggtggtgaccgggacgagttgatgacggcggcggcgtcgcccagttggcgagggcggcgtccccgttggaggcgaggcgagaggggggggggggggggggggaataagcgagagggagaaagggctaggaccccatcattcagtggcgagcgacgggggttaattttaagctgctgcttctatagtgctggtctagagtttgcttgtggactaaaaaccgcaaaagctagtacaaccctaaacatctcccccatgaggataattgctcagaatggcagtatggcacatatagtaaaaaaaaatttattagttaaggaggatgtgggagtttaatggaacatgaaaatatgggaaactatgccgaatcgatgtgtggctcgtgagatactttgtccagattatgatttcgtatatagaattaagtaagctcatatggtgactactttgtgacgtagatcggtttggatgaaataattaagttggctgctagattgaagatagtagtatagttacgactataactctacgaaacaatatgatgtgacaataaatatatgataggataatttacaatcaaaagacgtgcactgtagcactatattactaccttgcattaagaaccggtgacacgtataatttagaagtgaatgaacatatctgtggaattttatctatcattaagttgtaatttgtgaaataaatataaacatcgaacgcttttctcttcaaaacactaaaataatggaggtgcacatgataattttttttgtgaagaataattattagcaagtggttagttgaatgcctatggtctaccatgaacagtgatagtagattagcaaatgattgtatcattatctccacgattacaacaattgaaagattgggtgtgcaatttaaattgttgtgatagccaagggcccaaggcataacatatttcatagtaaaatagttaggttaaatctaaccagcaaactgaagaggaggttttgatgcttaaagttacaatgtcactcaccccgtcctattttaagtgcagttctaattttctgtgtctaacttgtgaccgttcgtcttatttgaatttttttatgattaatattttttattattattggatgataaaatatggataatacctcatgtgcgatttttttttaatttttttcataatttttttaaatatgacggatggttaaatgttggataccgaaacccacgataacacttcaatgggacagagggagtatcttggaatggcaagtccaaagtagagggacaaagttcattcaaaagttaattttaagtgtttatctgcatgatcatctgtacaactgccttgagaaagtttaagcatcaacctcacatttatcatatagtatttatttatcatacaatattatcttatagtaatgcaataatagaaactaattctcatgttgaaaattggaactcattccatagcccaagactaatttctaaagtgagtttggattggtctactccacccgtaatcatgagtatgcttcccaatctgttaaatgttgtttatataattgtttattcaaaagaatcaaaatgaacctgctttttcaagtctataatattaatacttaattaatcatacgctaaatgcctccccatattttacgtgctgtgcaaaatcccaacaaacatattcaaacacaccccaaatggacccaatacctgtcagttatgaggtatctaggctcatcggtgtaaaataattaagggcacgatttgatcctgggcaaaccccatcctagtctcttctagcaaagctacgtatttggaaccggtataataatctggcttttggcggcgagctagcttgacggaatgagaaaaatctagcttgctgatcggctctcttttgacgacaaactccattcgtgtggaaaatattggaacgaggggcaaaacaaatccccgaaattagcgattaatctctgtcacagaaagcaaaattcaattgggaaaaactcagcaacaagaggcaaactcacctgcaacaactagccattaatctctgtcacagaaagcaaacaatccaaacagagaatgcatgacaaggctagcaagcgggcaaaaaagagatggtttagcgttgccaagctagactagctgggcgagcgaaccaaacgctccctaacatgcttactgtatctgtgcccatcattgatatttagacatcgttgtgatttatcttactatttactactccctccattttaggttacaagatgtttgactgctttaagtttaactaagtttatagacaaatatagtaatatttacgataccaaattagttttatttaattaataattatatacttttataataaagtatcttgtgtcaaaaatattactgttttttataaattttgtcaaacttaaagtattttgattttaaccaaagtcaaaacatcttataacctgaaacggagggagtataaaatattaaatacatttaatttaatacaataattatcgtatgagccatcctaatcatacattttttgtttggttcgatgtgcaccctaatcataaatggagctgcaggtggtgccaaaagagggactgccaaatggtttactccttccgttcaaaaaaagacaaaccctgatttccgtgtccaacgtttgaccgtccgtcttatttgaaaaaattatgaaaaaaattaaaagataagtcacgcataaagtattaatcatgttttatcatctaacaacaatgaaaatactaattataaaaaaattccgtataagacggacatttaatcgttggcacaaaaacctatggtttgtcttttttttttggaaggagggagtagaacacgagggagggtgccgtcatgcaatgcgtggaagccaccgaagtacgactagtgtggttcagtcatgttctgactcccgacggttttatcgagtactagtacagaaggaagcaaaccaagcgagttgatgaaaactcaaaacagaggacgcaaaccacagaatgtttccgtcgctgtctttgctggctgctgccacggcttccattcctcccgtcccttcctcccactgacacgcgggccccacgtcccccaccccacgacgtctcactgacatcctgtgccccacccccaccagcgcctcggcgcgtccgcctccgcccgccgccgccgcgggggccatcctccgtggaccgcgcccacggcgtgtcccctgcgtgcgtggcgcacccgcacgttttgtcacattccgcggcggcggcgtgcgtgcgggcgcagtggaccgagcccacgggctcgccaccgacgacctttctcgcccccgcccgcgcgccgaccttccgtacggcgtagcggagatacaaccgaggctttcggcgccgaatctcccgtccaccacctgcccccgtcccgatcccccgccgtccatccacctcaccgacggccggatgcgcccccgcgtggcgagatcgcggtcgcgggggcaaaaacccaaccccccaacccaaccccaccgcgacgcgagcggtcggtcaccaccgtcgcgcacctgtttgaatcccactcgtgggccccacccgcgcgcagtaaattccctccccccacccccccgagagcaaaaaaatcccccgaccgcctgagcctccgcgcccactgacaggtgggtcccacgtaatgccccgggccctcgtgtcagcgacagcggagggaggcgggtcggtttgcggtgggggatgcgagggacgtggcgcccgaggaattagaccatttaactcgtcgccaccaccaccagtaaactgcgagtcctcctcctcttctcgtcgccgtgctactctcgctttctctctctctctctctcacttgttccccaaggcgagaagcagccgccgccggcgagcgtcgcgggggaggggagggaagggagggaggagcggtggatccgggcttgattggattgggtcggattcgattttggatcaaccccggagggcgggaggtaaaaacgctactactcatttattgctttcctttcctttctccggtcgatccggccgaaatcggcgattgctcgccgcggaatcccgattgggtgtggggggatgggctgatctccttccgagaaccgggagctcggatgcgtcgagttggttttgtgctccttttgctttccctttttctggattcgggtttccatattggaaggtttcttgatctcgatttcgtggcgagagctggttgctgaatcttatatagctttccttcttcttcttctagcggttgctacagatgcgttgagctttggttaatctatccggcgagagataatgggcgagcttgctgatctcgttgtcgtgccgtcgcagccgccgctcgccggcggccggcgggacaggctggcggcgctgctggagctcgcggcggcggatgatgttgatgggctcaggggggcgctcgcggagggaggcgaggaggcggcggagttggctgatggggtcgggctgtggtatggtcggagcaaggcgtacgaggcgcgcacgccgctgatggtggcggcgacgtacggcagcgccggggtggtctcgctgctggtgggcctcggcggttgcgtcgacgtcaaccgtcgccctggagccgacggcgccaccgcgctccactgcgccgcctccggtggctcgcgcaacgccgtcgctgttgtcaagctgcttttggccgctggcgccgatccggccacccccgattccgccggccgcttccccgccgacgtcatcctagctcctccggcttcgccagatgcccttggcgatctcgaggtgctcctcggccgccgccgagcactcgccgtggcgacctcggtggcttcaggttcgtcatcccctccgctctcgtcctcaccagatgagggcaacaggtcgccctcgtcgcgttcgtcgtcgctgtctcccatcactgtggatcgtgggaagaaggagtatccggtggatccaactctgccggacatcaagagcagcgtgtatgcttcggatgagttccgcatgtttgcgttcaaggtccggccctgctcccgtgcctactcacacgactggactgagtgcccgtttgtgcaccccggcgagaacgcccgccgccgtgatccccgcaagcacccatacactgctgtgccttgccccaactttcgccggcctggtggctgccctagcggcgatagctgtgagttctcgcatggcgtgtttgagagctggctacacccatcacagtatcgcacaaggctctgcaaggagggagcagcttgcgcccgtcgcatttgcttctttgcccatgatgaggatgagctccgccatgtgcctcacaacagtggtgccggcctgctgtctccccgcgcttcttcatccattgatatgactgctgcagctgcgctcgggcttcttccaggttctcctaccagacactttgcaccgccgcctgtgtcaccatctgctgggagcaatggaggagctgctgctgcgcattggctccaaggcagtaggctgcgttcttctttcaatgcaagggatgctgctgttgatgaccttggcatgctcctcgaatgggaatcacaataccttggggcactctgcctgccacccagcagccgcccccaaccacgcctttcagctggtctgagtatcaggccaacaattgctccatccaatcttgaagacatgtatgcttcagacatggcaatgtctccgaggttccctaatgaccaaggtcactcagtctactcaccagcccacaaatcagccctcctcaacaagcttcatcaacagaagggcctcttatcacctgttaacaccaacagaatgtactccccaagggctcttgatccgtcatctttggcacattctccatttggtggcatgtctccccggtccccccgtaccatggaacctacatcacccctaagtgctcgtgtaggagcccctgccacacagcggccttctgttggttcaccacggaattccagtgcttggggcaccgtggggtccccgatgggtaaggttgactggggtgtcgatagcgaggagctagtccgcttgagacgccctgcacaaccagggtttggagaagatgagacagatgtatcatgggtgcagtcactggtaagcaatgctgagcttaatggcaagaggggcgaagtacaaggcatgcctggtacttctgcattgatgaacaggcctgacctgaacaatcagggtgacttgttggaccagacggtgatcggtgcttggcttgagcagatgcacctggatcagaagtgatttccaagggaagccatgaagtcccaaagtggatgaagcctttattttgccaaggttatttaccaaagaatagttgttggtcctagtaaataataatttattctttttaattcttgaaatttttggtgggcaaagtcagagatggtggtcaagttcaacaaaacatttggtcacagattggtagctgaaatcagttccagagattggtaaacaacctcattacttggggtcctaactagtattcttttgattagctcagatgagtctttattttagtgggttaaaattcatatgttccccatggttattatgtccatgatctcttcctaacaaaagagagattataattgtccatttttcatttatcaatgaatgattttgttaaaacaatgtaagttacattcttaattttttctctgttcaatggaattaccttccttggttagtcctctattggattgtgttttgatgcgctttctgactgttcctatcaatgtttgagacatgggaatgggccactgccataaaattgtgtgcataaccatagttggaaatttgacctggctaggcaaaggcagacactaatggacataaaaagcgatataataactgctcatggtactgtatctaactgctcccaaaaatattcattatgtggaacaatggaaggttcgttctccatgattgttatccatgaaaccagtattatatttatttatttactaaaaaaatgcccgtgcgttgcaatgggtgaggactattttaatcttattattgttgtattatttagctaaagtgaaattctgggaattcgcttggatatttttcttacaaaattataagatacaattaggagtccgatcatctcatgttagcccgcgaatttgtttaaagagatttttttatgcaactccttttgtatttcaagtgtacgaacttaaaaaccgactcaaatacattccaaaagcgaatgacttaaaccgactcaaacacgatgacgcaccaaagtactgtatttccaaaagcgaattgacttaaaaaaccaactcaaacacgatgacgcactaaagtacgggtaaaaaacaacttcaatttttataatagtagatatttttataatagtagggatagagattactgcgtgttctgcaaatatggtcggctgttttctctatgatctactcggagtaagcctgatgtgtggttaatgccctcggattattcctcaaatcagatttattttctccattcatgcgacttaaattgttctccacgaaactcacgctaagggcaatagtttgtgttaagagacctcaattcatgtttgaactctgtaatctgaagttctgtaagtttacaatcgactgcagtttttccctttttggccaaaattgaatagtaatgaactgcgttgatcggtcttgtgtgaaatgagatgcattcattttcgcatcaaaccaggcagacagaaaaacatttacagaacctcatttgtactaggggaacacatccttgcacacaaatttcccctgtacactccgtgcagatcaactagcaagtatgtttccttgtactagatgcaaaatctgaaacgttaaattaccacatctcatgccaacagaataagtggtttgatagtgtcgatctagcttaagcgacacagaacctgtcatgctcatattcacattccactaacaagctggaaatcccatgaaaaatacaaagctggaaacccctaaataaataagctggaaagataatctaaataaacattactgtagcacatcgacacaaatgtatttgctgtgcccttgccaaacacacttaagaaactgatgaagtcaagctcatgtttcatttctgggggtgccagcctcttccgttgtggttgaatttggcccttcgatcgctgctctgaccgcttctgattgttcaggaccgtttattatataatttgctggtccaaacataagtagcacagtttagtttgcattgaagctgaaggttttagtgcaaaataagatgcatatcatactaatgtatatggagtgctgacataacacaggacaaaagcaaataggatgttgcacgggctactaaagcttgcaatattaaggtgatgaacttaatgtctatagtttaaaatggtaaaggactgagtgcagatgattgagaccttgaatgagacaaacacaagacataagagataagctatgaaatcgtgacgctgatgacaagtccacagaaatgctcaaaactaagctaaataaattgaggtcccaattcatctcgctattttatcatctgctcccagttgttaccacagttcctagttttttgttgaagcagaggtttgtcagtctagagaatcgatttcaaattctgtacctgttgaagcacccctggcggccatgtgctctatgaaatggatctcatcttcatggctgctcacgaacttgttctggtttgattagtggcaatatgatttgcatcagaaatacattcacgaaaaaatgcctaaagaaatgcatactagaagcagatacttactagttccttcgatagaatatttaggattctatcgatttttgcttgatgtttcaggaaaaacggccgcatataccttctatatacatgctttgctccctaagtaaacaataacaccattatcagcatgtacagaaaatcaaattttctagttcaccattcatcgatgcagatgtatcaagtgccaaacataggtcacaccagtcaacaaccttacaaccatccagaggaacaatagaacaaatctagccacaaacatagaaataatgtttagctagaccaaaagaataaaatgtttcctaagcgattgacagaagacaatgccaattgaacaatgatatcaagaaactataatcacaggttttcatctagatgatcacagcaagtgcttgaaatggaaaaaaaattgggcaaagcgatgcacagggaacatatgcaatgaacatactgattgagctatcatatagccaagactcaaaatgctccgggatggattgtcctaccagatatatggaacttgtcaatcacacgtgtcatgtctagataccactgaccaaataaccatctgacctgaccctgttagagactatattctccccttgattttgccattttgggttcatgttcatataaaacgtttgtcatgtggttttcagataatgaataccataataatattcttcagttcaggtcttatttcttgatagcaagaacatagtaatgctttctctttggtcaattatgtagaaatatgaaaatatgaggaaacattttaagatcagagagaaaggggaagggggggaggggggcttacactgtttgaaggaaactggagccagacaagaatagcaaacttcacgtgataatagaaaggaacactgcagaatatcaccagagtataaatgttcgaaaagtttacaaggacatcaaactttacaagattagaaacatcaagttaataaaggcaatgtaaatttaaacccatgcccggcgaaactttcaaccaaatattcctagtaatgcaatttctttcagttaatgctacattccgcacatatactgtccccatgcactgtcaactattcgtagggtcctctttcacacatcctctccactggaatgttttgatttattccatggtttatataaacataaccagaaaggcagttagaagctgatcaataaagatcagcaactcgccaggttatacaggaaaattccctggtagattaaatgttgtgtcttaatgcaccatgttcgcttttcttaacttgaacatggacaagctgattgaccacgaccaccaagtagtgagaatggtgatgaacagcaaggattacttctttggtttcggaagtactcggcattgtcttggccgatttatatagtttttggtcagaaaaaagaaatgatctactagagttcaatagctgtaggcagcagtatattgtgtgctaggaataacatctccagaatgctacgagtagcactaaattcccataccttgaaagaatctgatcagcaaagatttccgcaatgctaaaagatccatatgctgcaaaacattttgaacaagagcatctaaaggtcaaagcagtaagtttgatatacatctgtatcttttctatttcttagagatgttcatttagatgaaagctgattacacaaataattaaccaactgcctttgtaactataaaccataagatcatacaggtatgtcctccaaggatgcaagtggccagccgctaacccacaatattaaatggccttttggatgggatagtaggctggcccacttgcatccctaaactcctcagcaaagtaaccatgttaaggtgataggactagtaaatgtgcagagtattagctttgacacttcaaataactttctgagcatgcagacaccatataaataactttcgaaaaatgcaacaacctccgtcatcatttttcttttactttagcagtaatattatagcaattggtcacatagagtacctatcaatatactgaaaaggtgcttcaaagttaatagtgaaaatttcataggattttgttttattacagacctgcccaatacaagagccaccgctctttttctttttgatccttcttttcaatagctctgaaagtggagtacacaggcagaccaaccccaattgcacaactgcaaaagcatgaagtgagcataataaattatggacgaatttcttttccacaacagtaatagtagttcattattttgaggaaagtattgacagacaaaaaatatagtttttaggtttattgcagttgcagccattatacggataggtgactctaaatcaccactgtgtcgcctaatagccaatatgaatattgcagtttagattctgcttatctcacatcaatgatgtttatagatgtgagcataaacttgcggtaacgctttccccataggtaaaaatctacgtcattgcaatgtgctaatagcctaatatacgtaaccgttgacaacacaacaatgacagaagtgaatagctatacaatgaactaattgacatactcttatgatggtcctaaagagaataaactttcgatgtattattagaaaaaaaatcaatcaacataatggacaagcaacgcagataagagtaaaaatgcaatgaatacctggctgtacggatgacaacagtagagcttagtggtgccagtaagagccgtaaacccacctgtcataacaaatgcaatttcaatacaaagtttcaataaatctctgtaagacaagtatgggggtcatggaacttccaggaatccatcagaaaacacattatgagataatatgcgtaatataaatgtaatctctacctcatacaaacagattgattagccgaactgccccaaataaaaaagaaagaaatttgaagtgccatatttagaggcgttgcaaagtgcaaaaaattacaaaaggccataaaaaatgggctatcaggaaaacgttaatgtactgataaaaagggtatctatctgtttctgttggcagactggatatatagatttgatcaagagtgatgctcattgcaaaacgaaaataagttaactcaaagttaatttttccctaaaagcaagcccaaataaatttgaacgcgctgaaaaacgataaggttgagtcgtgtctgccaaattcccgtgagatgaatcctcacgtcaacgggtggtttggtggatgaactagaaagcgttcagcacaaatcggaacccacgagaaattacaactcaatcagctccacccccaataccatcccaaggcaatgggagcaaaatcgcatggctccggaacacaaaatccaccgaacgaagaaacccccatgctaacccacaatctaccgtgctcttcccgtacaatgaagaagaaagcgtaatccgaggcgcgccctcccccaatccaccccgatcgtccccccgatcctcaaaccgaacgcgccgccgacagcaacgtctcaagcgatctagggtttccgtacgagccagccaaagggatcgtacctcgccggagatggcgggggccagaagcgccatcggcgagttccgcacgccgcgcgggggtggaggaggaggagcaagggatcccgccgcggaggcggaggcgcggctgcggtttgcggcgtggagggcaaggaatccgcggcgagttcgcgtctccgcgggtaggtctcccctgagtccaattggtggggggatggtggtggtggtggtggtggaggaggaggcgccggcgaaagcggggggagaaaccagaaagcggttagatggaatcgggtgctttgggggcccttttccggtttagtcccaatcttactctagatttttaatttagagtccatgtcttctttcgatttcagaaatatattaaatttcttcagataattcaggattctagaaatttcgattatcaataaaaattcaatcaagaaaaagtaactttttcttacttaaaaatatattctacttcctctgtcccaaaatgtagctatttctagcacagtaccttgtcttgaaatgaagctatttttccacctacctcctcctctcaaccaattacaaatattctccttcacctaccttttcttttcatccaattacacaacttctccaatcattctcacatactttcttaatacccgtgccaacataaaaaatgctatattttgggacggaggaagtaagtaatttatgtatagaaagattatgtaaaaattgtaccgcttataaaaacaaaaaatgtgttcgtgccataaggagaaaagaaccgggccctaaagaatggcaaattatcaatcgagttttagataagggggcatttaactatttgctactcttaagatgttatgataacagatttgccactcgctgtctgtaacatgtgggttctcatgtgtctatgatatatgggtccaatggcaaacctgttatcatcgcttgtaagagtagcaatagttatttattccttagataagtggcacatcctaattaaagtgctcgtttgaagggtggtaatagggcataaagagttatattaaattatcccacattcctacttatcaaaccgtagcggcccgtttggttggattgagtttttaggagggattgggagtttagagggataaagctattaactgttttgtttggttgtgagacatggaaatttcggtgggatggggatgagaaattgaggaaggaactacctcattttcaatacatgggtagtggtggtaattgggagggaattcctcctttactctgcctagaaaggaactccctccttttcaatacctggcagggggtggtaattaggagggaattcctcctttactctgcttaaacaaatctcaaccatccgttttcattaatgacctaatcttcaactaaactctatatcaatttccaccacctctaccaaacaacatattgggattaaaaaccaaattcccatcttaatctcaccatcaattaccttgtgtaaattcccaatccccttctctgaagttgccaaacaagccgcagatgagccctccattttcttctcagtttaacagcaaattgatatggcgattgatacagtgaaatcaatctcagtgagtcgtgaaacagacaaacagtttaatggtggagaaaagagtctcgagtctgctgaagacaaacttcatctttgcttgagacggtcagcttgcaatttggctgtcacaggcaaatgcagcttttagtaagcgtgattccagccttcaaatttgaaacgaacgggtaaacatgattttcaccagtagtttttgggaacaggttcaaagcagagggaatgcagatctacacatttcgagaaacagaacgacagaaaactaaaatacaggaagaattcaacatatccgagatatctaatcttattgctgttcaaattttgttgcaacagcaaaaggtgatgtttatagcaattacaggaggcttagaaaatataaataaattaaatacagtctatataactgtaagcagctatgacaaaataaactactaccctacttgctcttcttcccttcagtcttctgatactgatatggtgggcagttggctacctgaacagattcagatcagaatggataaatgccgtgtgagatatgaaagggacattcgggtacatcccagcaagagcgcatcgcatgcactcgagcactgtgaagatctgtatgaaagcaatagccatccagaaatactgcataggcgtcccctgatacacgatgctgggcatccaggtgcacattgttgccactgcttgggagccagtgtccaggaggatagccaagatgacatggaaccttagaaagtgcggcgaccacttccgtctcacgacaaagaagtacactgtcataaaaatcaccagcaaaagccatcctggaaacagtgtcattgtatcgatgaaggtgtacaccaacgaaaacccctgcaagtatgtgtgtagctggtagatgacatcggcatatgaccacatgttgtggagtggaagcaagtagggcacacatgctacagtcctccaccaccatctgggtttcgaagtcaactcagggtagctgaatgacgctaaagaggatgctcgacagccaacttcaagtcttcgatgctgactgtgtcgtgctgccagtgatggaatgcccttgatagaatcatcccttccgaacgatgcaagcatgtcattctgaacaaaaccagtgccaactgcaagatatatcagatatatcagatatgcgtcagaattcaaagctctgaattacaaacttactgagaatcaaagacaagtacaacctacacaaaaactgtctcactgccgatatatgttctggctaacatctaactagatagcagcagcaatacaagctttcttcaatgtatcatgagttcacgatgatatttatttgacccaattttttttcgataagctgtagacccatttcaactaccacctttattaaaacctaataaaatcaacattttacacaatgtggtgcgtatttacttcatatattggcttgtacttgtactgtctacaatatacagttcatattggtccttaaaatgtgaccagtgaatccgaaaaccagaagttccagaagggtatacaagtgcacaatatcagactatcaactggaaaatagcaacgcaatatattaaatataatcaaatataattgacccgaatccacaagatgttgtcagaaatcacaaataggataatatggcatgaatatgccaacatggcaacaactacaaaagaaatggtagttcagtgctaccagccctctggacaaacgcattgtgtttactcgtaagtgctgaagagaaaggaaagaatgtagggcaaagagtgagcatgtcatcaaaattccctagtgcttcatattttaaaagaagttagcaaaaactatgtgccttatattatgaaattgaaaaggtaaactactacttataatcagtcataagtcatcataagtactatgtgctgcgtgtacacttcgagcagcagaaaagaactgcttacggtgttagaatttgacagaagccccccagaacataaacaaaggttacagccactcacttaatgtacaaacagaattacaaaatttgtgaagctcatgataatatggttgttataattcatcgcaacatgcaagtgagagaaattaaggaaagcattatgggtaataaagggcatataaatgatacatcacaacaaatttaaatgagagaagcaacttcgtctaatccatacctcgcaaagctcccatggaaaaactcttcctttcggcatgaagtcgcgcacgttttacactccatgatcccgccggagtacccaggcacgatgttctcgcgaaagagacattatgcttagccgcaggaaaggcaagcagctgagcgtgtccagcagataagccttgacagagaaccattctgcataaatacagcccttgccgaatcaccgaattacctggacagacatgtgagcgaatcggatcactggatcgcagagagcgaaacatttgggttagatttgcgcccagagaataaaaaaacaagaacaacatcaaaacaatccaatcaagttggaatccatcacccaaccactaaaaccaatccaagtccggatggatccccacactaagcctgatcagtatcgaggaggattgcgagagaaggataccttcacaccgagccgaggtggcgcttcggcgagaggagacccgacccgcccacccgcgtgttcgccggagagaggaatcgatgggcgcttccgccgagacggggaggcaaagaggcgattgcagatagggttctcttttccccgatttgcagatcagcccctacagttgcgggaattcgcatagagaggatattcttttttttttctctcgtgtaacctgtcaaaagcaaaccaagggtccaattctagaatcgcaaaacctgtagctttaacatgcttcaaccaaaatctgatagtagaacatgctccatctacagaataacacggtaaaacacgaggctaaaaaacagcaaaatggaaaacgcagtaattagggacatgatttctctaatctcttattcactgacattctcttatccctaagcctcttggctaactcagcttgcctactttgaggctaggcatacacactagataaaggaaaaaacaatgagattagtctgttttagagagttttagattataagaaacaactagtgaaaatttagccggtgagaatatggttttttttagcctctggcttctaatttatttctttgattcgacaattacaacttcttaaaatctggattaaaaaactgaattatttaagagaattttgaattcaaggagaagctacatctgcccaaaaactctcacaaacatgccattaacatcatgaaaaatctactccaaaatcctctatacaatttccatttgatatcagaaatctattaacttattaaaagaatagaaaaaggagcctccacgttcactctcacggcttagaaattctcatattaatcgaagaaaaagaaaaacagagtccatatagaaatacaatttagaaatagttcaaattcgaaattaaaaaaataagaatattggaagaggagactagagtccatatagaaatataaattataaataaccaaaattctgaattaaaaaaataatattataagaagagtatagagtccatatagaaatacaattaagaaataacaaaaattcagaattaaaaataaggaatattagaagtagattatagagtccatatagaaatacaattaagaaataacataaatccagaattaaaaataaaaaatattagaagtagagtatagagtccatataggaatttaaaactaactaaaactcggaataaacataataaaattaaaagaatagtttacaaataactaaaaattgatattaaaataattaataactaatactatataaaatacaatatgaatattatacattagtagtttcgtaaagttagtataaaatttaaaattatattgtcattttaatatatttgaataatacattgagaaaacatatatgctattatatgagagaaaatataatgatgctagccgcgcaatctacgcgggccaccatgctagtttcaaaatagaaaataatatgtaatcttatgcttcaaagtgctctatagaatattcttctctaataggttggaatcctataaaactcctatctttctcatacaaaccgaaacgggcataattttttacttgctccgatctaaaatgttgttgcaaattagcctccaaaaaacatgttatacatttcggtaagggaccacctatacatttatcgacaaattttctactaaaaatttgacagatgtaattatagtacaatcgtagtgtaattacactgtaaattgtatgtaattacactgtaactacagtgtaacttgtatgtaagtttcatgtaattttgaatcgttagatctattacaagatttgttctggtgaggaagaaaaaaatcatagcacacacatatgtgaaaggatttgttcccacgacctctattttactgaaataacatgttaccgagagattcttgaaagttacatataatttacattatagttacagtgtaattatatacaagttacagtgtaattacactacgattgtactgtaattacatctgacaaatattagggggagaaatttgatgacaaatatctagcaaaatcgtttcggtaaattcggcttcttcttttccacctttgatgatctcccagttaattgggtctcttttatggacctggaaaaagtacttgtctacttgtacgctataaaaagattggacctctacagccccacccaaacgggcccctgacgggctccatttagacatggcatgggcctgaaagactccagaacaactcaggtgccccttggggaccaacagtcacgatcaactgtagatttaagagcttgtagctccatctctgagctagagtttaattagacggttttagatttatctcaaaataaagtggagctaattaaagtgttctcacaaaacaaactaaataggtaaagctgagtttaggctgctcaataatttcactctagacctaactcttaaaagttaaatttaaaggttggaaccctactattgatggtgagagagagtatctctctgtttgcatgccttctttctataaagtcatataagtttttaacacgatctccaaagaaaaaattggcaattattttttataataatttagaataactataaaactagcatcatatgtaaatatttaaatatgaatatttatatcacatgcatgactctgcatatgtctttttatgatatttattagtcaaatttacaaatgtcgaccttttttttaattacgtacatgccttatatttatttttatatgtgggagagtagtacttattacaacggtaaataattgaactcactaaagttttattaaaagtgtaagaccgacacacaattatatacaccacgggtaagacttgtctaacgcacgttagaaggatatggtgcactgacatgtgagcccataatggtgggtcctacctgttagggacccacatcgctcttattttacataaaatgagctacatcctatacaccataatcatgcccaaaatatatccacgccacacgggtatatcctagtatgtgtgtgaacaagattggttggctagcatcgtgtggttcatgtgtaactgttgacatcaaaatttaaaacctgacatcctgttgttatcgggtggagttatccatctacaactccaccaccatacatcatctttttcggttttcattgtaatagtatgtttatcaggttttatttgtttcgcagtaatggttaaattgtatttcaaataccatgtattatattccaaataaggcgtttttaatccggtgaccgggggcggtgggagacagccatttgtggtagggtgtcatcgattcggcggtgttagctaatcgagagcgtagtcatcctcatgaaattggcttgcaaggtgagccatcactaatcttaacaggaaacaggggtacttgcagctttgaattggctgatgacacgctcctgcaatgcattgctggccttgtccttgtgtattaatcactagagccacatctccagattttttttaggagaaaagtgtcactgggccaaccttgcattcagacgtagtaccagccagtcattaaacgtaaatcatggccaaaaaccaaatgatttgctggaatacggcgtcttgatgaagagagactgcaacttcttatccaggcgacgcgataggaaaaacggatccgcctttatcggaggtctaaatgctgaggatgagaggacatgttcaatttctgaaccatccgattgaaatcctatggctgtgatcaagtgatacaaaaggaatgaaacactgcaaaattcgcagaggcagtacatccgaaaaagggtagccgaagtacccccaagatactgtttgtgttgcagtgaaccgatgcttgtcttctgggactatgcttcaaaaatcgtcaaccaaatatcgctccctagcagtttcgtcctcggaaactgacaaaaatgagtgaaattcagatagatttttatcaaaaaaataaatttagtttgattcttattttttaaaaaagaacttgggcgatttaccaagtggtttctggccacaaccagctcaaggcagctaataaccgcgataaccaagcggtaaccgtccattttccaaacctgtttgggacacaaaacgctgtagcgtctgcagctcgtgcggcgtttaacaccaaacaagttgagagaattcagggggcaaaaggtgggagtcaagccgggttagcttcaactgcaacagaggcttgtccgatgctacctgacctaatctgcatccgatgccggcaagacgaagaaactccggcctaggggtggtcgcagacacctgtgccaactaaacagaaagcaacgcgtaccggccagatccaaccaattctaggcacatttaagtgctgctttgctttgtttttgtttcgttttggccccagtgatgttgcaattagattcttgaccagttcagaaagtccaactttaggtgttcaaacatgtaatacagtcttaattaattgcccgtctaactagtgctgcagtgtacctgtcccatctttttttttatggcagcaaggccccagaccttattttctgtggagacaggaaacattagtttgggtatgtatgtattgctcggttgctcctcatcagatgggcaatagtacactccaacattagaattctttcatattttctgaatggtcacagggggagcacctccatctgaataatgttcattaaaaatcttcatgttaaactgtcatttacacacaacaaaaaagaattgtaggaaagtaatgttctacagatttcggataacaaaataagctatacacaccagagaaggaagagaagtagttagccaacagattttggaccatccattgcgtgtgttgtaagttcagtctctgactttcagtttcagagtataaaccaagcattcttaggaaaaaggagtaataaaacagaacaaggttaggaatgcacaaaaaccacctacttccttttcctttctcttgtacagtacatttcgccaaatgtttggccacccgtggggcatggatcaatataatctaaatacaaacaaacaaacaaaccttccaacaatcacctaatgcttcatacggggcaccaaaatgaaaaatagagcagtggaaatctcgagaaatgagaacggaagaaaatagtcgtcaacaaagaaccaggaaagctacacaaggttttcatctggggaattcacaacttgcctattccgtcatctatctattgggtagttgttaactgcaatgatccatctttctgaagttttaggctgaggctagtgaaccgttctcttgaatattgtcttgaggctttcctccaatctgttccggccttcatcattgccgcaaactcatcatagcttatcttgccatcctgaaagtacagaacaatgctattaatactttcagagtcatgtgtgctatgaatcattatgtcaaaacattttgtgcacaccaccaaattaattaaactatttgaagaagaaaaaactagcagtctatcaatttcttaaaactagtcaatgaagagccacaaaccttatcagtgtctacatcacggatgatggcattgataacctcttcatgatttgctcccaggtcatcagccaatgattcacggagctcatcgatttcaatatatccactctggttccgatcaaagtatgcaaatgccttgtgcagatgctcatcgttgccaatctttctcaggtgaacagatagagcaacaaactccccgtagtctaaagatccatttccatcgacatccgcctggcataaccatggataaatagtaaatatacgaaacccagtagtcattcacaacaatagtttgggaaaaatgcattcgagagcaaataatcttttctagttcaacaagatataaagatagtttcccatttttttcccaaaatttggaggggtgtttggggagagaggaagaagggtggcttagggtaactcacagcatccattagtatttggacatctgcatcagccatttggtgcccaagtttatgcaggccaagcttcagctcatcaaaattaatcatattatctttgttgagatccatcttctcaaacatgtcctttataccagcaacctcttctactgaaagatgctcagctatgacctgtagtaaaacaaaatgtgagaatccagagcaaacaagactactattgaaaagccatagttaggtttgagggtcaggtcaggctgaggagtataccctaagtgcatgcttcttgaacttgttcatcacagagaattgttgaagtctggccttaacagtttcgcctaaatttacatttggagccttcttaatgttctgtaaccaaggatgatctggaagaaatacaagataaggttgtcagccaaaaacaaccaagttaaatgatataagggataacatcttcagaaaatcattaagctttatcatttctttactcatccttttgcaaggtctgtgatatcttggattagaagttaacaagttatagatctttgtaactcagaaccaccacattttcaagcttgaaaatttttggtattgttaaagaacaaaagaaataccaatggttggaaagtttctgtatcagtcaagaacagaaggaaaaaaatacaatatattaaaccagtgtgcaaattgattattaccaagcacttgttgagcatttagccgccgcctagggtctggattgagcattcccttgacaagatcctttgcattatctgagacccttggccatgggtctctcttgaagtcaatgacagaacggataattgcctgagcaacaccctgttcagtttctgcattataacatggaaacaaaagaaggatcaggaatagcattcaacattacaacattgccaggtctacaacagacacagacaaaagtaaagattgacagtttctaatgtcgcagactgcattagtgcagaaatgtgatcagaagaggtcaacttctatacactaaatacgtagtatttaatttagtttatacatttggttatcagaattgaagaattcatgtacaaaactaacctgcccaaaatggagggactccacaaagaagaatgtaaaggatcactcctgcactccaaacatcaacctcagggccataatttctctttagcacctcaggagccatgtaataagggcttccgacaatctcagtgaaccgttcacctgcacataatcaataatcacttaattagcccatcggaaaaatatatacacgcacgtatacaatgtgaatagacaacctaaggtaagcccttctagaggcactgtgaagtcatcatttgacaactgagaactgactgacaaattaaaacagcacgcttgagatataggaaataaggacattgcgactgttagactgtacctggggtgaaaaaaacagacaggccaaaatcaattgccttcagagctgcagtttccttcttgtttgcaaacaagaaattctctggtttgaggtcccggtgcatcactccatgcttatggcacatctgatgttttacagacagacaaaaatacacgttattcatcacactatggaagaaaaaagaagttgcaacaatctagttaccaattcaaagaggcaggcatggataactaactaaaaccgaaactgatcagagtctaattaatcagacaaatagacaacagaatcatctggcatgtagcaaaagaaaacgattcccacattattggagaaacaaaagcagataaaaacatgaacttttcagttgttgtcatctagtaacaattctaccataaatctccaccagtgaactcgatttcttttcattatactgtgagactacctcatcgataacgacgacaagaaatcaaacaggatcatttcagaaaatacagtagaaagcaacgaaggaatagagaaatcaccgaagctaccaatctcacctgcacgacctcgacgatggtgcgggtgaccagcgcggcggcgcgctcggtgtagtggccccgggcgacgatccggtcgaagagctccccgccctcgcagagctccatgacgaggtggacggcattgtcgtcctcgtaggtgtcccggagcgtgacgatgttggggtgcttggggaggtggcgcatgatgtccacctcccggcgcacgtcctcgatgtccacggcggtgcggagcttcttcttggagatggacttgcacgcgtaggcgtcccccgtctcccgctccgtgcagaggtaggtgaccccgaactcgccgcgcccgagctccccgcccagctcgtaccgcgcggcgatgtcccgccccgtcggctcgcgcagcaccaccagcctgtgccccgacggcgccgacgaccggttgtactcgatcgagaacgggttcggcttcttccccttcttctgctgctgctgctgctgcttcggctccttctgcttctgcttctgctcctgctgctgtttcttcctcccgcggccgctgccctccggcgtcacgcagcagttgcccatctcgcttcagccaagatccgcgcgacgcaagaaccccccgcgaatcaaagatctgcggcgagtgggaggccaagaaatggcggcgtgacgcgttgggggagggaggagaaggaggcgagaggggggaggaggaggaggagggggttaaattgggaggtggggtggattcggtggggagacggggtcagccgtggcggcggctggggggcgtgtgggaatccgccagtggtaaagccaacgacgaggccgcggaggaggggaggaggaaggtaggagaagacgggggtgctggtcaaagatctccctctctcactcggctctctcggctctcctttttgcatcctttgccctcttctcttctccctagtttttttctttttctttactttttttttccttttcctctcatttttttaagggacatttaacttattgcaacttttaagctgtagcaattaattatttgtcactcgttttatatgacatgtgaaccgtcgtgtctctatgacatttgggtccagtgataaataatttaacaccacttgtaagtggcaaatatttaattaattctttttttaagctcttccttttcctctcgtgtttattttcccctctgttccccttgcttgtgctatggtgtgtgtaccaatggttttatgttaaagtagttgtttagggcattggtaatgtgtgtgttgattattgttttttattaataaagattattaaaatgtatgtaagaaaagcttttaagaaattattaatgacatttttgcgtaccaaagctttgggatgagtctatattataccttttataactgtcggatttatctaaaaacaccactcaactataaaaatggacactttatgtcactctactatgaaattagacaatttacacttacgccactcaagtattaagatatgagaaaataccctctaagagtaatacaattcggttttggaggtgattttttaaaaacattttgacatccaaataattttttttcttatttgtatcgcacccaattagtaagatatgtaaaaaaatcaatataaataaaaacatgtattttgtttttctcttatcatgaaaccaccatcaaaatcaagttgtattgtccttgggagaggtattttgccctttttattagttaggagtgtacaatatccggttgcatagtttttaaacaaacccgataactgagtgatgtaatataggcttatccctacattttaatatattttcatgcattaattggttaagattttgatgtttacctaaaaagtcttaaattgataactgtttaagaagggactatgttgattgtgttgcttctctcgttttcctctttatctcgtctgatgatcttgttttctggtttccccccatccccccccccccccccccccacatctgatatttttgtttttttgtggtcctggtgtggcgttgtttatgaggaaaatgactttgaacaaagttttcatgaagtgattgaataggactaaaagataaggagagggttaggtgggtgattaaagtgacattaagcagcatttgtccaggtttgctgcctaatcataagggggcaacttgacgctttgatgggtacgggaaggtagtttaatcagattgtggaaaaatctagctgatggttaatgctaatcggtttagctattggtactaagatggtgtaatttcaacgataaatcaagaaaaagttggtcgtactcttgttgtaacaccaggatattctttttcacttcctgatagaattgtgaatttatttttcgaaatagaccctcgttgtaaattgtaaccacttgtgttctgacaactcctgttacagaaaacaaatctagcgtcacagttttactgatatggtggttagtcgtgaattatccgaatatacatttccttctgctttgcaacatcagtgtatcagtattcagtcaaggttttgaggggcgactaattctcgcctaatttgggattggttctttctttttggctactgcatgcctgctgtatcaactcctgcttgtcaaatacatctatatgtcaacttccaaaaagaaagcatccttgtgttcagctaaaatttcttctgaaacatttgcagattcaacagaaagtcaatcgaagccaattcaacacaaagtccatgggcaatgttacacacgagggaattgacagctgaaatgtgaaagtgcgtaattcctcagttgttcaaccgcctcctttttttttgcgcaactgcatgcgttgcgtacgttttcacaagctgaatttgttctttagcttgtcgagaagaacgtccactcaaaagttttagcttcaactgtggaactagtattagtatttgttctttaactgtagagtagttgctatcctgaacattttgtagagtttaaaaattttggtcaaatctttgtactacttccgccggttccacagtacttaatgtgtcagggttatggatatcacatacctaatagtagtcgactaaatctcggcaggacccaacacataccatgtcttatacggaaacaacctccggatataggaggagttccacataagaaaagatgaatagagtttctacatggaaacgataaggactactcggattgtatccatattggtctctctgttctatttggacaaggggacacctatgggtataaatacaagaccccctaggaggagagaggacacggaacaatagatcaagacacaagatcaacatacaagccaacatgcgccaagataagacgccggatatcgacttcagagataagcatagctagtcccctacgatgtctacgaatactgttaggagagacatcgcgttgtctctgatctcgccgggcacgaactcgatgaggaagactaccctattttcgactacgggatggtttcatggccgccatatcgacaacagttagataggctaccccaaatattgcactggtgtgattatggtgaataagagcaacgaccggcttcggccaacatgatgtagggctattacctgacaattcaagggtccgaacctgtataaaaatcctcatctctgtctcttttacctaagtctcgcatatatcctggtaccaacgatccccatactatgcaaataccggaatcgtgacattaaacgtcgacataatgttttggataaaattaagatcaaaattttataactttaaacttcacacatatttaactttaagacactataacatataaagtactataataaaagtaaaaatatataccatccctccataaaaaaattcaaacatagctataaatttgaacacacatgtgtttctttctatctagaattaggtttctttaaaacagagagagtatacctattatatatatatatatatatatatatatatatcataatagaaaaatatagttcaagatatattttaaagaccgtgttattgtttaaaacgttaagaattatatagctagagaggatatgtactgtacgacggaattctggtggtgttcttttctcctgaagatgaagataaagattaagttttttacgtaaaacaaggtggtattaatgtatgatttattgaggtttaattattacaaacttaaaaaacatattaatatgatattttagaggaactttcatatagaaagttttcgcacgaaacataccgtttagcagtttgaaaagcatgccatgaaaatcttaatcttcatccaactcttatcggagagaagaacttgggcatgtttagatcccttggtaaaattttatatcatgtcacatcgaatatttggacacatgtatggagtattaaatataaacgaaaaaaataactaattacacagattgcgtgtaaattatgagacgaatcttttgagcctaattgcgtcatgatttgacaatgtagtgctatagtaaacatttactaatgacagattaattaggctaaataaattcatctcgcggtttacatatggattctgtaatttgttttgttattagactacgttcaatattttaaatgtgtgtccgtatatctgatgtgacacgccaaaattttatacccgtggatctaaacaaagcataagtttgaacccattttcctatttgaagcagacgtggccactcgttcatctttttcatgttccacgcggtgggttctgtggctgttgcccgtgttccttaactgtcacaggctcacagctcacatcgtcatggtttttcatccactactcgtagagatccacttctcatgaattcatggccgggggtcgctgtctgcacgaaccgggcatttatgtttccgtgttgtctcgccttgcatccggtggatgctaaaagcgccccagccgaagagcgtgccaagagaacagcaagggaaagggacacggtcaggtgttcacaccctctgcggtggtgttatttatttatttatttattttgttaagatacatattttacctttattttgttagcaatttttttcaatcggtttaacagtatgtttttttccagataattttctatataaaaactgttttaaatatcaaacaaatctatttttcaagtttacaataattataactaatcatatgttaattgttttttcattttacgtgatcttactacaacatcattgtttcacctattcttatacttatttgtatcgcttattgtaaataaaaaataatctatagcatgttcttaacggtaaaaggcaaatgttataaaatactatttataagtgtgttaatcttcgtcttcatctgaccaagttcaaatgggacctgtgtctcgcggtttcgtggtactagttaagatcctacacggagcattcggtgcatatatagtgacttggtagtcatatcatgtgggtgagatttctccgtggaattacgtgatctaccacaggactttaagtgagtagttgtgtgtgtggggtatgagattgcgttgcaccgtccatgagctcaaggctgcaccataggtcaagagtttgaattctgttcctacctgaatgtgaaatagaaggataaaaagagcaggtttgtacattttctcaaagaaattgtcaggttttcgatcacttggaaaataccataaaattaatggctaggattactcgagattcgtggatacaataactttatcccctcatattcttccccgcaagctcgtccgctcgttctcatttcatttgacgccttacagattgaagcgcttgccgtcgtctcccctgcccgactgcaacgcccctccccggtctcaccgactaaccgaaaagcgtgaaagttattagtaaggcccaacgcaccagtcggcctcctccctttcctcctctctccttctcgtcctccctaagttgggtggcgacactattccccacccctgccttgcctcacctcctttgagctggatacatcgtcaaccccacccaccgctatccttcatccatgtgacttcagtgacaccccccgtccactgccgtcacccaaagccatccctctaaaccccagggaatcccctcccacctctgcccccaccccagcgctaaactctaacctcatagccatctcattattgtcatcgaagaagagcacatcatcgccgggaagtcaccatcacaagtgggtcgtattttttctccccaccctaccccagcacacaaatcaactcttgaagacaactccctatcggtcagggagcatgtgaggtctcaccttataactagcaaatcgctttgtcaaattacatcttacattttacattttatatagaggaaaggcacatacctgactgtttttatatagaggaaaggcacatacatgactgtgtttcctaaattctgatcatttttatatcaactatagatagacaattttactccaattaatttgtcttgtccaatgaacatggacacttgttcaggttcttatccaggttcattgttttagtgttttaggacatgtcacattctatccagtttttttttaaccgaggagtaatttaaacgtaacttgtgcagtgaagcaagcggtcagtgctgcaatcggctgagcagcaggtctcttccctgatagcacgaatttcaaagcatatcggatggcaaaaaaaataaaaaaaatctagccctatttacagtaggtacaatagcagactataagccatctataaataaatttcgaggagataaaagaaaagagtgaagagcagcgagcgagctacaaatttgtagccagctgtagcacggactccaagatgcaatgtgtatatgacaggtgagagtagatatctattaacttattaaaggaatagaaaaatgagcctctacgttcgctctcacggcctagaaattatcatattaatcggaaaaaaagaaaaatagagtccatatagaaatacaatttagaaatagttgaaattcggaattaaaaaataaagaatattggaagaggtgactacagtccatatagaaatacaatttagaaataactgaaattcggaattaaaaaaaaagaatattagaagaagagtatagagtccatatagaaatacaattaagaaataatagaaattcggaattaaaaataatgaatattagaagtagagtatagagtacatataggaatataaaactaactaaaattcataataaacataataaaattaaaagtagagtttagagtccgtataaaaatgcaatttacaaataaataaaattcaaaataaaaaaacatgggaagaagagtttaaaatcaatataggaatagtaactagaatttgaaatcaaaaattaaagaatattgaaagataagtttagagttaacttagaaatacaattaaaaataataaaaatttagaattaaaaataagtaatattggaagaagagcctagagtctatatagaaatacaattcacagataacaaaaattcggaattaaaaaaaagaaatattgaaagaaaagtctagagtccatataggaatataatttagaaataaataaaattttatattaaaaataattaataactaacacgtatataaaatacaatataaacattacacattaatagtttcgtaaagttagtacaaaattttaaattatgttataattttaatatattttaataataaattcagaaaacatatatgctattatatgagataaaatataattatattagctgcgcaatctacgcggccactatgctagttaatagtgtagtatatgtttataggtaactatcatataaattggccattaatttgtctatagataatttgaagctagtagcgagctatactattaaacttgcacttaggttgtgtttagatccaaggttgaaaatttttactgtgtcacatcggatatacggacatacattgtctaataacaaaataaattacagaattcatcaataaaccgcgagacgaatttattaagcctaattaatctatcattagcaaatatttactgcaacaccacattgtcaaattatagagcaattaggcttaaaagattcgtctcgcaaattagtcacaatttgtgtaattagttatttttagccaatatttaatatttaatgcagatgttctgtgacagggtggaaaattttagggtggatctaaaacagggttttattctcgacggtacaataccaaatccgtctattatattcgcgcgaatatgctcggccagtccacctgtcacgcgaggcatgagaagggcgaccgagccgggtggagctgagcgagtggtggtgctgctgcagccgccgccgccgccgcctgcaggcgtgctgaaaacaagtccatgccatggtggacgagaacactgtggacgtggtcagccatggatggtggcgatttggacagcctcgcgaccacgacatatactagtagtactcacatatatacgacgactagccaaaggtgattgctttaatcaaacaccggcgatgttcgcgttcctctggaagttggtgcagtttctctcctcctcctcctcttcttttttaatttttcgtccctaaagaacagaagaagtctcatgtctaaagtgatactcttcgagtcttgacggccagaattgtcagactgtgtgatccagaagcaagctaaagaaagggagtatacggtccagaaacacgttaataaagggaaaggaaaagggttgtctattcttgcttcagtctgactgtgcttgccgtgtccgtcgcattgccgtcgtggtcaaacaaacgccccaatggaagctgtaaacctcattcagtcaacaaataatgtgagatcagaactggctcacctgattcgggagatatgagttgatctcaggaaacagggaaataactattaagaaagtgttgcaatgccagaatactgttagtcacttcctagctaataggggtcggactgtgtctcgatctgagttttggccagacaacacttgtaacctcataacacaccttgtgtgtgaggattctttgattgattaatgaaatttccctttttccccggaaaaaaaaaacaaacgccccaatggaaacatctcccgttgctaacgcgtgaatagacatgtgttcccaactctcaagttttccaggtaggacctgctctctatggttcggggccatatatcgccttttgatcgataaccacgaaatctgtgaatttcaggcagattaattatttatccaaaataaaataaaataaaatttagtatgattttttatgaatttagtgaaattattaaatggctttcgatgtgtaagcactatgacagtgtttctctccacttgtctgccactccgtctaaaaaaacataaccttagtgagttttttttttttcgaatggagtactttcattacttggtcatcgagcgggcaaaaatgcaaactactccaaattccaaaatgggagtggcagccgatacaaagacaagcggtggacttgtgggcctgtggcttgtgggtgatcagcccggatggcttgcttttctgttagtgggctgggaggtgaaggcgataagcttaggtgggctggcttgctgctacgctcgacagaaagcgggctgggcaagatggggaggcaggccgtggctaacgcttgatctctttttgtggcctcttgcctcatgggtggcttttagtgtgagaaatgaacaaggctacgaagcagtactttgttgccctctttagccgatccttccatcgatttcaactgtcaatagtgtcattcgctacagatctcgacgccaaaccaaaaaaaaataaagtttcgagccaatgttggaacctctggaaggtagacttttcgaaatggaggacgatcagatgcgtaatggaaggggaaaacagagtataagatcgcaccactgagcagtgagcatgagggttcggctttccgtgacaggtactattggtgcacgcgttggaggggacgagagttgcaaaatgccggatgaaagagcttcacgacttcacgtgtggtttggtttttatttactcgacgggtccctacacgatgctactgctacacatgaacgtgatgcgcgtgtcatccgcctcgtacagtcgtacctccaatgtaccgccaggcggtgcgcgcgccggcaaaatcctttcggtcacaggatcacggccggtaacactcgtacacggtcacacggatacgtacatctcggaacaatttgatgcgttcgggtcatctgaaattaataagtgcagtgcttcatcctcgttgtaacttgtaacccataattgtgcttcttactagtgttttttgttcccttcctggagcaacaatgcccatcagagagaggggagactgcagttcacagccgtgcgccagacattcccagtgtcccagcaccgtgtaccctctttctcgttaacgatcgattgagcaaaattaatgggactcggtgttgggctggagactggaagacaggcacttccaagtatgtaaacgtaacacttatcaaagcatcctgctttaagctagcctctaacccggcctcattaagttagcccaatttcctggcccatgtacgcagataggctagatctattatattattaagacagctcgaaaagaagacatcacgtttaccgtggaggctagaaattctcacgttaatcgaagaaaatataaattatttacaccgttggattgtaagaggcatagatttcaatgtctgagatttaacacaaacttagcatgttaactgaattagaatcaatctctaactaggatctttacatgcaaacggactcaaaatagttttgtccgattttctaaacttaagttaggttctagaatagttaggctataatgtatagtagcaacggaaatccacagcagcaggtcgagccgcgcggctgcacgatgagcaagaattggacgatgcacgtcaacaaacagaaggaacgatggcatgtgcacagcagctagccaggtgcacaccttaagcgatacaattaaaaagttttcctttgaaaatataggttccaaaataaacttaaaaataaaatttggaataaaaatataataccaataataaatatgtaaatattctttgccaaatatgtacatttatctatatatatattattaagatagctttagaaaaatcatcagagacataaaaaaaacgtagaaatctttattattaagacaactcgaaaagaatgtgccatatttattctaaaagatataaattatcacattaatcgaagaataaattccaagccattagactgtggtagaaccaaattagaacggtgaagattgataacagaaatatatgtaatataattatatctttagaactaaacaatggtatatagaagagtacagtgacagcatttgatgagacttctaaatattataaaaatgaaacgaaacaagataataaactctaaaaagtacaaggtccaatttttaaaggttcgggacttttaaaaagtaaaaagaacaatgaaaataatgttccaatttaaaatctcaatgaaataaagagaggagggagcatgcgagccatagaatagtacaatggcaaagccgataattgtttggtgggacttttagaaagtaaaaaaatgaactcaaacaataattatgtttgatttttagaatcccaatgacaataaagagaggaggcagcagacgggttatagaagagtatagtggtagtgtttgatgagacttctaaaaatataaaaatgaaactcaacgaaaataaactctaaaaattaccaggtcctatttttaaagattcggaacttctaaaaagtaaaaaaaatgataataatgttcgattttaaaatctcaacgacaataaagaggggaggcagcggacgggccgtagaagagtacagtggcaaagccgctaacggtttggcgggagttctataaagtaaaaaataaacccaaacaataattatgttcgattttaaaaatcccaataacaataaagaaatgaggcaacggatgggcaatataggagtagagtggcagtgtttgatgggatttctaaaaattataaaaacgaaaccctaagagacaataaactctaaaaattataagatcaaaattttaaagtttccaaggagaatgaataggaatagtgatagatcgagcaagcaaataaaaaatagggtaacttttaaaaactataaaattaaacacgaggatgatatggtttgatttttaaaagttttaaaataatgagataactatttattcaataaaatttaagtaaaatcatattaaaaatagataattttatatggatgctagccgcgcaattgcgcgggccacccagctagttcttattatcccagacaggcagcatcatgcagaaagtggggtatcctaccactttacagtagatccacagtacacggtatactgagttgagttcaaaaaggaggtgtacccagttagcgctcgcaagtacgagtacaagaacgaaaggcaaattatatcaaacacttatcatttcgatgatacattagggcgatccataacgtacattcacaatacacacacttgcatcatcatcatcatcgtactccatacacggtacacgtacgcacacgtacacacggctccctcgtttcgtacaatctgaaggagagtcgaccacgcacgcgtgcaggcactctaccttggttacaatttgtactaacgtaaacccgcccagtaccctgcacggctgcacccgtcgtaccgtgtactacacggccacgtccccgtacgcgaaaaaacaccaaacacgtataccgttacgcaccccgggctccaccttacgtggcagcatcagctcgccggcggtgatggatggatggatgctcacgattggtggcacccgccgagcggggcgccgccggcgcactggttgtgctcgtacggcttgcagccgtggcggatgacgccgtgcagcctcgggagcgggccgcagaggcggttgtagctgaggtccagcgtctgcagcgtggagagcgcggcgagggagcgtggcacggtgcccctgatgcggttgtggctgaggtccaggtaggtgagctccggcgggaagacgagcttgctgaggtcgaagtcgaggtcgttccacgagaggtccaccttgccgatgggccggccggcggcgaagaggaaggaggcgtcgccggtgaggcggttgtgcgagaggtcgacggtgttgatctcgtcctgcgcgtcgtcgcgcgggatcgggccggtgagctggttgtaggagaggatcagcgacctgaactgcccctgcacgagccccgccgggatgcaacccgtcagcttgttgctgcggaggtcaagcgaccggaggttcgggaggtcggagaaggagttcgggatggggccggtcaggctgttgtgggagaggtcgacggagtcgaggctgcggatccgcgcgagcgagtccgggatgacgccggagacgttggtgtgggagatggtgaggaactggaggttggagagcgcggtgaggcacgccgggatggggccggagaggcccgggaggcggaacagcgacagcgacatgagcgccgtcagccccgccacggcggacgggatctggccgcggacgtcgttggcgccgtcgatgaagacgttgttcacgcgcccggcctcgtcgcaccggacgtggtcccactcgcagcagtccgccgacgccagggaccacgtcgacagcgtcgccgggtttcccagcgactgcttcactctcatcagcgcctgcttgtcgctcggcgggcatcgcaccgccctcgccggcgccgccgcgacggccaccgccagcaagacggcgagcatgaaagaggcggtggacgccattgtatctacctgaactaggctcgtgtggctggagctggcttgagtgtgtgtgagtgagtgcgggagtgatgagctctcgagggtggtataaaaagagccgcgcgtggaggcgtcaggatcagtgtgcatgcatgatgggataaacgatacattttcctcccattttttttctctctccctctcatatcctttttttgaccacccatcgaaccgggacatgcttgggctcggggcctcggacaccgagacggccagcggtgcggtggtactacgagcggacacgagaaggattcgcggtgaatgatgagtgaaaacgaatcaatccctgacaccgcaacatgccaaacgcacacacacgcacaggcacagagataggtggtgccgtggtggtgataaccgggaagcatcgccgtgggttcggccacggccggcgcgtgattggtgcgtgcatgattagcaatggcatgtgggatgggaacgaactggggctttcgcccgctccgtgctccggccagcgcccacattgctgggtgcagaagcagaaagcagaagccgctcgctccgcccgcccggccggccgggcggcacggcacgcactcgtattaactcgcggacatgtgcgctcggatctcccggagcctcaagacgggggcgtcgcgtagctaagctagcacctgttctggatacgcttgtctcggttatgatcggcaaagggccgcaaatggacgggaagacagctcgttttccgtgtaagtcaacatgataggagtactagcaatgaggaggttatttaaatccacatgaaacaattatacgcagtttgcaaattgcagccccctctgattgaattcgcatataatgagtatcccgcactaattatttcggatgagaaaaggtcgaagtgcatgttctactgttcgatttcgtagagatatgcattgcattatcgtgtcgcagggattagatcgatcacatatagcacaggcccacgagagacaatcaaggagacgtcgtcacgtcgctcgcactgtcgcaggcggtggtgcatgcatgaatgcaaactgagtagctgaccaggtccatcactccaccagcccgtgaaaaaacgtactagtagcaggaggacggacacagcagcagcgagagccaccgtcgccgcgccacgtactcgcacaagccgcggcccaccacaccgccacccatgcacgcgacgtctctgtccgatcccctgaactgaaacgctgtcacgctggagcgcgcacaagccaaaggtgctccctgtccgactcggcgcgcgcttgcccgtatcacgtcttcagcgagcgagacgagaggaggaggcacgcagcggcggccatgtgggggctaaataatgcggcatggacgtggtccgacagggttcaggccggcacgagagcgcatgtggaggcttgggcggcgaggggaaaagaaaggattctttcggctttctgggctggctgcccgggccgcttgcagctttgcgttaaacctcccccttgtagaaaatgcagtagagatttcggaggtttggaatctcattatgatgctttagaaccaagaaatgactcccctatcatgtttcacatatttatgtagatctagtttatataggatttaacaaagataattcaatcttgcgttgcaatttgcagagctgccttgacgcttgacgcttttgctctgtgctctgcggttcggcctggccgtccagctacgcacccacatgcatcgaccgaactggagatagatgtaccccgcctgggcgctgctctgtccagtctctgcctctgctcgcaccgggcacaccagtttcaccagcgagcgtgcggtacgccagcaccaccagaccagatagcaccgtcgtctctgcgatttctttacgcgaaaagcagggcgggttggttggatcgcgaaaccgatcagccgaggcgacgccgcgacggagagattgtgccagcgtcaagttgcatgccgacgtaacacacttgattttctttagtactgagatttgtgcgaggtactagtagtagtcgtagctttggctctccatgcgattcttggctgccaaagcggtggctgatgcctccgtggtttgttttggtgcgtcgtggtgttcatcgcaggatctctcacgtgttgactgaaaattgttgtattaggtgtagtctccaggttgcagctttttaacgacggggaattataatcagcctatatgggtggtgtatccttttgaattttagtacgtacgagcacatcacacgacaaatactctattactgctacagtcaccagcgcaaacatttcttaacagagatattattgtactatcggccagctagcacttgtatacttttcattttggatcggttccgccctgaacggcattcatctctctctttttctcagtgtatactacagaccgagtgaaaaatagttgcaccgtgcgcgtgggacagctcgcagtaattcttcttcaaaactagtactgctgttcattcatcagatgacaaaatgacaaccagcaactagctggcggcctggcgctgcagcacttggtggcacacccatcacgtgcctgtaacgagaagaaaaaaaaacttactactaccacagtactattctctctaaaaagaatccaattggtggctaggattgagttttcttagacgaagaggttagctggctgctactccttccgtcctataatataaaggattttgatattttacttgtactgtttgactattcatcttattaaaaaaaatttagaattattatttattttttgtgtgacttactttattatctaaagtactataagcataactttttgttttttatatttacataaattttttaaataagataagtaattaaacagtacatgtaaaatattaaaatctcttgtattagaggacagagggagtagtagttatagtactccacgctccacaggcaacaacagtgaatactctccctcacgcatggataagttcaatcgctaacgttcgtagccctctgccccctcccgtccctagctgccctacccggccagaataaccagatgacagccaagccgtggagggcgatccgtcctttgcccagttgcccccgtgcgatcattacctccccagatccgagctgctcccaccctcccaccgtgtcacgatcgaagaactgcatgcaccatgcatccgcgaccgcgacggcgcggcggcaccgcaaccggccgcggcccatgcatatcccccacgcgcggttttgacgagccgcacgcaagccacgcgcaccggcaggttgccggctaccgacgagcgctccctcgcggtcgcgggcgggcggggcgcggtgtgccggtgtcgcggcggaggcatgggcacttgtcgcggatgggatgcgcatgcgcggatctggggagacgcacatgccgcggcggggagaggagagacgtgacgcgcggtgcgggtttcttggggggcggaaatgaattgggggaggacgtggacgctgcccaagatctgcgtagcacgcctgaagtgccgttcccatcggcgaaacgcgaaatgatcgttcgtttcttctcatcgccgcgtcagcgcttcgatgagaaatacttctacaatactggcatgctgctgctacgactaacctaggctcgattcggcaaggctatgtaggagatgatattttgtggtggtatgaacgagccactcgctcgggtcacggcacatgaggtgtatggttgttggactgcagctctgcacgcatcgaggagagaaaaaaaaggctgagagcatgttcttcgctcagataaactaatctctttatgtacgagactcgctcttaaaaaagggatacgatccacatgcgaacagaataagcaacggggaattaatgatctagcataaaaagaccaagtaaagacgggaaatacatgggtggggtttgacgtcgggtcaaagatcgatcaacctgtccgtgtaccacatgtgctaaatcagggttccttgtttatcaccctgacgaaacaggacacaaaccaaaatgcactataactacgactcagaaatcagaatcctgctcaggggaaaacgaaagcgaatgataaagctggacgacgtgtcgacgtttacgggaacttcaaaagagagagagatagagaacgctaactttacagatctgaacgagataatccaaagcggcgagaaaaagaaagcgaaaaaaaaaacagaagagccaaataaacagacaagctgaaaaggctaaaccagtacagtactccattagcgacacagtagaagatcgtagagctctggaccgctaccacaccagagcagctctgtgctgcttctcttctcccctctcacacggccattgtcgacagcgcattcaagctctgcgtttatgacacccaggatgtttactgcatacagtggcacttcagaattcctatccttcagagggaaagtagagtgcatttacagccgaccttatcatcatctcctgatatatgcatctgtacatctgctgtatttgatgtgtggtccagggttgccaatgttcaattttcttacatgtgccgtgtttgatcaccaagatgcccaagtctctgaccaaaatgtattttgataaaaaaagaggagaaattttcaccctttctgctaaaagctaggcagaaactggatacacctgcaagtcccatacagccataaccttccaggagatagcgtcaaaagaccatacaggcatgtgcaaaacgtcctactattattgaattcccagagccaacaaaatgattcatttagaacgtatgggtgctaaatacaaaaagaagatatggttgaatacacatgaatcatgatctattttactagcatatcatatcacttcttgctataacaaatttatatgcctagtctagaagctacttgaattgctggtctgctggattaaccataggcaccctctcaattcttacaggctgatcgacgccgtccacggaaggtttgatgtaaagattgaacacaacgttggtgaatatcgtgaggataacaagtgcaagtgttgagaatgttacatacgttggagaaaattcaggaagttcatcttttgatccccgcccagttatcatatctcggtccatgtaagggtctgtttcaagcaaatcacagttagatcggagtccatctcactgtgatgttaacattgttaagaacaactgatcaataaaccatgatgctgatgcaacgtggtagctctcctaaagacaactggatgggttttcagagcaatagagactcaagatgcaaacattattactgtgtttcaaagctctgtctgccacttttggatggcttcatccccactgaactgttgctgttgtccttaggttcttcataaatgacaatatggcatgttgtgctactgcatacagaagcaatgaagcatttgtccaagtcatgggtgaggcccctataaacgttgcatacttgcataatgtcagaggtttcattaattgagtagtttcagtacagaggactgatccatctccaccaaacactttataaaaaatatttatatttgttgctgagagatctgtcctgccgaccttttaaagctcttgatctgatcattgacaaagttagtatgagtgagcctagtatgttgcataatgcattgaggtctccacgaacagtttcagccgattgaatgatccatctcttctattttaaacatatattccatctccaaatatataggtcattgcaggataactatggacaacatcttaaaactttgatcaatagtatatgtaaaagtagaacactatacatataattttgactacttaatcaatcataatctcattagattttttgggttaacgagcttgagaaaacgaagatgcttgcacgcacaaactagtgtaagtttaccactaaaagttttcagttgatatcaattactgaccctgatgaacatagtgaattgttgatgaaatggacacagcgcacatgtaaactggaaaagcaatttgccatgagcccatgagaggagggacgaggtaggcaaaagcccaacgggacgtacccggtggaagaggcggcgccggcggccgttccctgggctcggaaagcccctccagctgcgagtcgagctccgccagccgccgcagcgcctcctcagcccgcggctcgcgctcctcccccgaccccggccccggccccttctccgacgacgagaaggcgaccacgtcggagcaccgcctcctcccgcttccgcccactgcacgtgtgttatcggcgaggaatctcaagctcgctccgccgacggcgatcgccgggaacgggacgaagcggagatgcatcctcgccgccgcgcacagccgcgatgtggataacgtactgaaggatttcttttcgattttagcgagataataactgggctggatctaagcccaataaggcccattattatctcacgatgggcttagcccaaaatgggcccagttttagcggtcggcgtgggggcccataagatgggatctcgtgttccccaccggccacggccatcagattcgtcgtgtgtagcgaagcactcgacggaatccggaagcgaagcgagcggagaacgccgacgagcacaccaccgccgccgccgccggctcacggtctacccacgcgcgtggaagcggggcgatggaggcgtcgggatccgagccggggcggccatggacggtgtccgccacctgggctccggctggcggcgcggccgtggaggacgccgtctcgttcgagacgtccgccgacgacgcggaggccgtcccctccgccgtcttccttgaacgcccttcccctgatggcgacggcgacgctcctccctgcgaggtcactggtgagtcgtcgtttttgacttggggggtagcttagctctctgggcttgtcagaattttgcgagtttgccgcgggatcgcggtgtttgcgttggtccgatcggatgcaggtgcactcactgttgtgaattttagttttgcagcatctagtctagcttatggtcggataaaccctagtaggctggtagaaccaaccgaacctagtaggctggtagaatcaaccgaagtggttatcgctgttcgagttctagtgcgtgaatcattcatagttatcgttaaaatgttctaatgcgtagagtccatggattggaggtatctgttttagagatcctttcgtaacttgaggaatcgtttcgactttcgactaataccttaagataaaaattatgacaggttagtatgtcatataacggattcatttgctactgtctactggttattgtttgcgtgatactcttaaacttaagcttcttatgcttccatgaccagagcattcttaattgataactgatagtttgcgttactatttaggaaaatatctggctaagtttttactactttagatttgatttttccatcagtggtaagcggtaagtgtagatacctagtcttgtagtgaagctgttgcactgtgaacagtccaagcatcatcgatcatactgaagtctcaatgatgtatttgttcaattcctttgtactgtcaatttgcagaaattggagctacctgatattaggaattcaaacaatttattgaattggtggcatttctttttggaagatgaggattgggtgatattaccacagaaagctctaagcactgtatacttgcagaaattgtagagttgctaatattaggaaagtatctgtactatagtttcgtcatcctcatcaaactactactagtatttcttttatgaaagtaaaaggaactggcagtattccattgaaagttgaaacctttacatggaattctgtataaactacaaagcccatcgtgccgaatttagagtcgattttcttttcattgattcattgtataaatttcaagtcagtgtctcacatctcatagcatatacagcacagtacctagcatgatgaaaatctaagctatttttccatttcagtatgcatatatctgattcacagctgttcatcagttcatttcaggggaaagtatgagattcacagggtgtatgtgcgaagcacagctcggatttatgaaatatactatacaactgaccccaaggatagctctaaggattatctatgcactgtgcgttgtggacctgcagttaaagagccactcccctctgctgaagaaagtatgccccaatggagtagtgatgcctcaactagtgaaaagcatgagcatgaaaccaaaagcgtaagcagtagtattgatgaagatagctgggttgatgtcaaaatcccagagttacatgtggaaaagaacagatctaaatctcaagaacctaatgcaattggagtcaaacaggaaaccactctggtaaagccttatttcttggtttgtatcatgaaagattgttaaatactcaaccataaacttctgctgggagtgctcctattgtgatattagcttctaaaatttttctgtaactttgtttcgctatgtggaatgcaggcacactatgaagcaactgctgagataactgatgcaagcccatgtgtatctctaactgttcgcctcctttcacttcagtcaaaaacatcagtgcacatcgaggagatttacatatttgctgatcctgttgagccaaccaatgatgaatcagaaacacgtcctggaaacatgggaggtagttctttgttggctatgcttgtccctagcctcatgcaaatgtccaaatcaaggaaccagaaaacggacaataaatatttttctgatgcctcaaggactcagctttcccaaggttgtgcaatggcagtgaataatagtccatgtgaaaatgtagtgcgagatgcagagccgtgtagcacagatgatttaaatttcaagtcagcagggatggaaagcaaactaaatgctatagatggcgatacaataacttatgaaaaaggcaaccattatgagctaaaggattccaagtctattctattgcctatacaaacaacagaaaatacacaagctcctttgacaaagaaccagagtgtgtcaaatacagatcagcctgttactcctctcatggatgaaaatccaaatccttacagtcgcattgagggaaagctggatactcttctctctaagatggagaagatggaactatactgctccaggtttgacgatggtatgatgaggcctatctgtagcatcgagtcaaggcttcagcgattggaacaacagtttgatgtgttctctatggagattaagactttacaagcttcttctgcaagaatgacagccccagatggtttatctgatatgattaatccacaggataaaacagataatgatggtaaggctgaaaattctgcttccacaaccaacaggcagccaggtctggttgtcagagcaccagagttttctttagaagaatccttcagttgcgataagtccaatgaaaatgcagttaccttacgtggaccgagcatggtgccaaggcttcttgttaaggctcctgattttgtttctgaatctgagtttgcttgtgagaagcttcatgatgggtctttctcaccagttgattttgctctgtcttctgagaaagaacctaaaacttccccaggtttagttgtcaaggttccagaatttccaaatgattcagatgatgaattggaggaagagaaagaaacagaagttggtgatcatgatgatggtcatacaaaatctgatgctgctttgagtgaaagcactgttgacagcttcaaaagcaaatctcatgtatctgtcgatggtgctctagcatcagccttggaggcacttcttggttcaaccaagaaaacaccatcttcgcaatctgctgcttgccctgccagtaattcaactgctgaaaatactactgattcttctacctgcccattttcttctgaacaagttgatgagacatccactaatgatggctcggctggccaattatctggtacattcgttgatgcaaataaggtcaataccttcatatcttgtgaggaagcagatgcagttccacaaacttatatctctaaggcaaacttgaaggctgaggtaaacgatctgaataatgttctcgatttgaacatgatggcatttgctgaaagcacagaacccttgtgtgttccacagcttcacacagttgaggaatctaaagatgttggaagccaagcaaatctaaagaataatggctctagttcatacatgatgcaatccattgcaaacactgagcacatcatcgctccttctcagcttcctactgtcttggaatctattaatgatggacaacagttgaatggcaacagatctaccttgtccttggcagagtttcttgtggcaagaaatgctaactttagtaagaatgtgatttctgaagcattatctagtaatggtggtgctgaaatgcataccttcaagagaacatcgatggaatctgctaagaatataaaggatatcaatcaacttctgctgcagaaagctctagaggttaatgaggatgacagtgctaagttttctgtttctggtgggatgaactcttgttgtcttagagcctttactgattccaagaaaagatgcattgagagcagcggcttggaggcaagcctcaatgatagctttacaaaatcagaggtagagcactccttgtcagatttgtgtagtatggaatcatttagtgcagaacctgctagagaagctgtcggctcaggtggtgtcacagctggaaattgtgttgatgatccttttacaggtagttctactgtaaacccaactgcaggcgaagagctgcaaaaggtgtgtgacttgctttacgagtacaatgatgatgttttaggcatggctttcgtggcaaagaaaacaagtaagagcagcccttctctcgaagtcctacttgctgaatcatctgattcggaagcggaaatttctgatgcgaaggacactgacaatgatgctggcttaagttcagctaggttgtttagtacattctcgtcttcagatgatgaagctcctcgcactgatgaacctataattgatgtagttgatctgccaacaccattggatgcatatgcttcttccaagaacgagctggttgatgatgagtctttgcttgatatggatgatccgccaattcctccagagtcgtatgcttctgtcctaagcgacatgcatcatgcatgtctaaatgatcaatcaaaaccttcagggacattcgctggagagggcaatggagagtatcctgacagccttatataggttcaatcaacattgtcccacttgttagaaataagtcgaacatactcaaaaagcctcagctgcactactttttttgttggttttactgtacatatatcaacgtttgcttccacgcccatgcggttttctgtacatataagacttactgtgagtaaacaatttaccttttggtattacctgtgtacacttatcacctgtcctttcacagtttcactgctggccattcaaccttaagcagtcagcaagtaagcatcacaagaaaaggctgaaaagcgcccagatttccactctatacagttaccatcttgtgacttcgtcttttcacgtggttgacgaatatcctgaactaccagagaccgactcatcattccaaaccaggtatgacttattatgaggtaaattatgttcaccaccgtagagttggattgcccgatttactgcaactgtttcattcataccttctctgatccactgtaactgctaggaaatttctttctttctttctctaatcatgcaaccaggtatgtctaatgttcaccgtagagttggattgcacgatttactcgattgtttcataccttctctgatccttgtgatccactgtaactgttaggatctttctttctttttttcccctctaatcatgcattcatgcagccacttatttctagcaggtcagtttctggaacacgccatgttacgtgatgaaacacaagaacagggctacataatgtacacatgtgagcttgcttggcgccccagcggtctgcaccacatggactaatccttaattcctcatgccatgggccaggtgaaatcgtcgtcccacacggtacagctacagcattaacactgcagccggccagccttcgccatggcgtccaagttcaaggaaagcatggattcgtatcaatttgcggctcaactgaaaaggcgcggacgtacagaaatttcaggtatggtcggatccaaacttattaggattggtcgctttcttattggatgatactgtgcgagattttcccacaagaatctgtgcgtatacggactttggaatagagtcaatgcaccgcgatcacaccatcacttgtctaggagcactttcactgtgtgaccatatccaatctaaacagaaatatagccacaagaaaatgtaggggggtgctgtttgtcggaaaacacccttatcaaaaacattggtattatcaaactttggtacgataacaaattgaacaatgaaacagctccaactatcatagcgctaccaaaatttgataatttttggaaccttacactaaatctggtaagacctcaaaccaaacatcaccatccctatcgttaccttaccaagtaaagcaaaacttgttaagattattttggcatttctgccctttcgtccgtcgctcttctcatgcggcatattcgactcttaattactcggcccagacccaacgctggccttacaaatctctcgtttatcaaccatcatcaataaccttatcaaatttggataattatagaactttgcattctacatcaaaatctgataaggcctcgaaccagatgtcaccatcacatctttaacatattaaaatttggtaaggtttatttttattacaaaccaaacatgcgcataaatctcatcactctcttcactgtgcccaatttaaacggaatattttagtaagaagaaacatcttaatcttaccgcacaatggaatctgaatacggcttcagtttaactaagttatctgaatacggcttcagtttaactaagttaaaaaaaaactcgaatactccatattaaaaactgctataaaaatccagagatcagttttttttttaaaaaagcagagatgcagatgatgggataatccaactgtcgactggattgcaaatggcactttcagatatactggtaccataatagtactgtttaataactgcagttcctctcgaagtctcacctttgttagtgtgagagcgagctgatgtgacatttgacaaacaactcaatcctcaattcaggcactttgtcctcgatgtgttatttacagctacgcagtaaactcgtcaggacaatatgaaagatcaacacacgttctaatgctcaaactcaattattcaaagtgaaaccgccaaaccggtgggtcacatgccggaatcaaggcggtagggttcagtactctatgctcaagtcctcttcctaaatggtgcattcatgtccttttgtcaaaatattgttaagcacttatgaagccataaaagaagcaggacaaggtgccggactgcagagaaacttcactcgtactcctacatagaatgaagtgaaggaagccactgaaatggtggtcaagcaattacacaaaacaggtagctccatatcttgttcatattgacatacacaatccttgatgatgacaaaaaacaaattacaggcagctcttgtccccctcaccataagctataaggggcagagcaccatccaacttatgctatttacttgttctgtctgtccctcccaactttgcaatacccttatcaagcacaagaaagtaaagagaacaagaaaaaaagaaaaaaaagagaggatatgatgacagtacatcatacatgtggatacaacactaaaacgagagttccacacagcaaccacatcacagcactgatccctgcgtgtgaagcgaagcggtgaacgatcagccgccggcgccggcgacgacgacgacggcgacggcggcgagcaaagcagagaggaggaggaggaggggaagagggtggcgcggtcgctcagaagaaggagcgcttggatggcgccctccccacggccctcatgaagttggcgagctccagcacgcgcgccaccttggtgcccctcttcgcctccgccgacgcccgcttctcctccgccttccgccgcgccttcgccacctcgttctgcgccttctccatcgccttggccctcttctcctccagcttcctctgcaacacacccccaattccatcagaatccagagctcgattggtagaaatcaatggcgattagatgatggatttcgttttggtttcttgttttacctcgtacttcttgagccaggcgttggccttctcgacctggtcgccctcccagccattgatgacgacctcctcgcgcttgaagcggttgttgaccttggcgacctcggcgatctgccacgcggcgatcttggactccacctcctccttcttcacctgccccaccgacacctcgtcgccgtggccgccgcccgccgacgacacgtcgccgggggcggggagcgcgaggtgggcgcggcgaggggacgggatggggttgctgtccgggacgatggcgagcgggttcgtctcctcgagctcatcctccccgatcctccccagcgcgtcgtccaccccggcgcggctggagtcgccgccgttcgcggctgcggcggcggcggcgttggcgttggctgctgcggcgaccatggccgagaactccctgctcatagtagggaagagctcacttggggcggtgtcgctccccacggagcggatcgacgtgtgcctgctccccgccgcggactcccacgactccctcctccgccggtggtacgacgacgacggctggctcggcgtcggcgtcggcggcgggctcagcgcgtggatgtccctgaactccggctcctcgagctcctcctccaccaccacctcctcctccctctcctcacccccgctgcttctgacgacgatctcccggccggtgctgatgacaatctcccggtcgtcggcgccgcggctgctgctgctgctaccactagccgccgtttgttcactcaacatgtgtcgccgccgtgggtgaggtcgtcgtcgccgtcgccgccgccgccgccgctagtgctcagccactagcacacacgcgtaaccatcggcgtcttgctcttcttcctcctcttcgcttctccgagctgagctgtggtggtgagtggtgagtaggatcggatgcctagcttggttaaataggcgggagaagagggggaggtgggcccgggcgtgtcagtgtcgctgagccagtgcccgccattggaggggcagtttgggtatttccgtttcgatccccatttcgtgtgccttttgggcggcttcgtctcgctttctgattttggaggggtctgtgtgtgtgtgtttatttttggggggtaaggtttagaggttagagtgtgcaaagtgcgctgactcacacaatcatatagttttaacattaacaagcgccgtatgattattttttccctttgattagtagtacaggtttggattggatacgtcacccattttttagggcaaagagcgtgaaggttctagccttctctcttcctacatgtttagttacgtacttccactgtacgatcatgcgtcgccgtaaaatattttaaaatggatcgataaatattactcactccgtcccaataaaaatcaggaaatcaatctatgttgatttttattaggacgctaagttactttttatcgagacggagggattagttgttttttaatggactagattgatgttctaaatagattaattaatataatactccatttaggggcgggacatacgatagattatctaattttgtgatgataatcgactatacaaacgaatgaattaattgtgaaaaaatagataagttgttctaaaatattattctaaacagtttatatatagaaagtttttaaaataccatgtttctaaacttgtaaaacgtgtctacgataatctataatttattgaggaaaagaaccagcctcaaaccaattgctacatgctatagtggtttgggtcaggcggtgatgaggacatcctccactattatccgctggcagagacgctaaagtcgggcggcgaccgtgtgagcctctgaataatcccaccttgcttagctaatcccaccttacttagcttagaaggaggaagccaccttaaaaaggagagccacccttcccctaccggactagtcttttagggagattgggcctttccctgagtgggtgtgctaaagaactgttggggtccggacaaccttaagttattgggcctcggccgaccccacctgggccggattgttatcaggcggccgcaatgaccttacacaaaatatatggttaaatgaatataacatcattggcttcgacataaatggtactccgtttcaggtcataagatgtctccgtttcaggttataagatgttttgactttagttaaaattaaattgctctaagtttggctaagtttataaaaaataatattttttacaaagataaatttattataaaaatatatttaattattaatttaataaaactaatttggtaatataaatattactatatttacctataagggcccctttgaatcgcagggtagaaaaaacggaggaatagaaaaaacgcaggattctgataggaattgaagtgtaaaacagaggattgcaaaacacaggaaaaacacaggaatggtcgtttgattggagcgcaggaaaaacgcaggaatcggatgagaaagatagactcaaaggaaattttccaagaggttggagctcttgctaaattttcttcaaaatccacatgcaatgtgccattccataggaatttcataggatttggaaagtttcaatcctttgaatcaaagggccaaatagaaaaatttcctataggatttgaatcctatgaaattcctacataaatcctttaattcaaaggggccctaaacctagttaaacttaaagctgtttaactttgattaaaattaaaacatcttataacctgaaagccacggagtactactcatatgatgtcagcgactcagcgtatcaaatatacacatatatacccacccctaccgaacgaactacaagtcggtataaccggcgaaccttcgagtgattctgccgccgcatgcaaacgaagggcctgtttagatgggattaaaacttttaagtccctatcacatcggatgtttgaatattaattataaatattaaacgtatactattaataaaacccatccataatcttggactaattcgcgagacgaatctattgagcctaactaatctatgattagcctatatgatgctacagtaaacattctctaattatggattaattaggcttaaaaaatttgtctcgtgaattagctttcatttatataattagttttgtaagtagtctatatttaatactctaaattagtgtataaagacagggactaaagttaaatctctggatccaaacaccaccgaagtctcgtgcactcctgtcccgagagagttcagtcaaacgcattcccagcggataaaataaatgaagatttggtgattaggccgtgtcaacttcaccccccccccccacccccaccaaaaaaaaagaagatttacgattcaaatgtcatcaccgaattgtttactggttacttcgcgagcagggaggcggtgagttacctacgtagtacgtgtgtgctggtttagagcaacgttgacagcgacgttttattaattcttacacacacgtaagaggtactactaccacgtctcataataattcttacactgtttgaccactcgttttatttaagaaaatttagaattattatttattatttattgacttactttattatccaaagtattttaagcataattttttatttttttatatttgcataaatgtttttgaataagataagtgatcaaacagtgcaaacaaaaactcaaaatttctcatattactccaatttaacagaaggagtagtaattatcatcgtttgcatggaggcgatgggtaatcaaaagacgtggtcggccgcggttaaccccgtctcgctgtcacggagttaaagcgggtgtgtgttagcgaaagggggttaggattattttgaggccgttgcgaattagcggcggagccgtgtggggcccagcccgcttgcattatcctactactctattatacaccgggttaggcgcagacaaggtgggcccgggggtgtctccgcgggtgggccccacgggtggagatcgacggcggagatgcgtttggtgtggtgcctgtcagagatcagaacgaacaaacccgtcaggtgaggcgttggccgttggcccgactagatagatagggggtgtgccactatgg

SEQ ID NO: 70847 - DNA, 22065 bp, Oryza sativa
  unsure (1)..(22065): unsure at all n locations
aggtattattttgtaccttattcgacgtattagtactcggataatttatataggcctatcgcagtctgggtcgtagaaacattatgtggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctcagtattgacatctccttggtggttcctgggaggaaagaatagatgtaaagcaagcaaagttagtaaatgttgtgagaaaataaggattcatgtaatcaaaatattcttaccatgaaatcgtcgttaagaatatttggacaaacaaagaaccttcgacccaatgttgtaggatttatggaacgaagaacctgataacgctcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcaagaacgggattttctgtatcgacccactcgatgtatgcgcaagccgtagtgcgggtctgccgaatagagtagtgttacgaagaataaagcgattgcccatacggaatgaataagcatgtgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcatatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatctggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcagtgatgtcgaagaggaaggtggaaggcaacaagtggtccgacgaggacccagcatggtccagtggtggaccctgactcgacgtgccagctgcctgtgacgaagtcccggtgtactgccagaactgcgctgagtgcgaggtcgacacagctgcctgagacgctgaccctgcagcctgggagaagtgggcggcctgcgtcatagcgaactaggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcggcaagtgaaacgactcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgaccccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcaaggtactcacagcacgagcgaagtcctggttgcggtgcctggcatagaggtctctagtgctcgcaacgtggggctgctgctccaagggagcgaaggtgaccctagtacgggtacgtggctggtaccagcgtaggtaggcctggtacgactcctcagtgtgtggctctccctcgtggtccacgacctcctcggttgcgagcaaccagtcctcaacaaaagtcgccagctgactgctgacccttgcgcgagtacctgcgaattaatgtgtaatattagtgtaaaacgacagatgttacaaattattgtgaacaggcagattttaatgcaacaacggaaagcgtagtgcaagatcttactggtgaacagcagctgggacagtggtcggaaacggtactggaaagggctgacggaagccgaactgccgcatcacgcggaaaggggcatgaggctcaacgcagatgtcgaagaccatcggaaccgtagtcatccagtacgcctggtccctggtgcagagtgtggacagacccaacggcgcacgagcctgggtagctgtggcactgtagggctcccacacgacgtcagtcggcagaaggcggtcgaactccataacaaactcaggatacgaccgcctaacctggacgtgagcccatcggcgctgcaataggagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcttctcagctgcccagatagaaagaaagagagggcacccaccaaaggtcgcgctgggatccgtcttcgtgcaagactcacaaagtgcacggtacagagccgccaacaacgcggaaccccagctccactgaggcacctcacctaccgcggcgtcggcgatgctcctggcgtagtgcacgagtcccttgtcgaccgcgtgcccgtgaccgccacagaacatcacccagccaaaaagccagagtaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgaacgggaggtgcggtgcgcgctgtactagtgtgaaacgtgccgccagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggccgcagcctccaccagccgacacattggtaggaggccggcctcacgtagcctgcaataacaaattaatatgtcattataaaaaatattacagtgcaactaacttatagtaaaacactgttcgtacctctcgacaaaagagtcgtgaactgggagtagctcaccgcacgtgcgtgcccggaacgtcccaagctgagccccctgcaccgcagtaaggtgagaccggtgtccgtgatctatcgccgggtccaacaactgaggtgtatcctgacgtgccatctctgaaaaatatagtgtttcgtgttagaacaattcaaaaaatagtactgtaaaacaaaagatagcttggcaaaattatgaaatagtaataaatttttgaggttaattatgtacaccaagagtacaggctatttaaataaagcacacgttactaatggtacataccgatgacgtgcaatttaacatatatgtagagttcaataatataacataccattacgtgtcgaagtccgacatacatcagcatacctaaagacgttaggcgccttagtccgacgttacatcccgagacctaaagacatgacatgccgaagtctgacattacatgacgaaacataaacacatcgataagttcgaaccgaattacaagcaaatccacatgccgacatagaacataagatctacaccacgtagccagacgcggcacgactacgcctaggacgtggtcgagtggaggtagtgccttcaccctttagggcgagctccatctgctactgatcctaatagtcttgcctccgccgcacttggtttctccttgtctttaggacaatgcttgtaggtgtgcccatgtcatgcattgctgcaacgcttaaccatgccagcctccgactcgtccatatcgttgcggatgcgatgagtcctcctccttctagccttgcctcggagtttcgatgggtcacgaatattgagtacttcatcgttagtctctgtgaactccccagctatgccgaacccataaatctcgccgctccatgtatgatatattgcttgcttactgaagtactgtgacacatatactgcatctggtatgccacactccgctgcagcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactctactatgccaactagtggcagtccacggacaccgcgcatcacccagttgtaaatttctgccaaatttgttgtcattattccatatctagcaccacctgtgtcatacgccttggcccatttctcttttggttcatgcagaatccactgagaaagttttcgaatctccaatccagttcttctaaccaatgttggactatccattgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacactggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacaaggcttcgtaagttccaaatctcatctctattattttctgtttggccctctaggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacagcaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctcgctgaataacctcattttctttgtactcccatctcacactatcctcttcagagacgatcagcccagaaaaatcctcactagcccattctgctggattaatatctgtctcatcatctgacgaatcaccttcctctacacgctcattgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgctatcatccatgttcgtgtgcacacctggatccttcgggtgaacaaacggaaccaaagctagaggccacccgcgttgcaatgcattttccaaataccatctccacactcgagagttttgaactggcattagttcccaataaaaaccctcagtgcccgacttactataacattgattgttatgtcacttgtctgtggatcaactctcaagcccctcattaaccatcccgttatagaaggtacactcctctcagccgggctatcaattcccctttctgatacaataaaatctgacagatctaccccaggtggcccgtaacggacgtttactggtccatggtaaacttggaatatttggttgttcgacatatctgtcaacgaaataactagatcatattactctttcatgcaataaacatctacaacgtaatatcttcttgtgtaagccaatgcaacggtaatgtattaattccaaactagcagatctacgtaggtaccgatatctacaatacgcacttttagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccgcctgcaaaataaccggccccgactggcttttttgcattcgggccccttgccgccccaccagagggcggcaagggttttcttgcaaaaaaatcctccctccgtcaccgcccgttcctcccccgtttgccacgtcagcttgccgccccagaggtgggcggcaggggctatttctacaatttttttggtcgatagattatttctgtaaatattaaaaaaaataaatctaaaaccgaaaaaaattcccaaggaccatcgatgcatgggccgctttgtcaaccgcgcacaagcaggaacatatgggccgttgaattatggaactacactttgcttgcaccggcctaatagtctaataatgttctttctgggatcatctataaaaaaaatgattttgctatatctcactcgaaagatttttttcttatcgctcacttgattttctcactcaaatttacagtttatttttttgtaagttacagtataatttttgaatctttgcataaaaattttgaaatttatattcgatttggtctttttcttgatgatatggtaatttagtgtcgattattgtgtttttagttgctttttactttttactgtgtctattggattttaatataaagattacaaatctgtgtgatatgttcataaaaatattttgaaagatgcataggtactccctaaaaaattgtctcattccgtcaaaaaaaaattgtctcatcacaatgacagtcaatagcaatgcccaatggccatgctggcgtgaactttctccctttttttaacccatcttcggcctctgcactatatatagctggctttagtaacattgtaactatggggcaatttcgatgattgtgatataattggtcacaagtcacaactcacaacatactactgtgtatgtaactttatgtccactatagaccatctacaatgtggtggctcattgatgatttatgtccacccatgataaacaggacacgtataccaagttagtaccaactaggaatattttttgaacatagcacgtatgcatattctacctatatgactacatctgagagaacataccagtatatcttaattaagatagataaactattaaaataataactaaccataaatatatacaagcatccataggctttatttctgagtgagcattccaccaatttttaaagtaatgctcatcgtttaggccggtgagtgacatttttgttcactgcgcattcacctttggggttcttcgcatctaggtagtaccaggacccttgtgcctcggactgcaccgaccgccttatgacccatgctgcgacgagacgtggacattcctcatgctgcggttcccttcggtccattcccgggttgggttaggggaagatccgagcgattgccttcacggacgcggatcgagtatcaaagaaattaataagcaatggaaaataataaaaaaacccagaggtttggaaaatgttgtgtgtcctgtagtgtagagcagcataaatcatttggacaagatcagggaagtactgatcggtcgatcgatggttgcatggtcccttccaaccaggcttggaccccttctttggaggaaaaagacgatttgctgttcaccaatgtgctcatcaagctagctagctttgtgggggttccatagctggctaatggtcggtagagcatcaatttttgtttcaaaaaatggctaaagttagcctagtaacttaactgtcctaaaagtggcagaaagctatatatacaactagtgataatattatattgtaattaagctgatatgatctacacaaaaagtgtggctgatatctttcatcaattatcattggctcccatcctaccttgttgattcgctctgacgttaattagctagcatcatatatatttatcagggatagctagttgctagcttaatatattgcagtaagtaacatgcatgcatgtatggggatagatccctttcctaaaaaaatatataggttaattactaagtaagatgtgtgagaatatttgttcatatgtagcttgtcgatatccttaatttgcatggtaccttgtgatagcgaagaatatatactctgccctttcgaatgatcgcaaatctaaatattagtacgccccccttgcatttggtataatatctcttttttaaaataaagatctaaagaaaggcactagttattgttcatcccttacagctcccatagacataaaagcatcatcaagaccttaattcaactcaagctcaatagctacatcaaacatgttccgaaggattttacaaaaatttcagtaaaagccacacagcagctaaaacgaacattttggattggtgtcgatttatgccctaccaacattttggtagttccaataatgacttattggttttgattttggattaaagccattttttgtccacactaaattattgctcgtagcaaattactataccaaatttgatagtaccaaaacttgcttagttttcggcaagctatgtaacataagcgcttacaacacgtgcgcacacactctataatatgattaagtcatcatagacatctcattgtatagaacttaaatccggatgaatagattccaccacaagaaaatctaagatatactccaacgcttcgacaatatgaattagaagtctatctttggcagcatcttgctggtaggagtataagcataattttcctctgtaatccaacctaaaaagtggtgtgatcactgcaacttgttggcagcataataatacatactctacacattaaatttgggtaagtttgggtttttaatatacagcaaaatcaatcatgctttcatgcatgccaatgtagccgcataaacagtatagaagcatgtgtgcagcaacaaaaactgtgggcgctctcaagtatggactagctagtacctgtcacttttggagagtggtatgcagctcaatccaaagctggtcctaaaataatggtgattaggtgcaagatcggcttctgtagtggaccaatatgctagcctaagaacaagatttggacatttgatttgatgcgagcagtggccattggttcagttaggtttgttgttttttgcatgcacatgttgactactccagctcacaagtaaattaatgaaaagatcaaggtagggcttctaggaattcagtgtgttaagataaacagaggtctactgaggatttaggcacaaagcagcatgtatttatggactaattgcaatgcattctaacgagactatactagtgttcatcgatcgtaggtggcccgaagttgttcgcgttttcctctcgaattaatgtgacactcatatagctcattcaaatatataaatacggaaaaaattattcaggatactctatatttatggtatttgcttaggacactctggttttgacataggacactaattatatggctctttataaagacactttgattcttatcttaatatatccccttctaatatagatcgagataaaactttgcaaatgatagttttactcttgaggcgaaaatttaaaatttgaacgcattttggctaagcgcttgtttagtttggtgctaaaatcaaccttatcaatatttggcattgctaaattggcacattttgatagtgttataggggtttaatttgtagccttaccaaaatttcgtagtgttcttatgagagtaagtttttggaaatatgagaatttggtagtgtgtcaatgacaatagaatgtttggtttattatcttatcaaattttggtaatgcacaaaatctgataaagttgaaactgataacaatctgaacaatcccaaattacataattcaaatacattcatttttttttcaaagaactaataaatttgaaataatgttgtctggattcaaacagctcttagaaaaaaaatattcttttatttccatagtttgtgacaacttttgattttgcagtttatagaattatctcaaatgtatttaaatgtgaattgtacaaggtgatccaagggtaaaatattcctttgtgaagttttgtctcttcattgctgatgaaggatatatgaaaataatggtcaaatatctttattagggatattaattattaccgatattgttgtacataccttgtttagttgtttaggctatcgagactgtgcttttaacccagaaccataaagtgctctatggtaaaatcacaaaactagcatatcttagagcaaacatcacaaatctaaagtgtcgtagagcaattttacctatataaatattatattcgtacgtactatttgctaggaacgatggtacagtgtattataaaaaaataatctgagaaaaactctagtcccctcaaatttcaaaatcttcaaatacataagtttgtggaaaactaattaatttaatctgaggctacgaaattatgcctcaattaatttaattcctgatgaagagcagtagagcaccaatttaccaagtactccacctatccgtaaaggaagtcgtttagaacaatgtttaagtcaaaccttgggaatataaatcatgaataactctcaagttgttgagtttaaaaatataaaaaatatatgaatagatttatcttgaaaaatatttttataaaagtatacatatatcacttttcaataaatatttttatagaaacaagaaattaaagttgtgttttggagaccgtgtcactgtgtaaaacgacttcctttacgagtacggagggagtcactgtgtaaaacgacttcctttatgagtacggagggagtacagtagagagcaccgcgcttataattcataatttgctggtactaattaattttctaaaaaaataaatttgctggtgcctttcgccctgcaggtaggcataacgcaacagtagttaagcatctttgatttattggtacagatcgacagaaagagcgaaaggctaaccaacctatatcgatcaggacaggaacacgacaaatgatacctaacatgagtctttttttctctaaaacatgggagtttacactatatgtacttattgaaatttaaaagtatatgcacacatttatttataatttatggtgtcattggtatgtttaggtaatgtaagtgcacccaaagacagggttgaagccagcagccgaaattatcaagggggttattaactccattgcatggtatggtgaatcttgaatcaaaatagtgtttcgctagaagatttaatttggagtttcgcaggggtcgctgaccccaacaaagactagtttcgatcttatatctacaacttatgtacagagaatatgttcaggtattaattaattacctgcaatgttatatggacatatgtatgtgttttttcactttatattttactgagctactccctccgtttcataatattgtttaaattcattagtatttatatgaatattgacaataataggaagtcttatattaaaaaatagaagaaataattaaggttcacggatttataagtaacacccgtctgcgagagcagatagagtcgtgtgtacatgttcggcgaactaaagacttttgtgcacatgaacttgttgtacgatacgatggagctgagtcacgttaaaatttaatcagtcgtgttaacttaatttttgcgttgatagtactgtagtacatgtgtacgggggttaattagttaatattgagagcgagctgattgatcgatgttgctgaaaatgcaagtcaacccctttggcggaaaattcctctcttttcccctaacttatgtactgatcgatatggtattttgttcttgtacgttcggcttgctaagagtcaacaagcgcatgcaatggccttttaggaaattaatatacttttctttctggcctaattgaggatacatgcatatggatatgctgctactcttgtgttatttgtgaagtacatagtatacataatttttaatatgtttatttaggaaggacacaaataaatgagtaccttacgtataatgtattgtatgttctcctgcctatgtcagatttatgtataaaaaaaatttatttctgttccagagagtatttgtgcacccagcgtatttatggattattattctttcattgatatgtgatacatatccattgatagtgaggtatatgtctgcaataaatttatcagttttgtaagatgtttgcgagtttctccaagatactaacttaggagtatacagctaatgtgtactctcccttcgtcagaaaaaaatcaaattaggagtatatagctaatgtgtactctcccttcttaaaaaaaatcaaccaatttaatctgtatatgaggtttttcggatttattgttgtaggtgttatcaaattttcatctagttttttttttgcgcgtcctccgtatcaaaatataagggattttggatggatgtgatatattctagtacaatgaatctggacaaggagtcattgtactaggatatgtcacatccatcaaaaatcacttaggtagtgtttggtcgcaaggatgggatgggatggggtgaacccacttttagaggtgtttggtttaggggtgagtgggttgggttggtccctgcagagcaatatttctctcaggtttgggaccaaccgatccggtaaaatcaactggacgagcacacggcgtgagccgcgccgcttcacnccgttcactcgcaccgttcgcgctcgctcaccctactagcctgcacggcaagcgacggattcagtaacgccaccctctagtgcgtttgcggtgacgacgacggcgggctcgagcggtggcagggggctcggtgacggcagatccgacgatcgggatggttgtggcagcgaagacaatggcgggcgagggtgagtgctctggtggtggcggcgacgatgacgatggtcgttggcggcgccgtgcggccatcatcacactcctccacccacccggctgtcgtcgaggcagagcctccacttgctaggccgttgtcacacatctccgcccgtcgtcgtccatcttgcaagcccgccctcgctgctcttcctcttgcttgcctgcccgccggcccatctcacttgccgcccggtcgttgacggtggttgcaaacggcatccatcccatctctccctcgtcccttcaaccaaacaaaaaattgggatcgtcatatcctataaaccaagggcctgttcggtaggccgactgcgacggctgcggctacagctgcgcacagtgagtgcggcattattcgtgccgattgcggcacaatcgcagtccaggcagccgaatagaccccaaatatataggtggaatcatcccaactctaaaatcaaagatggtttcatcctatcccatcaagttccaaaaccacacacatgtttatattttgggacagagtgatgagtggtatactccctccgtcccagaatataagaattttttgggttggacacagttattaagaaagtaggtagaagtgagcgatggagggttgtgattggatgagtagtggaggtaggtgggaaaagtgaatggtgaagagttgtgattggttgggaaggtggagaagttgttatattttgagataaattatgatggctaaaagttgttatattttgggacggagcgagtacattaagggcatgtttggtacagctctaactcttaaatttagcttcaggagttaggtctgaaatagagttgtgaagctgcctaaacccagctctaccactccagatcattttgtgagagagcttcactcagcttcgctcctatttttgatggagctgaaactgtttggctgagctccagctctaggaggggtgaaaatgaagctggagctgtgccaaacagaccctaagggcccctttgaatcgcatgaatagaaaaacggaggaatagaaaaaacgtaggattctgataggaatgaaggtgtaaaacagagattggaaaatacaggaaaaacacaggaatgcccgtttgattggaccacaggaaaaacgcaggaatcggataagagagatagactcaaagaaattttttcaagaggttggatctcttgctaacttttctctaaaatctctataggattagccatttcataggaattttaaaggatagtataggattcaatcctttgtttcaaagtcttttatagaaattttttctataagattgaaatcctttaaattttgtacactttttctacgaatcaaaagccctaagagttgagtgtatgatgtgggtgaatgtctatgtctacacgtttgtactgctcagttccggtaggaatggacagaggagcagcagcccacaacggccaacattgcggccggcgaggcgacccgacccatgccaaatgcgtgacgtgacggcggcctactacttttaacgcctcgagaagcgtggcaggttggcctcgtgggccccacatccccaagccctcgaggccatcgtactgggcccacctaccagagtcctggcgtatcagaagatcccgtcgcgtcttgtcttgcaggcatgcatccggcgctgctgcccacgtagcccgccggtgaaattatcgaatagccctccgatcatcctgcctcacgaggggcaatctcacggaagcttggagggcatatcgggaaagaaggaaaatacagtatgtatacggggctggcacactgctcgaggaggtactatacgttctatctactgtataaagagggatggataccttgtgagcagagggatgaaggtccacttgtcacccgttatctgaagctagaatgggtaagcagaaaagggaattaatggcaatggttatccgggcgatggccaatcggatattccgtggtatcgatcgattaatcgatcttcgagaaaaagggaaaaaaaagaaactgaaggagcttgtcggaaaatactgtacacactatgtttgtgttaagagtctcgctccggtgctttctacttggagtagaaattaatccgtactgttaatcgtatttaatcgtagggttgagatctagttctactcccaccaaattttattggagtagaaatgtggagggctatatttgttcagagataataattcgcgtaggggtattatcgtaatctgttattatctaactgttcaccctttccctatcctatcctaatcgacgccattcccctccattcgccgtcgaagacgaaggccagcgtgtttatcgtctgcgtgccagcgacgaactgatcgatttggagacaatcgtcagatatgttcatgagaaaaatgtttactaatctctgaagattaatctgttcttgcttatgatgaccatcgtaccggaacgcctttgtgaatggtgctgatgacggcggtgtcgctggtgaaaacgccgctaccgaaccacatgccggcggcgaggaaggccgtcagcccaacgccgaggacgacggtgagctgcagcatgcgggcggtggtcaccgccaccttgtagtgatccttctttgcaaacacgctggcaagcaaggcctgaggttgattgatcaatttaagcaaagttaattaagcagccatgcatatatcatcggaatgtaggctaagctagctaggtaggtaggtagctagctcacctggccggcgatggcgaggccgtcggcgaggagcgacatggcgagccagacctgggcgcagatttggaacgccgccatggccgtcgcgccgtggcgcgacgccagcgtcacgcaaaacgtcacggccaccactctcgtcaggatactaggagattacttacctgctctttaaaataaacggtccagatgaattctactcggagtaaaatacttaaagtacattgcacaggagcatctctcttgtgttaagaaaccacaggtgatctcatccacccaaggaaataagagcaacggttcctaatctaaccagtagataagaggagatcgctcctctctctccctttggcgtccctctcgacaaccgatgcgatgttcccaaacattgcgtcccctgcggttgacaccgcttcacattgtataatgtattgttgattaatgagaaatcgatccattcgctctagtgtgttcaattctctctctcgctcaatctctctcgctccaatcaattctattcacaatagtttgcctaccatttcagtaacgattaaacgccccaccgtttaagtggaaaaacaatctattttatgtagtatcaaaagttgcagccgttaataaaccgtaggagagggacgttcgatcgtaaacattagatcgtacgtatagtaactctcctgcttatcagcccaacaattcaccgagagttagcatgtcttttttaatccaactggtagtacgtgtactaattttactccctctatccaaaagttttaaacatattttgttttctagttttttaaataagattcgcatatttatagtcggtacgtattaaggttatacaaataatttactctatttaatcctccctcctaaagcataaaaatgtttggtgtttttctaaagattaaggaaatgtgaagtaaaataatacagtcgtgattggttaataagagaaaattgatagaaaaattaaatgagagatggttataattgattgagaacttagaatattttgggacaaagattaaggaaaccatccttttcttttcttaatcgttcctcctatatatatttcgtcccttttcgcctacccctatagttttccttccctcctacaaataatgatttttactttttgttgtgtaatgtacttctactatttgggtttatccaaagacaataaacatgctattttttccctacctaaacgactttcttctatgctgaaaagggtagctagaaagtgggaaagagaatacatgagtagaaaaggaacctttcacatgattgatagtggagacggttatatatgtgcgttagcaataagcttcaacttgtgccttttgcttagccaaaggaatgcactcaacttgttagtccgatcctagccgtttaattcctctttcattcaacctatcaaaaaaatgtaaaaccctttaactttgtttttgttcgacaagagaacaaactttgtcgcttgctaaaatgtttagtgttcctagaaatataattaatgtgccttccacttatatttcagggtttccagtattataaggtgtcaacctatctctttcagtgaggtagaaccaacaatatacaattctataaaaaaaataaaaattgctatacatacgacccaactgtccgaatcacgtatgactgaatttgatcaacgatggtaaatggctacagtgcatatgaacatgctcttctttgattgatctatgattgtatatgagttatatatgagttatacaactaaatcgtatatacagcagtataaaaaaagggttaggagaaatttctaggatgctccatgaaagtttatatgcaaatacttctctctcagtgaggttgaaacaactatatataattttgtcggaaaattaaggagaaatttcctggatgcaacttgaaaatttacatgtaaatgtcaaccatattttgtggaaaaatattatttgtccattttccatgaaatttttattagtaatacaaaggatcttaacttatggtagctaactaactggccagcatcacctgcataagagcatgatttgtgtgcagcagagagaagacatgaatgcagcaactactccctccgtccaaaaaaaaaaggcaaaccgtgggttctcgtaccaacgtttaactgtctatcttatatgaaatttttttataattagtattttcattgttgttagatgataaaacatgattaatactttatgcgtgacttatctttttaatttttttcataattttttcaaataaaacggacggtcaaacgttggacacggaaaccagggtttgtctttttttggacggagggagtaccaaattaggagaagtgtacataagagtaaggttgtcaggatcgggatactaggtagtatcattttgctcaaagtaataccgtatcgtagaatcgtatcgtagtatcgggatactaagagattttcttttttttaagtttaattaatatttatattaattatatatagccattttgtataaaaaaatatagtaatgatatatataatgcaaataaagacaagagaaaccacgttggttttgatatatttaactgatttttatataaatttgagcatatttagttacattattttgaaaccatattatttaaaataatattttgtagtatcgtagggatcgtagaatcgggataccacctaagatttcgtaggatcgtgtagtaatgaatagtaggatcgagatactatgaaaattaagatactaggtgggatcggtatcctttcggcttgataggatcgtagtatcgtaagatactagtatacgaatcgggatactgacaaccttgcgcaagagacaagggaaagagatggagaaaccgtccaaccaccaagcgggacccgcaacggctgctcgcctggcatagcttagctcaggctcttgtcatgaaaccatatggttcatcagttcgctgaactcgataccaaacaagtcaacatcgatgtatctaccagattattttcgtgatgtaaaacaagcataacagctacgtttactgttaattactcccccgttgttgaatataatgattcctagattttaaattttgttttttcatatataagaaattctaggtactgatatattgtccgatcaatcaaccatagtttaattttctttcatcttacttctaactatcttccaatcacttcagaccttctctcatttagtaagtgaggaacattaaatccttttcttttctcttcaatcttaaaaagaaatctagaatgcttatatttgtagacgggaaaataaaataacttgtgtttccttaaacagtactataatttattatcacatttatggtattttaaagaagagaaactatttgttgtacaccaactcatgtcgtcaaactttagtcgccatatttaaagctgccctaattgactacatgaaagtgatattttgagattttgagatttgtcgataaaagtatatatacagcgcattgtgatttttcatactaaattataattcaattagtgagtttaacatagctcagctgattaagttcattgtggtggaattcatccatctgaattcaagttttagaccgggcaaaggtgttgatatttgcgagtaattattctagctttcagtggtatacaactgctcgccgataacgagacgtctgtagtgactttctcaattgcaagatatatgtgggactgtttttgaaagtatttataggggtgtatatgcttttagtgatgagtgtacatacgcgtatatgagcatcaacgtttataccttttttgaaaataataaattagttgctttgacacattagtttttttttggctgcgcactcctagttagtgcagtggtcggatgtttttattggttaataaaatatttaattatatttagaaaaaaaatcatttaaaatgacaaataatggagagagcaattaaataccacacaaacatactaactattttatcaagtgtcgtccgttgcattgtggaaaatcttttgatgtcacgaggagccaacaaaggagatgtatgtcaccttggattgcaaaatcaccaataagtgtagaggaacttggacttggaaatttattaatccaaatggccgggacagattactaagaaaaaccacggcaaattcactttttgtttcaattttatattaaagctatggacattgacaaacaccacaaaagtatcacttttggttgcacgtttgccgcgtaggcacacacgagagatagaggggacatcacaaacttccacttcacatacataggcatcaataaatttcaatccccaattcaagttaaggagatgcccacgacacaccataataatctgtatgttactccctccgtttcgttttatttgacaccgttgactttttagcacatgtttgaccgcttgtcttatttaaaaaatttaaataattattaattcttttcctatcatttgattcatcgttaaatatacttttatgcatacgtataattttacatatttcacaa

SEQ ID NO: 70848 - DNA, 10290 bp, Oryza sativa
tttttccacacaaggatctcacatgtattaatgcatatcggatgcaatcatacatcatagaggtgatatttagcgaagttgtggacagtgtctactactgttttggcccgtttggatgtggatgaattgcttctatcaaattaatggtgtactccactacaaatatgggctatatgggagttggacaactgtacctaggatgagcttttatggaccctttcaattcgagcatgtctgtccagcactccagctggttaattaattggaatttggcaaaattcatttgaaaacatacttcgaatttcatataggaactgatagtttatttgtccaaaacagagatcaagcctcaaagagatgttataaagctcctttagaaagagaattaaacatagctagtaattctttaacataaaaggtgaacttttaggatttggttgtgaaaataaattacctagcaccagaatatgatctctaggtctaccaaatccttcccacccaaatatcttcttcaaaagctttcaaaatctggcccggaaacttccaaaaagaaagatacgggcaaatttaaaagtgagagttccactagaaaccattgctaaaagaaaaatcaattattccacataaaatccctatttaatttctaagttgacttttacaatttcaatcctatatgcaagttttgcatgtctggtcctgtccattcgcgagtccttatgctgaccttgatgacgtacattgtgtcagcatgtgttttcaatttggaattatctctttttacgccccctttgaattagaggatattattgtaggaattttagaggattattatatttaattttctaattattctttgcaatataatcttttttattcgtatgaaaagataaatttccattgaattgtattcatatgaaaaaaaacacgaatattagagaagaacctaatatcaaataattagaaggggtgaggcttggacgtttctcatccatatgactcaattttatggaaaataagtctaaccatttgaaaaactattcggtcctctcatttcctatattttccatgttgtaggattagacaaacatacaactttaattactgtggttttcttattctcatgtcctttcactttggaacatatttttgtcataaaaagtcaaacttcaaaatttcagctcattttaccgtcacatttcaccgttggtaactgtaaaactaaaacggtaaaaattgaagtctcaccttttcacaggctcactcactctataaaaaccgctcccgacctgccgctcggtacgcatccactcctctcctctcttccgttccttctccctcgccgtcggccaccgcatcgccgtcgtccgccgccgacagggacagcgttccagccatggacaagggcgccctgatgccgtcgcccgacgagacgtgctgcgtcggcggaggcgggggctcgtcgttctcgagcctgcgcgcgtacgggcgcgcgctggcgcagacgccgcggcggctggcggcgcgggcgtgcgccgcggcctcgcccggcgaggagatgagccgcgtgcgcgcgcgctcgggggccgacatggcgcgcgccctgcggtggccggacctcgtcgggctcggcctcggcggcatggtgggcgccggggtgttcgtcaccacggggcgcgccacgcgcctctacgcgggcccggccgtcgtcgtgtcgtacgccattgccggcctctgcgcgctcctctccgccttctgctacaccgagttcgccgtcgacatgcccgtcgccggcggcgccttcagctacctccgcgtcaccttcggtgagctcagctgctcaatcacgccaagatcatgacttaaatatttcccttcttttttggcgtcaattcaggatttcttcaaatttcgtttcattttgttgggccgtttgttcatgtaattacgtcattaaagattgggttctatcttttctttcttttcttttttttttctgtactcaaagatttgatggttatctatctctatggcttggcttttcgccatccttcggtttatctatctatctatctacacgctagaaagtgcaaatttcagtttctttttgtgagcatttatatgcatatgaacatggcagtttccttttaagccggctgctgttgtccttttgtttgctcctatggttttttttgataaattttataatacctgtacttttgctgattgatgctgccctgcatattttcgctgtatttattatgggctcaagttgtatgagcaagaaaatgtctttctctgatttcatattaattggctcttccttttcttaaaggttactagatttttcatatgttttttttaaaaaaaaatttgtcagcttgaaaatccgatctaatttctattttcacacttttttattttgacaagtaactacgggtggtttgattattttattatttgttcgagggaaatgagcattccaaaactagtaacgaagcctaatattgtgccaactttatttagttacatgcacgtagatttgtcaataggtttcatatcaacatttttctttttcagaaactcacaccaaatggatcataaaaaaaaggagtttggctagattgtgactcccaacaaattttattacacgggcgcatgtccatgtccaaataatgttgcaaagtccctttctttgtttctttgcatctcccaaaccgcttaccctttttttttccacctgggaccaaaaagatcccattgtgactgatcatcagtttttgcagtcacttcattttatttttcacaaaaaaaatatatcactcttcagctaaccaagcataattgcatagaaattacatacactgttgcatctattaacttgcttgtaatttactatatctgtcctagaatataagtatttctagagttagaaatacttatattttaagatggatgtagtagtaatttagaatttgagactatttttctgctctctaaaagtccaaaatgcgttatgttttttttcagatggatcagatttttgagtttgtttggttgtgcaggggagttagcggcgttcttgacaggggcgaacctgatcatggagtacgtcttctccaacgccgccgtggcgaggagcttcacggcgtacctcggcacagcggtgggcgtcgacgcgccgagcaagtggcggatcgccgtgccaggcctccccaagggcttcaacgaggttgacctcgtcgccgtcggcgtcatcctcctcatcaccgtctgcatctgctacaggtacgcacacatctgtaaaaactaaaaaaaacaacttttttttttgttgggggagtactccttccgtccaaaaaaactcaatctagaagaggatgtgacccctacaatgaatctagactaccatttgtccaaattcgttatccttaactctttctagggccaggtttagttcccaactttttttttcaaactttcaacttttccatcacatcaaaactttgctacacatataaacttttaatttttttcttcaaacttttaagtttagtcaaacttctaattttaatgtggaactaaacacacactagcttaagtttttttttgggaccaagggagtatggctgtgtttagattcaaagtttggatccaaactttagtccttttccatcacatcaacctgtcatacacacacaacttttcagtcacatcatctccaatttcaaccaaaatccaaactttggatccaactaaacacaccctataatagaaattgtgctggttttgcttatgacacaagtgtcagagttcttgtctcttcctacggatgtgtactgcaaggcttttgcagagcaagtgcaagcaacttttgttgcgttgtctgttcccttgtcttctctgcaactgctcctgtagtcctgtgtctttcttcttggcaaattctagctcaaagttcacacaatgtgcatggtgccaatttaattttggtcgaatttctcctgctccatggctgcatggtcctcctctgcagagaaaaaaaaaattcagagattttgttctgaaagaaaggatcttgttgaatggtcggtctctgctattccaaatgcccgttttaccctccctttttctttcacgatcgaatgtgttttctgtggcgaatgtgttggcaagctttgtccaaaggaagaatctgcaaaagaagccgtccggcctgtgtccttgtgttcccatgctctggcatatcgtatcaagtcaaaacagtcaagaaccactcttttttgttcttgtcccctgcacaaatgtgtgctgagattttgggaatacaattcctgaaatgattggtgaatgcagaggagaatcaatcagtacattatgattgaattctgatagctatgtttccatgaccaagattcattttggtcagcatgacaatattcttacaattttttttaagaaaaagaattattttgatgggattttttatggcgcagcacgaaggagagctcgtcggtgaacatggtgctgacggcagtgcacgtgttgttcatcatgttcgtcattgtgatgggattctggcgcggtgacacccggaatctgacgcgccccgccgacccggagcacaaccccggcgggttcttcccgcacggcgctgccggggtgttcaacggcgccgccatggtgtacctgagctacatcgggtacgacgcggtgtccaccatggccgaggaggtggagcggccgtcacgcgacatccccatcggcgtctccggctccgtcgtgctcgtcacactgctctactgcctcatggccgcttccatgtccatgcttcttccctacgacgcggtaagtacacctcccctctctctgagatggctgggcccagtgtcatctctccctccatccaaacatataagcatttttgatagtttggttgagaaacattaaatgtgagataattatcactagttgagatgagaagtatagagagaagttgcaatattctgaataaattttcaatgttaaaatttgttatatatcgggacagaggggatactacctatcaaagctatcaaaggaatctatctatagaaaaaaaacggagattcccaaataggacattgtagtctcactctcctaggctaataattaaaaaccaaggggaaaaaagtttttttctaggctttgatgttagaggataattctggggaatatattagctatagctagaataggaggccggcacacgaatctctttctttttctaatcctttgtttcgctttcaacctttccgggatagatatgtagtagctggatgaatctacagtaaaaaaagatctagtcacagtattactactttttttttccaacaggatgaattaaaatacatcaaagaatctgcaaaattaacctttctgatccatatgctcacattcccccctcgagaaattgggaattaatttggaaaaataacatcaatatttatttttgttgtgcttgtgttttggtgtggtgcagattgacacggaggcgccgttctctggggcgttcaaggggagctctgggtggggatgggtgtccaacgtgatcggcgccggcgctagccttggcatcctaacgtcgctgatggtagcgatgctgggacaagctaggtatctctgcgtcatcggccgatccggtgtcatgccggcctggctcgccagggtgaaccctcgcactgccacccccgtcaatgcctccgccttcctcggtgagccttttattatacatacctgctccttctgagtcgtaaataataaatatttgatatttaacacaagattcggttgaatttctagttccatgaaccaattttgctttatagtgaattataaagtctgatgagtttaaacgatcatattatattttttcatggtgaatatatggatatcgtttgtttttatttctaaaccaaccatctgagaaattatcgatggttagggctgtgtacatcctttttgggtgtagaggccgatttattatattatcttaaaaaataaattatcgatggtcaatttttttaaaaaaaataccaaatattgctgtaagtgttaaagatatatatatttttttaaaaagaaacttttacatggatgttttttttccccataagtcaaagtggcatgtgagtagcagttgacgacgaaacagtgagctagcttagctagtacagtaccagctcttgttcacacagtgtctaaactaataacagcagcatcagtctgccttttcttgttagcctttgcggccagggaagctagctaaccgcgatcgatgaaattaaagcggcggacatgacacgggtgtggtggtggtggtggtggttgttggcttctctctcaactcatctcggcgaggaagaagaagatgacgacgagagcacaaccaacacaaacacagccacacacacgcaattaatgaaaagctgcttagctaactaactaactaactaactaactaatcgtcttcaaactcacggttctagctactactgtttgacatttgacaggataacgacatgctgatcgagtgagtgagtcagggagtgagtgattggctgtgcgatgcaatggttttgattgatgagccgtgagaatttgtaggatggtaatgttcactgtgagaggaaattattagagcccgtgtctttgaattccacttgtaatcccgtgatttgggagtactgctagggggtagtactcttttgtctcatgaatcttccgtgattagtctgaaatccgtgtgagccttttctgacttctcaattcaacttaccttcctcctaattaattccaggtagtcaagacagcgacactgcctcgattccatatatatatatgtcatttaaatagttatattcttttaaaagaaattaataagatacgttactaaatgatatatcatttcagaaatataaaaagttaaattttgacttgtataaattttagaaaaaataaactatagataattaatgtatattcacaattaatttttttctcaacttgtagtagatgttaaatttgattttatatgcttgtgaactgatatatcatatattaatttatcttactaaattttctttattctttttctaattatttaaatgcatgcaaacggggtgtaatctcgagagtgtagaatctactccatctattttatattataaatcgttttgacttttttctagataatttttttctggtttaactaaatttgtagaaaatatctagcaatatctatcacaccaaattagtttcattaaatataacattgaatatattttgtattttgatagtacgtttgttttatgttaaaaatgttactatatttttttttacaaatttaatcaaatttagacatatttgacttaaaaaaagttaaaataacttatgatataaaacggatggtgtatctttctacaactgtttgatcactttgatccatttgttctggggaataaacagtttggtccttggcgacgatgcaggggtgttcacggcggcgctggcgctgttcacggagctcgacatcctcctcaacctcgtctgcatcggcacgctcttcgtcttctacatggtggccaacgccgtcgtctaccgccgctacgtcgccgccgccgaggacgacgaggaggggcggcggcgcggggcggtgccgacgctggcgttcctgctggccttctccctggtggcgctctgcttcacgctggtgtggaagctggcgccgcgcggcggggccaggacggggctgctggtggcgtgcggcgcggcggccgccgccgccgtcgcggcgttccgggcgctggtgccgcaggcgcggcggccggagctgtggggcgtcccggccatgccgtgggtgcccgcggcgtcggtgttcctcaacgtcttcctcctcggctcgctcgaccgcccctcctacgtccgcttcggcttcttcaccgccgccgccgcgctcgtctacgtgctctacagcgtgcacgccagctacgacgccgacgaggccgccgccgcgctcgacggtgccaaggtgctcgacgagggctgcaaggtataactagctttggggggtggctgacatgtagggacagctggtcaagtgtactctgtagtagattttttttttcttcttctttcttgctatatggtgtttcagctttttttcaggctaaagtagttttttagtgttggattaaaaaaaaggctctaagtagtttttggtggtaaaaaaagattcaagatgctaacagggtgaaaagacaaggaaatagacaggagtgtgaatgagtggaaggaaagagagaaatgtaactttatcttgcaaatatgcaattgtacaaaaaaaaaatcccctcaagaaaatggttattacctcggtcgtctcgttctaaatttgtcataagtcaaacatttatatcttcaactatcaattttttttcaaaaaaaaattatattttaacaacacatgaattacatctcgtgaaagtatttctcatggtgaatctaaaaataaaaatcttatggtgctaaacgatataaatttgtagaaattggtggtcaaaggtgcaaatgtttgacttaaaaaaactagaacaataagtaattttaaggacacatttgctatcaatgagttatcatcaacttttactcctttaggagtggatgggagagggagaagagcggacacagtgaggatcatgggtattagacccaattcctatatttattatatttatagaaagtagttctctatttgagcataaacctcttgttgcttaattggttagtaggcgattcacacattcaggccttgtttggttaatccccaagagggagggattggaggggatttattccacacttattgtggtgtggaattattctccatcaatcccctccaatactctttaatcccctttaaaccgaacaagaccttcaatggaagctgggttccatcctcgtgattcctctagatttcgtgctgccataggacaccaccagcccaaataccattgacctcgatggattaagtcctcagggttggggcaagtgtacaagagggttggatggaaatgatagctatagagctagagcaaacctagacacctagacaagctgtttaggtttatagttaaaaataaagtttttcaggataaatgtagcctctagaacaataaattcttgtccattttacctttatattattgttaggattcttgtccattttaccttttatattattgttaggaattaatgagagttgatcaccaataccatgagtccatgactgcgaagttttaacttgcatttttacaaatactccatttggtaaaaatatatttgatctttagataagatttggttaattttcaatttgatcatcaactttatattaaaataagtttatgatattttgatacttctctccaaggtaaatctatacataccgattttttaaaataaattaactaagcatttcagaagtaatttgtggtcaaagtttgttttaaatgaaaatgatccattctcatactaaacgtcaaatatttatcacttgaagtagtataactgaagcaaagtaccctgtccgtcccaaaatatataaaaccgctaactttcttgcataacgtttcaccatttgtcttattaaaaaatataaatattatttactttgttgtgatttgtttcatcatcaaagaaaatataatctcaacttatacttttacatattaatacttaatttttaaataagacgaatggtcagatactataaaaaaagtcaacggcgtcatacatttcggtacggagggaatgtttacatgattgcatcctcctcctctgtgaatatgtgacaatcagcattgttatctgaaactatattttttagcgaaatctgaaactatttatcaacagaaacgcgagaagctttacacagctcggagaagaagggccggatcgagccgtacaagcaaatggattacatccttgttcagattctcaggatagacccaaatccagaatccaccattgctgcactgttcttgctgcacacacatttggcacgagctgattatcccagtagcacaagatagagacgtccattttgcaaggatatatatgcattctttgagctggctctactctacacctctccatatatcctttttcttttttgctactaattgattggttggtcgtgtgccatttttactagattgcagcatcattatctacatctcgatgctaatctttcat

SEQ ID NO: 70849 - DNA, 6295 bp, Oryza sativa
  unsure (1)..(6295): unsure at all n locations
ccaccggtggcaaagcaaggcggcgggtggcgaaattcttgcacaagaatccataggtggacgtagatgtgttttgccgcggcgctgcttctgcctgcatgggactgggtggtagaaggttcaataaaaatgccccgaggaggaggggatgcggcagtgatgaagtggttccggcggggagcaccagggcgttgggcggccgccaaactagtccggaggtcggcgaggaagggcgacgactgcccatgaaggccgtggagcgggcccgcgacggactgagtgggtggggagttggagtggactagccggaagctcggcatggtggggagctcatctgtcaaggttgggnggggggnngggcgtgggggtgccgatgagggagcagaaggcgagtagtcagagcaggcgagtgagcgtgcgaccgccggagtggagcggcaacgactggcgagcggagtgtcagtggcaagaagcgagcggccggcgaagcggagcagcggcgtgcaaccggggcaggcccgcgagcacgcggccgacaaagcggagcgggtgacggcgagaaggttggaaaggagaagagaagagaagagaagagacaaaagaaaagggaaaaaaagagagaagaataagatatgtgggccacatatttttttcttcaccctatatttgttttggttgactaggatgccacgtcagggaaaccacccatatatattgccataggaccttgattgcacggtttgtgtgagtttaggggtacacatttctagttttgtggttaaggaatctaaaaacaatctcgctgttaagttgagggacctgtggtgaacttattcttagaatgagtattattactgggccggattattggacagatatccagaggcctatctaaatttgcagggagatgttttgcaattttcaaagaaaaaaaagtccattttgagtccctaatatatagtacaactgaaaggaaacagaacagagagatcaactactatagtagaagtgtacaacctataaaatggaagaggctggatagtttaatgtgcacaatttcacctctatcttcctttttcttttcaaatttttgcagtggaattttgtcttgggacaggggagtagggtagcagccctatttatcccttttccatcgatttaattcatctcaactacttcattcttcttttttctcttttgagggaacatgcacgttgttatttccttcgtttttttggttcatgatacatttggctctgttgttcaaacttcaaataagagtcctcactacttaaaaaatgatctttccagacacccgctttatttttgcaaacggacctaaagaatatctgcatattaaatgattttagaggtgtaatagggaagatttgttttgcaacaattgcttttcacacgcggaccccttaagagacttgcatgtgaaaatagagttatttccgtagacggggctcttatgagacccgtatgtgaaaaatatagcaccggcctccctcttctttaatttctctcctactcttcgtgtcctctctctaagtcctcccccttctctccactcctctctgcctttctctccattcctctccgaatggccatgatgagaggaggaggcagtggcggtggacttgtggaggcggtgacagcgagcttctagcggcggcaacagcaagtgcagagttgggagctcaccaatgaagagcttttgggggatggcgatggcgggtgaggtgctgggagctcgagaggcagcgaatccaacgtttaggacgtcagaggcggcggatctggcactcgggacctaggaggcagcgaattcaccgctcgagacctcaacggtggcggatccggcactcggaacctctgcgtcagtcgatctggcaccactggcctcgatatttacgacgcctcaacaacgacgacaacaacggtagatctagtgctcgggagtttgggaggggttaaggggtgacgagaaaggtattagagagatggccggggaggtggaaccctagcaataaggacaaagacaggtggacggtgagccagtggaggtgaaacaagagcagttatgcaacaatggcggttctggtggtgcgaaaccatcggaggtggctttatgtcgccggagttgtagaagaagaacaacaaagaggagagagaggatgcctattggacgaggctcactggcgtcattggcgacttctggtatagcgaagccacgaagccaggggccgacgcggattgggatgtaaggagacacatcacgaggagaaggggaattggtaatataaggttaatttgtttacggaatcttggtactatataagccatcggaaaagtgacttaaatttgtgagtatttttagttgaccaaaacttcacatccatttatttatatgctaagcatgcatgcgctcgagttctaaatccattccattttctcaaattcaataaagtatgaaacaacttagatgcatccaaacaatgctagcaatgctcttaatggaggagcagcaacctgaagggtagagtcacacctatgttttatggtatattttttataatggagatgtgttacgtgtaccagacctttagataattctgtaccatttgcctgcacaatgcaaatcctggaaattttgctgtaatttttatcacttgcctttcaagaatttaggatgagttcagcaagtcataagattgatcagaattactaccacttatgccattgggcttttagtttatatggaagaggtgtggactggcagcatgcgttgaataattcctcctaaggccacaaaacaattggccttcccagtttgattgattagtggctcaaggatgaaaggcaattagaattttgtgtatggagctttttctttgacttttcagtatttaccatttttgtcattgatgagtgaattgaatgatagtatcagatatcagtgatagtgagattcaaataccgcgcgctagcaatctcaacatgtgttcctcgattcgaggagcgacctcgatcattgtctgtgttttcactgtcttattgacctggcaatggatcaacaatgtatcaaaagtactttgtatgataaatattttattaatccttataggttatgaactaccagaacttacatataccatattctagacaaggatgatatttacacaatgcatgtagataaacagattctgtgcttataatatgctcaattcaatttatattgatcacagcatgcatttcacgtgcacgattactagtcagatgaaacgacatagttatgttctccgatgcaggatggcctggttcagtgcatgaacagcgagttttagctgctgggtacccatatatacaattttcctaggccatcacagggttagtaatattttctaacacatcgctttttggttatagtattattgaaactaggaagaaagcccgcgcagatgcgtaggtaatttatttattgtttataaaatgtacaaaaaagccctatctcaccatattcactgtatgaaataggccatagatttttgacatactaaattataataatgtccatcatatcccaaaaaaaatctttttgtactcatctatcaccactacttattatcatgtcttgaaatatggatatatagttagaattgcatctttgcacaaataaacccaatacataattaataccataaaaaatcatccctacttcatacccaagtactcatgtctcataggtatccaaatctacatgtaaataattaaaaataccacttctaccaattaattaatagaataagatcattaaacttatatatgaatgcccctttaacaaccggtgaagccaaatgtagccgctaaggcttttttctccaatgccttgattcatgggtcccgtattgatatagtcgtgatcctcaagacaagctcttagagcacaattttataaaggattgtatcggtaagtaggcaagttgagctctattgtcaatggtgacctcttacacggaccacttcagctcaataataaatactcctaccatagttattacaatgtagcctattgagatccatgcttggcacccttttagggtatgagtgagagaaaatggagatgatgaaaatagttttttttaatgtcttgagtcgatttattgtatagagtgtacataatttgtttacggtgttaatcgatactactaaattttagtggtacatatataattttaaaaattagcagggttcatcattggactctacttcgaaaaatctaatagctttagtggtgaggaccatgcaaaaaaaatatttgttcaaattgtaatcctttgctaacatacaagttaatataggttttgatctttttttcttgtgttatacatctaattcacctatgcatgttcgtgggattaatattcgatggaattttttaaaattatttttgctaactgttaacactatttggattagaacgacctgaaaagagatataatgtagttacatgtatgttttttttactagcgaatagtactatctcatatgtatttatgttttttttcttttttttctttcgaacgaatatttgcctatcatagtaatagggtatatgtgtttgtattcataacatgcgtctgcacacatttatatgagatcttgtgattgccttttacattgttagttaaaaaagtatgggtggctgaggcggcggcatggtgtggcttcttttaccatccatctcattaagagtggtcactacgtatatgctcaatttagaaaaaccttagagcctggaaagaaagagaaaactaccatatggggcataccatatacacactcttctttttttctttttatatttcttgcgtatgtatgtacataggagttgtgtatgtacataaggagatattagacggtttttagacggagggattactgttatagatctaatttaatggttgaaaataatggatcattgattttgagtgtaaatcgatgaataattgtttttattttattttatagtttttcttagtttctctctaattagagcatcacatgacatctaatgagcgtttgtaggagtatagaaatgctattactcatagtcacaatctacttgtagtcaactattgtttgtggtggattggttgcatcctctacctatcatttgttgatcattgcacacttagtatttccctttattttcggtgcctgatgatatatatgctcattagatatcaactaaccattaggtgcattgtgcatggatacctcgtgagtaatatgacttggcgatcaataaatagtgacttgtatataaaacctacatatagggggatcaatgaggacatatgattgatattttaggctaggattgtccaagtatattgcatactacatattgagtttttataatgcctaagtaataaatttaaggcagcattgtaaagttcttatagcattagctactccctatttataacgagtacgtttctcaaactactatacggtgcattacacggtatgtgttctacaaatactttttatataaaagtttttaaataaatcaaatagattcattatttttaatatttaatacacagttaatcctatgctaatacctgtatcattttgcatgtcatggataagcacacctaatgagctaaatcgaacgaagcctaagcaggagataaaagacatcgacacgatgtcaaaagaatatatttgatccttaacttataataatatataaataaagaaacatcacaatacatgaaaatacattcataataaatttagtatttggatatatcaatattttttgatagtagggagtgaatatttttttatagtagggagtgagtaattttgggaaattttactcacaactggagttattttatttttgaaaatgcaagtctaatcttgctatacaatatacatttatacaatgcatactattcatttatttagatcttttataagtttcgattacatgtatattgtagagtgcaactcgaaataatatatatttttacaactattggctgaaattattagtttgatttttttatctcatgagagtgaaaaagaaaaaggaaaaagaaaagaagtgaaagggggcacgtacaaagtatgtactacctccgttttttaatagatgacgccgttgactttttctcacatgtttgaccattcgtcttattcaaaaaatttacgtaattataatttattttgttataaagggttttatcactcaagggaacgagtgatctaagggcgc

SEQ ID NO: 70850 - DNA, 1923 bp, Oryza sativa
ttaaaaaacggagggagtacgtgcatgcacatacactgatacacgtattgggccgatcaacatgatgcggctttctaaacataaattaaatctatttggtatttttagatctacccaacaaaaatataggtcccccagattaaataaaaatcaatggttagatatgttttgttttttcttagaatttgtctaatttataaactggagttgttcatttgtttttgaaaatgcaagtaaaattttactatacaacatacaattatatagtgcatattatttatttatttagaattttttatggggaagggggatagttacaaagtatgtacgtgcatgcgtacatatatgggagcaatcgacgtagatgttctaatgataaattaaatctatttgttatttttagatctaacggttaaaaatatggtgtccactacattaagtgaaaattaatagctagatattttgctttattttttcttagaatttctctaatttattagagcgccacttggcagcctaggagcgtttgtagagatgtcatgtgacggcttaggagcatttgtagaaagttttataaacttttagtattatttttttcttagaatttttctaatttattagagcgccacttgacagtctaggagcgtttgtagagatgtcatgtggcggcttaggtgcatctgtagaaaatttctaatagatagatagatagatgcactgacctgactgaattgaaatatttgcaactaaatattttctcatggactcggaatatccgagtaggatgggctccatacccatgtgttaggttataaagggatcaatttgtagacgaacaagcaccgcaggtccgctgcccggggaaagagaagaaacactactacaaaagtgatttttctgtacgagagccggcccatgatttttacaaacggaccgtaactagtggcgtctgcaaaaatcgagggtcattttcccatacggctccttaagtggcccgtatggaaaaatcgattttcccatacgggcctcttaagagggtcacttaagcgcccgcatgaaaaaatcgatttttccatgcggctcgcttaagcgcccgcatgcgaaaataaaatttgaaatttgaaactagtgtatctcactcatacgaactccaaattagatgattctttttcctaaatgtttctaaaatcatgctatatcatgttattgtattcttactgctattatttttgtcattttttcttgagactttgttttatcaattaaaaatttgaatttcaaaacttcaaataatattttgaagcaataaatgattttagctgaaaaagtcaacaacaacaaagttgtataactcatcaagatctataacttctattttggtcatttcttcattctacaaagtggttgtaacattttcacaaaatttacatatctctctatagtttataaaactatataagagatgtacatcttgtgaacagtgttacaaataactttgtcgtatgaagaaataaccaaaataaaagttatagatattgatgagttataccactttgttatttatgactttttcatttgaaatcatttagtacttgaaaatattgtttgaaattatcataattttaaattcaaattcaaactgtcgaaacaaagtcatatagaaaaatgaccaatacaaaagttatagatcttgataagttataccactttgttgttaatgacatttctatttgaaatcatttattatttgaaaattttatttgaaattgtcatattttgaaattcaatttcaaactgttcaaacaaagtcatatagaaaaatgaccaaaacaaaagttgtagatcttgatgagttctacaactttgtttttggcaaactttttcatatgagttaatataaaaacataaaaattaatttaaaat

SEQ ID NO: 70851 - DNA, 672 bp, Oryza sativa
cgaggggcattcttctaataggctccgagggacttaccttctctctgagggcccaacagcccccgtcaagttggagtgccctctcgaaagaatggttcgagaagaacaggcaagtcggtgataaaaccggcaaatctcttaagaaaagggaatgactcgttcgagaagttccagaacaggtccgcaaagaggtgaagaaggggtattacgaggttggaatgacttcttcgtccaaaaagctgcgtcccgggcattgtttgatgagcaatgggccaagatagatttcactggcattgacgttgaggaagatgacgacgatgagtagtggttagtttggagctgaattccaattgagatggatatatgctctgaattctaactgagatggatatattgggttgttatgtatgtaggaatgccaatctaacaatgaagcatttgtcttttgagaatgtgttttgagagagagcgagacattttttttttgttaatgtaatttcaggtagttgtagctcaagcactgaacccatgacaaccatgagttcatggacaggttagctccagcctgctattagcagcaatttgcagctccggatatgcccccatgtcatcaaacaagaactacttactcgttcattgaacaggcacttgtgtcggatcctattccagatt

SEQ ID NO: 70852 - DNA, 680 bp, Oryza sativa
aaacataccaccaccaccacatgttagcaattccaaacatacccctagacaaaagaactagcaccaagccagccgccactatccgtgactgaatgccgctagtcttgcaaacgccctggcgaacactagctccaaaacagaagatcgtcaacgggctcccggtcatcctcacggagaaagcttggggagggagaggacaagagagaagaacacccacttgtccctcacgccaacctggtgacgacaactgacaaaacgccaaaaaccaaattgagagaagcctgtgacggcgggaagatgagatctcaaagacgatgccttcaaggagcatgatgctcaagacgccaccgacatccgtccaggaggtatgatgctcaagacaccaccgtcatccgtccaaaggactaggttttctcccggagaatctcccaaggaggaagagggtgtcagcttgacagcgccccaaaggggtgaaacgctgctagatgccgacactgccagcctagagaactccaagcaaggcgttcgcctacagatcactctattcaacatatcatcaacaacctaacacaaagccacccaagcggactacgatagcacgcagtcttgctgcgtcagctatcttgcgtcagggcaaccaccttaggcaccttcgggtgtgccctgctagccccaacgcg

SEQ ID NO: 70853 - DNA, 2719 bp, Oryza sativa
ctattacaggtgatgcaacaccttgtttcttcaattgcggctcactaagatggaatttcgcaatgggttggatccgttgtaaagacaactccgagagctttctatcaagtactcgtggacccaaaacggagctcgtatgcatatttggcggccatttgaagtcagcaatgtagcaggtggccgaatcgaattccagcttttagagaacttgatcttgatgtcttcttgtagatccatgatgtgagcaatggttgtatccatagtagccatggtcacatcatcctccccttcttcatggaaaaacgtcatcggtttttccatatggtgctcctcacgtagtctatttaaaacaacctgtttcttccaatcaaaacaagacaaactcgagataattttgttagcaataacatttctctctagcttgcatgttttatccacatgtacagaaggttctaaatccgaacatatgtaaactctatgcaccaaatatattcctctatcattatattcgccaaagatatgagaaatagcattagttggacatggcaaatcaaatttagcaaataatttctccttcaaattttcgagctcacaaaaatcatcaaaccaaacatagcccaaagtatttaaataagatagaaattcatgttcctctacttcatttgcaatgtgaacaacatgcttaaaatcagcacacaaagaaacactagaaatagcatgttcattcactagttgtggcatggatataagtgaagcattatcacacaactcttctttatcacaaggaacaacaagtaaatcaacttgtgacaaaggcatctcaacaattggttccaccaatggttgctctactatagcatgaaaagtggacacgtgtagctcagcttgagaatactcacattcatttatctcagcacaatttaatttaccttgcaaactttcttccgaaaccgcaggtgcttcatcctctttcttatcaagtacaccattctcctccttttgttgaatgttctgaactccctgcaaaacgttagtaacaggagagacaaaagattgctcctccaatgtttgcacatcatcattgcataaggatataggagattcagaaatgggagataaatcacattgttcatgcttcctcgcatttgatatgatctaactctcaatgctacgagcaagcatgaataggtgcccaatatgattatatgtcacattatcaaacaaaacctgaattttagaattaagcccattgaaaaatctacgcattgtattttcattgcactctttgagatcactgtagatgatacagaccttaaattcatgaatgtagtccttaacagttctatcgccttatttcagatgttctaatttctcccgaagagtacatttgtaataagaactcacaaagcattttctcattatggttttgaattcatccaaagtttcaggtttgttacaaacataactccaccaaaataatgcagaagaggtaaacttattactagcagccttaatcatttgagcatcagaaaaatcatatatatcaaattcattgtctactgctagctcctaatcaatatatgcaacaaaatcatacttcccatcatagaatggtaactttgatgcaacttgtgcaaaattatagtcatgtacctcatatgcatcacgtggagaagtcgtcatatctcatcgaaggtgtagaagttgatgttctcgtattcccttgcgcaatcctgccattgttagtagaaaacaagaaacacacacaagaatatgcacgttcctatcaactactaggtagtggtagctcaaatatcacacacactcaagcttttaaccaagctcttacaagttcttaccaaagcaagcggaatggtgatgtacaccgactcaaccaagcaccacaacgaagtttggatgtatgaatgccttggcaaacacttgttgtacggctgtaatcaaatatgtggagctctgggtaggcttaaatatgtagcaaaggaatagcaaatgctcaaatcagagaatgcaaagttgaataatcgttcaaagtcaagtaccgtgctggtcctaggctagaacgtactagagacgcgagcctagacacaaacgataccacaagatagcactaggaacaactcatgcacaactctgatatataaagttcagctcaaacataacagtattttctcttttctttctttcttctttcttcttttcttttttttcctttccttttcttttctgtttttttttggtgcggctttttgttttcttttttttttcacctttctgcctttttttttctcacttttttcttgattttttttaacaaaaactgactcaagtaccttaatgtaagattacagggactcaaacataaatataaaatttacagggactcaaatgtaaaagtctaaacccaaaattaaaattatacaaaaaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagat

SEQ ID NO: 70854 - DNA, 12517 bp, Oryza sativa
acatatataatatttctgtcatatagatcattagtgggttaattcttttgggtggcagagaataaagaggatgatttagttaattcatcgatatgaccaatgttatgatcactgatctttattccctaatattgcgattatgcatctccatgtggaaaaacataacaatcatactagctactattcaccatcaattttggtccagccaagaacatgcaaagtctagctagctataaggccagtgatgaaccacaccactatgcctaacacgattgcatgcatgcctgaatacacgcatgcaattcagtgagaccaaaaaaaagaagatgatgtgaacttgcaactgactatgcgatggaaagatgtaaagagatatcaagatcacaccggcatctttcactctattttgttgtttatctccatgtccatggacactccatgtgtgatgcagaatatgctacatcttcggatatatatcatgatgatacataattggtttcatctgtcgtttcttcagagaagagaaaagaagaagaaagaaaaggaagaaaaatagctgtctactgcatgattgtttgattgatcaagtgaaggcgactccgattctgaatttctcatcaagtgtgcttttgcaagttggctacatgaaatggatggatggatcgatcgatgattgagtttgcagggaaggttcggcagtacagattggtcagagttgtttctgcagaaatggaagacttgttccgttatgcgccatgcactgcagatgttttggtttttctatgtcattgcagaattgttgagctgtcagatgagatataaactaaaacagtgacggaataagatactgtaccagcacttgcgcatgagaaaataacaatattagcttttgattggacttcctctgcatcacctccgcgaaaattgggcagggaatttcagaaggagaaagaacaagttctggacagagtaaatgaaattctagttcgaaagatatggctttataaattcctttttttaataatgaaacgagtagtagctagcaaacatttctatgaaaattgaaaagttataggttggaagctataaggtagagccgatttcatgctcacgtcgttttctctcatcttttcagaaaattaatgcatcgacatagtgtcatctacatgcactggccatagtttaggcttatccaaaatctgtagagagatcggccagaatgtattattcctcacaccgtttttgccatctatttccaaagcaatgatgtgaaattatgaatccttgcaagaatggagctggcagtcaccagcgatccctgaaaaaggtgaagtattaatatgcttgcttttttttagataatccattatataccattcagtttactctagttaaacaattcgctatcgactttgtctccctttataatatggactttgtttttttttctaaaacacaccattgggtggatatttttcacagaatacctaaaaatacccttcaatgcttacaagaggttacaattgattgacctactataagtttttaaaaaatatgatttttttatgtagcctacttacataaaatggaagtgtgtatatttcaagatttttattttatatgtattaatttaaaaaaaatatcattcgtattttatatgctaatagagtttttttatgtacatagtattcacatgctatataatttattttgatgcggcaatcttttatgtatgtgattcctccttcatagttatataaaaatagttttctaaaaaaatatgaaagataattttgaaatatacacacaaacttaaatattttgtaagaaggctaaggacacgaaactttcatatatttttttaaaaaaccttctagtaggtcaaacagttgtcaactcttgtatgaattgaaggacattttagaaatttcttaaaaattattcaccccaatggcatattgtaggaaaactaataataaatttagtagtacattatagaggaagacaaattcgatgataaattgttaaaatataataaagtgtcataactaatcagaggggaatctttttcggtttttgatagggtgccagaccgtaaaactatttgtagaaaaagtggactagtagttggtaccatcttggaccaaacaaataaaaatgtccagagatgccactgtcaggattaattacatatactagtaaaatgtcattaccatttcaaatattaatcaagaattaatcttcctattaaatgtcattaccatttcaaatattaatccagctaacaaactttgttcagttctgttcattacatactattgagtgtacaaactttgaactttaatttacctatgtattctactaaaaaaaatactccctccgtttcatattataagttgtttgattttttcttagttaaaattctttaggtttgaccaagtttataaaaaaattagtagtaacatttataaccctaaattagtttcattaaatttaacattgaatttattttgataatatgtttgttttatattaaaaatattagtatttcttttataaacttattaaacttgaagaagtttgactaagagaaaaatctatcgatttataatataaaacggggaagaactcccccatctataaaagttacacctatttcacatttaagtttttccaaataaattgtccctatttgtagtccttatgtattcaagacttaaataaagagataaattaatgttttattagaacccaaggagtcatctaaatactcatcggttgtatgcttgcattcacttcttgattttataaatcaaaggtgatttaatttcttcttgatcttggttaaaagtaatatgtgtaacttttgtgggtgaaggcagtatctctgtattattaatgcaaggtaagggcatgcatgcagtttcttactgcatttgtatatgctgcaacctcgaaataatatggacacagatggcccagaaaacaacacacatgcatggccggcgaacatcaaagtcgccaactactcaggtttgacccctgcattgcacagacaggctagctctcaacgctggcggctcgcacctcacctcttcacacattagcttttcccaaatccaagctgttctaggctagctagctctggctacttcttctcttcccatgaaattattaacgactttgacacatgcatgtgcgtactatatacctctaattaaacaattcataacattgtatatatatctgctcacatatatatggagattcgatcatgataacagtcgttttccagggacctattttaaactctccggagcatctcgattgttaaatgtgatttcaaatagttaattaataaaaaaatctggaaaattaggtaatgtgggttatagtgacatataagtatgcaaggttaaatacgatctatacgccttttttttatccaaattgcttgtgtttagtttgaatttgacctggcatgtttttacctgttagaggcacatgtgacaatatataatatgcctagtctagctagtttttttttaaaaaaaaatttacataaatgtttagagagactatatatacaaaaaaaacaagggcatatggacttgagggtttaaaatccacttcctttaccaccttttgggctcaaatatgctatgattatcgagcgtgcaccagtgaaaccaagtgtcgatggcgattctgtgtttgccttcatagctttgtttgcgcgcaattttttcagacattgactgtgcttatggtgggacgatgcacacaggactggacaaggagacatgcaaagtctttgacacataagtaattttggtgtcttggaatcttggatgctttgaaaggaacgaaaagcgcacgtatttgacattataagcggaatggtgatggatgttgtcgaggcggtgtctgaggagtactggatatggcaagttgctagtctagcgggtccactccctactatagagtaattgcggtgtttgatggggaaagtatagtttattgatagaatgccgcattactagaatctttttttccctatagtgaccacaccacaagttgccgatggccccttagccaagaatgactgacggttttgtatatctccccatcacaaatgctactgctttcgggatgtatgtcttcatagttgtagctctcacacctcatatgaaaaatgctgagctccaaaatcataattgtagcgtaacaatgtaaaatttttccttccatgtaaataaagtttggctagcgttcctccgccagaccggcggaaaaaagtttcgacattgactcttggatcgggcattagtgtcttgtcatgctatcataggatgcatggttctattgttgggatacgcgtaggctacgatagcattaatcaaaattttatatcgcataaaccaggaaccatgcaagtattagatcatagatcgttaccactcgacgcgctgcgcagcggaagaagatgctaagaaatcgaaggaactctcgcgaagtagcgtgcgtcgatatagaggaagtagtcgatcgcaccggctcgaccttctcctcctcgtgcgttctcctcgccgtactcccacgccgatcagcaccgcaaaccagcggcgcctctatcggtatccacacgaacagggacggaacgccacgcgcagatgtgctagcacccgcgcgcggctagggttttgctcgaggtgggatcggtgacggctagggtttctcacgtgatacaatacctccaccggtcatacccctcacgaatatataggatccatcactcgggcctccaaggcccgtaggactcctattcggatccctatatgaattaagctcatattgtatctccatccaatccccttattccggcccattaagcgtgcgaccctgtaggttcatgtatactcggctgtaatccgaaaaccccttttcggtccacgcgtcaacagcggcccctaacagaacgtattgacccaccgggcatacataaagatcatatcggctgaatctctagtgtatacttgtatgaacccctttgcctcacgatatcgattaagctcaaggctagatatgtgccatcctctaatagctcaatcattcacttgaacctgttgatagattatataacttgtgattgactcctcaatcacctttggcatggctatgcacttctataatctacaacatcgaggggcccagagatatctctccataggtggggtaaatctcatcttgattattcatatcctattacatgtttcatagcatacccgaaaactacttttataactacccaattacggagttagcatttagcagtccctaagtaagctactacacatgttgggaaccatgataatctcaagtctaaggattcaacactaacactaaataagatcactgatgacacaacacatatggttcttgcagtgtctcatgttggatctatccaacaacatgttcactaacatgtacccacattattaatttggtatctctataccatgatccatgagacatgatcatcaattaatacatgtgctgatcatctaaacatatttgttccacatatgatatttgatcagggatcctttagaaatagcaacacataacataaagagtctcataaaagaatcacacattcattaaccaataattagtttatctattttaaggagcaaagtcggataaatatgtaaacatagtgtgtgatataatcatctctatgattgcctctagggcatatcactaacatctgtgactacggacatgtatggtatagggttctaactcttaaatttactctaggagcgaagtctggagtgaaaatatagctagagtctatatatagttttttagcaatgatgaatgcattgtaatttgcaaagcagcagcacccatgcatcatatcgaaaacaaaaggaacagaaaagaaaacaacaataacagtatccatcacatccaaaacaaaaggaacagaaaataaacaaacaccgaaaactcaacagaaaaagctgtatgttactgccgtagctttatgacgataaagaatcacgcttacgtgagtgtgcagaggacgacgtcgtggttgcagtggtgatcagtgaagcaaagaagaatatggaaacgcagtagcccgccgcgacagcgacccaccaaccgacggctgccgagacgagacgaactagcgctaagcctataaaatcgcatcaacccacacgagctacctatccatcgtcctagctatctcacgtagtctccctctcccggtcttcgcgacgacgctagctttacacgttcgtgataatggcggcgctgctgctgctggcggcggcgatggtggtggtggtgttcgcgcacgcggcggcggcgcagcggtacaatgctatctacagcttcggcgactccatctccgacaccggcaacctctgcgtcggcggctgcccgtcgtggctcaccaccggccagcccccctacggcaagaccttcttcggccgccccaccggccgctgctccgacggccgcgtcgtcgtcgacttcctcggtaggacgacgtcctgatcgatcgatcgatcgagctagtagtggagaaaatgacatgtgaatttcatgcatatatgcagctgagcactttgggctgccgctgccgccggcgtcgaagggcggcggcgacttcaagaagggggcgaacatggcgatcatcggcgccacctccatggacgccgccttcttcaagtccatcggcctcagcgacaagatttggaacaatggccccctcgacacccagatccagtggttccgtcagctcctcccctccgtctgcggcaacggtaactaactaattattcaacatcttattatttaccacagtaactaccactgtaattaatgatccaattcattgattagtcgtctcaccaacaactaccagtatatatgtgcatgtggagtaattaattaattaattaattaacggacgaattgatggatcgatcggatcacgggtgtgtgtagattgcaggagctacctgtccaagtcgctgttcgtggtgggcgagttcggcggcaacgactacaacgcgccgctcttcgccggccgcgccatgacggaggtcagggactacgtgccacaggtcgtcagcaagatcatccgtggcctcgaggtaactaaccaactaacctgatcatttcacgctctccacctgatcaactcacgagagttggatcacggatgactccaaaatggaaaaaaaaacaaattgtccgccaaacagtctatttcctccttcctacagtatcagattaatttcacacaaactatttttttatatagaaattgccctataatatcaaatatatcttttttcaagttaatttgtaataattaaaactcaattgatcattcgctaatggctttcctgttttaaatgcccttacgtacttaatcttaatctttatctatcttaaattaagcctaaattactatattttaggatagataaagtactttttttatcgtaactcgtataggcaacaaaacaatcatgtaaattttgcgcgcgacttgtgaacagacattgatcaggatgggcgcggtggacgtggtggtgccaggggttctacccatcgggtgcttcccgatctacctgacgctctatggcacatccaacggtgcagactacgatcgcaatggttgcctcaagagctacaatagcctctcctcctaccacaacacgttgctcaagagaagcctctccaacctccagaggacgtacccacatgccagggtcatgtacgctgatttctactcgcaggtcactgctatggtccgctctccccaaaacttcggtgagttgatcatactatttctcatctcataaccgcactaaaacatactacctccgtttgataaaaaaaactgtatttttgattatgcacctggacagatcaatatgtgattttttagaacggcgcattatattagtaaatcttgacttacctgtcgttttcttgtttatttgagggtcatggacttatcaatgatatgaaacctatcgctattttttctgttaggcttgattttttttttttttgcaaaatggaatttaatccagccttgttatggttgataggagataaccgttttataaaattttacaagctatttcgtaggaactaggaagcataatatttagatcagcctataaattctattttgtatagtagttaacagatcagccctgaacattactgcccagagctgcaaggcaccatcgttgtccggtagcacacatcacccttttatgtgctaaaaatcaaaagcgtcccagaatccagttgccgtgacagagttgaagttttcagtggtcacggcatgtttagtgtaggttagctaggggtacatggcccacacgtcagatctaggtaaaggatatatccaaaggttgttagagataagtataaattaatacactgtacgtgcataacaacaagctttacatctccaaatagtccaattacttgttggattcttagctcacttgtcctgttagtgtggcaaatgatttgtgccttccctgtgtggaccattcatgacctctgtccatatactagctagtacagtataatttaggaattgataccttgtaatccaattggaatggcatctatcatactatatcaaatactccctccgttttaaaatgtttgacaccgttgactttttagcacgtgtttgaccgttcgtcttattaaaaaaatttgtgaaatatgtaaaactatatgtgtacatgaaagtatatttaacaatgaatcaaatgatatgaaaagaataaataattatttaaataagacgaatggttaaacacgtattaaaaagtcaacggtgtcaaatattttgaaatggagggagtattatgaaataataacaactggcatgatttatgtaatactagtgctaaagcatgcatgcatgtatcacagctagctagctcttctttgcatgcgacatcgtccaattgaaaacaaagataccctttggccaaaagctcatggccacaaattaaaacaaaacaaaggaacatgttcatatctttgcatgatcttgaaagttcaaaccctctcagccttgctctgcttgcaccactgcaaaagaacagagcacacattacaaagcaaaccgaaaaaacgacaaaaaaaaaaaacaacggcactatttgaaacatagaaatattattttatcaaagatagatttaaaaccgagcctctacatctaaactagatatacacagccaaataaataatgcaaaaatctgacactacatatttctgccattgtaaaactatttctagtgaaacatccgaaacacgtatatatgacatcaatttctaagataagtgaaaaattgtttacatctccggtatccaccgatcaatatatttatttggagagtgatattggttgctcaccttgttaatataatatggcagggctgaaatacgggctgaaggtgtgctgcggggcgggagggcaggggacgtacaactacaacaacaaagcgcggtgcggcatgtccgggtccagcgcctgcgccgacccggccaactacctcatctgggacggcatccaccttaccgaggccgcctaccgctccatcgccgatggctggctcaagggcccctactgcaaccctcccatcctccactgatttattaatcctacatgtataatatctgcagagagatgagatgtgacccaattaattgtgcactgtttgcttaattaggccgaagtgtgtgtttgtatttgtgtgtgggttaattaatatttgttcatggggtttacttaattagagtttggttgtgatttggagagggtgattttaagcctgatgatgtatttagttggggatcgaatcaaactgatccaagtgaataatgaagctcaaacaagggcttttccattttagtttcacaagttgttatgggctggctctcaatgaggtcctgaggggctttcgtttgcgtggccttgcaactgcaattccggcccctctagtcggaactttacgggccaaattttgtaacccttttgtagtagtagagccagaaatgctaaaaagaatttggtcgaaaggagccactataacactattgttagttttctttttcaaaatttcctgaatctatagtaaatccctccttcctcctaacaaagccactgcctcccatctttctctaagaaaaccgcatagaaccaaacaaccgtaaaaaaaccggcatagaaataaactaaaacaatatttttatcacccaatcccattacaacctacgggcatataactagttcggtctaaaatttaacgttatggagaaggctaagttaactaataaattattactggtagtccatttctggcatgggctaggaaatagcccatgctaaaagagtcatggaaacagaatggaggagaaagttcactttgactccttcaaaacattaggttggatcttattcgtatccttcaattcaatcataaaacaaggtataatgattcctctaactattgaaaccgacacaaaatgactaggtgatatttgacgtgacaatctattaatcatagaaatagagtggggcccatgtatcataccctctccttcctttctctccaacataactcctcttattggcagtagggtgatggcagggatgcagcagggtggccggtgcgcggaggttgaggagaggcaacatggcagtgatgggggcgacaacagggtagctcacaaatcggcgacaaaggggttgaggtggagcgtgctccggtggggagtggcggtggcagcgacggggagcggccgtgtgctcgcgcggcgcggcgacggcggtggggagcggcggtggcggcagcggggagcggctgcgtgcttgcgcggcgcggcggcgatagcagcggtggcggtggcggaaacctctttggcctcgccacggcctcctccttggagctcgtcgccaggaacgtgagccaccttcttctactgggtcgccttctcgtcgctgtcgtcatcgaccccccactccctccgcgccaactgcctcctcgtccgcctcctctcctgcgctgccctcatcggagctcgagctatggcggcggtttcacctgcatcctgaggatccaggcctcgggctgcggccgggtctgcgtgaccctagatgatctcagatgcttgggcttcatggcgacaacggtgagtgggagacggagtcccggaggcgccccgccgccggtgagcctagatggccccagcacatcctcgatgtcctccatctccatctctggctgctgctgcggaggcgacggtgcgccaaggcgagtggtgggctggtcattggtggcttccccgaccgagtagggtttgggaaaaagtatactttcccacaatacttttttttgtgtgaataacatatgggtctcacatatttttttatttttgttttcattctattgacacgtaagcgccacgtaggacaaagacttggtcaagactgccacctcagccaaaaccacctccaaaaccatcgagggacattgtttgcaccagttttgatagttggaggagtcgatgaacccggttttgtggttggaggatatgaatcttactcgggcgatacttgagcgagtcaaagtataccttttccttcccattttacttgttaagctaagcccatcaatcactctgtaattcattccccctctctccactccaccatgttaccttctaagtttcaaacagtatacgctcctctatatcgccgccgtcaccggcagcggccgacggccgtgaattggaccagctagctggtggagttgacaccataaattcccgccggttttcacaagagcgccatggcggacgtgctccggcgagaggcaggcggcgtcaccacaatcatcttggtgtgctccacggtggcggcggcagcggcggcggctgggacgctggcggtggctgacgcgggcgctgcggctggcggtggcgtgggaggcggcgctcgacgccaacctcgtcaagcagaagtgcgcactccgccaggcggagcgcacactattcagagaaaagtgttgaaccaactaggagcaacaattgaattggcaggggatggagctaaggctgtggatatattcaaagatgctattgagagagtaagtgtttcaggagagcataatgtgccattgccctatgatgtcatattcatggattgccaggtttgtttctccttctagttgttaggaaacgataagcgaacaaacgataaagaacaatagatcaatcacagaagacacgagatttaacgtggaaaaccctcccaaaacaggagagaaaaaaccacgggtgccagccagcaaaatatcttcactatatctagggtgaggttacatcaccgcacggcggcttacaagaggtatatatatggttgaaccctaaaagggatgacgatccg

SEQ ID NO: 70855 - DNA, 1218 bp, Oryza sativa
tgcagcccatagttaagtaataattaaacaatattaatccaacgctagacaacataccttgttgcataggcccaaccattctgaacaaccatcccggctgcacagttctatctccaaaccaggaatatgccattccaaaccaggagctaatcaaattattaccagttatagcatcttttattatgatgagaagtgtgagactaatcacgaaagacattgttagacccgcccataaccgcgggcacggctattcgaatagttttactctggccagaggtgtaccactgtacccacaagacacagccccacaacatgtcaccatgtgccttcataccaccacggtacctcggaaaggagctgtgacagtaccccttgcacaacacaatccaccacagcgcacctttcctggatcataatcacccccttataaacaaggcatggactccccagcgacccccgtgggcttatcttcgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcagaaccatgtgctcacaacccaccattatcaagttttagttggcaagtaattaattaaccaatcacgattgaccatcgtgaactatcattaagccataattaaataatagtgagtcataagttatcccaatagtgtgctaatgtttctaagcatggctaagcaatcatatctaatatttagctgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaacaagagctttaaacgggatcaacatgctcaaagggttgtttgggatctatgtgacttgccttgctggccttggaactcttcaaattcttctcctgcaaaaacggactctccggaaacgtcggaatctaaatagaaatgagcaaaatcaccaaaacagcacacaaacaagcatgaacaatacatgtggatatttttaacatgtagatctcaattttagaaaaatttagagactcgaaccaactaaatccgagctaagatgaattacttatgaat

SEQ ID NO: 70856 - DNA, 4007 bp, Oryza sativa
tattgacggtcagatattatgatttaaggaccgtcaacagtaacctcattccttcgttccaacaaaatctaaagaactcacaactccaatgaggatcaaacttatcaccttgacaatattcttcatcctgatcaccttgataatatctatcatctcggcgatgtctaaaattctgaaattcctctgaacttgtttgtcatgtctcttctggtacttgttaatcaatctaatgctatcaatcatggcatacaccatatttacaggaaaaaggatgtccatcaatcttcatcgacctttttccatcatcaaacttgattcttccttgttcgatggcggattggatttgctgcctgaacaccttgcacccattagtatgatgagatcctgtattgtgccacttgcaaaacttcctcttcttcagctcttcagccgatggtagaacatgacctactagcaactggatttgcttttcttgcaacagtaaatcaaagattttgttggctttattgatatcaaagtcatattcctcttccttgtttatatacttaacccattgacacatagttgtcttcttgatcatggaccactctgccaaactgatctctaggtcttcctagttgtcttcttgatcttggaccacttagccaaactgatctctaagtctcctcctcagaatcataaacatatctatagacgtagttaaccttcttgaccttcttggcctcctgaaaacgttgctcatgagccgataccttctgagccagatgtgctaagctctcaaagtcttgtgatgaaaatttctctcttatcgacccaatcaatcactggaaagccaaatcgactagctgtgaatcggtgttgacggtcgttatcgatcagttgcgaccgtcaatataaccaaaatttaggagaactagtgatgcttgcaatgcatatatctgttaaaataataatattccactagtattaggtacagtaaccttttgcagagaatgacaataaagtggaggagaatcgacatcaactcagacgataaaccaatcggacagtgtcgagaaccagacttatgtatgaatgggccaagaactcagaaataacacaacacattgggccaaaattcacaagtctacgaaggaggactacgaaggaggccgctagccaaagatgggctgggttgagccaacccatggttcggggggttcggctgaacctcccgtggcgccgatggatgcaaggtttggatggacggctgggattgatccccaatgacggtaggagggtattaccgaccattccaaccgtcgcaaccgtcattacctacctataaaaggagctcctcttctcacttcactcacacacctcaagcaatagctctcccatttctctcaagtttagtttagtagtatctagctggtggaataggaatagagtagaaatcaggagtccggaagtcttcggaagagttcgggtatggctctagcagctttcctttcttcttttgtaagctttgtacttttattagaataatcttctatatacatttacggtattgaaatactttccgagtatgtgagtacctattttacattatgttcatgttatactgaatatacggctagcatatctaggagatgctttggtgcgggtataatgtttgcttatgcaattactctatgtcatgacgatgatattagagtaatatctggtagtttagacgtagtgtctagattacgggatatcattatttggggttatatgttgcggatgagaggtgggccgctgatggtgacagctcagtacgggtattcctccgcaccggtatataatcctaagttaatttcctggggagggtattcctccgtatttagccccggttgtatggtcatgacagactatcgtaaggaactcggcagtcaggggtggcttctcgaaatactaggagggcatcggatagagggtattagctagtatatcagttaactagaatgtatgtatactatgtatattagaagtataggaatatattttctttctcttttctttccacttagctcagataatatattatgagaatgagtagtaatgcttgtgtgtcactctacccttggattatcttaacccctgcttagaatatgattatcataagtaatatataaattattagtcaatctatctctacatgatcttcccacgggataaaataaatacgatacccttagaatactctcgggtgaaatgctacaatggtatatctgtgcgcttgcggatgatctctgtaaccataatataccagaagtatttctgcgccattgctgggaattatatttctagtaatgtcgttaagaaataccagcaagcatttttggcaccgttgccggggaagattcataatagagattgcttgaactaatactttatatttacctctgtataatcatttcctttgcaggctaaccttggttgttttcactttttgttgtgaaaacagggtagtgcatgactggtttcaacctgccggaaaacttcaaagaatatccagaagctttcttccggggcgtcagaccgcgagccgttgctccgcagaaaactctaccaacagagaaaccagccataccagcgccaccgatcttcaatactatggccagcaagactcttcgcgagttcgctgctccctctactgacaatgtggccattgggccgcaaatcaacataggagacatggatttcgacttgaagtccagccttatcacaatggcgcaggctagcccgttctgtggcaagcctaatgtggatgccaatgctcatctgcaacagttcctggagatctgtagcacgtacaccatcaagggcgtcagtcccgacgccatcaggctgcggctgtttccgttctcccttctcgggagagcgaagcagtggttttatgccatccgtgctgctgttaacacctgggacaaatgctcaccgggattcctctcgaaattcttcccgatgggtaaaaccaatgcccttcgtggaaggatttccaatttccagcagacaagggacgagtctattcccgaagcattagaacgactgcaggagtatgtggccgcttgtcctcatcatgggatggacgactggctgattgtcacgtcctgataaattcatcccgaaataaaattcattctctaaatggaataatagaattaattaaaattcgaaaagaaattggttaacactaaaatacgtacaagaaaaattcgaatgtggcccggagaatttttgttaaattctccttggtctaaaatgagccctcaaattttacttgaattttcagagcaccggaaatatttattaagcaacaaaaacaattatcaaagtttattaaaaagaaaaacctaaaaataatcctccttcctcatttgggccaagtctggcccaaagtcctctctctctctctctctcggcccgcagccaaagtcctctcttcctccctctctttctctccctctccttctctccctccttctcttgggcctccccttccccctcggcctaggtcccttttcctcccctcccgcctaggccgcgtcccggcccaagccgccccacccagccgccccagcctcccgaggcgcccccctgacgcgcgccacatgcgcgccgcatgcgcccgcgtggggcccacgcgccggtcatcttcctcctcccggacggcctcctctctctcccgtgcaaccctagttcgttcctccccaaaatccacgccattcaaaccgggaattccaaaattgattagggggaattaattcccattccttcctcttcaattccccctaatttcccccttgattcgtgcccccaatcgtcgggaacgcccgcgccaaccccggccaccttccatggccgccgggcgcctattccgccgccggtccccgcctctcccgtggccagctccctctccccccctataaaatggaaccccctccgggcgttgtctcgttttagccccttcccgagattctccg

SEQ ID NO: 70857 - DNA, 11422 bp, Oryza sativa
ggccgctctatacgtagaggatcccccctccgaatgcgcatcacaacatactatagacaagcgggggagactgaggttcaaaattggggctgatcgggcgcctgtcacaccctgaaaatcgctaagttataaatcgttgtgaaaaaaggaatttttagaaattatttaataattaaagtaattgtgtgaataaaatctatgaaatttttgaaagttaaattgatatagataaaattttattaaatactttgtgtgcccaagtattttcaggatttttcttggatttatttgagcattggaagtatttttaataaatgaaagatcatttcagtaattatttaaattaaaaagttgattaaaatttctcttctgtccactcctctcctgtctctcttccttagcccgcagcagcccactcttcctttttgtcttacttagataaagtccattttgggtccctcttgcaatcaggcctagtaaagaaaaggaagcccgaaaagaagtctatttgacagagccagttcatcccgataccgcgccaatctccaccgaatccgtcgcatcccgtgctctgtttccaaaattggttgcaaaaacggattcccctcgatctcctctaccttgtccctaagaaacccctttgaataccgttgtatatcgcgtgaattcgatgcggttttgagctccgtttttccggcgaaccctaactaatccgtcgccgattcttcccgtaaccgagccgatctctccctcttccggctataaatagcagtcccaagacctcctcttccgtttgctcctttttcccgaatttttccctaaccctagagccgccgccacgctcggctttgctctcctatgctggccgccgctccagccacgtcgcgccgcctcctcggtcgaccccgacctgcgccgtcgcctcccttggcttcgcaagggtgagagctacctcggccactggttgttttgcgccaaatcccaccagaaggttgccgtcgccgtgaaccagtgggttattgccgtggtttggtctccagccgtgtcgttcgtcgtcgtccatcgtcgctttcggacgccgttgcttccactggattcgcagctgtgaggagaagcccgtccacccctccgttgccgccgcttgtcgccggaaagccgtcgccatcgtcaaccaaggtcgccgccctttggagctcatcgccggccatctccctcgccgtctgtcgtcgcgtaagtggtggtaagggccgtgcttagaaatattagctcattaatgggataaattatgcttcactattacttatggttctattaaatggtagctcacgatgggcaatcgtgttatgataattaattgataattaaaatatgattaatggtgggttgtgagcacatggttttgaaggttgtgctcataacaattaaggaccggttcgcgagctactgttgtgaaacattaaccgtgccaaccacaagccagcgtgggcaacggctttaccttttgtatagtatggttcattacggggtgccagactgagaagtggtggagataagcccacgggggtcgctggggagtccatgcctctggtttttgagggggtgactacgatccaggaaagatgcactgctttgagttgagctatgcgagaggtcttgtcacaactacacaaatggtgacatgttcagcatgggcacatgatgatatggtgacatattgtggagttgtgtcttgtgggtacagtggtacacctctggcttgagtaaaactattcgaatagccgtgcccgcggtcatgggcgggtctaacaatgtctttcgtgattagtctcatacttcttaccataataaatgatgctataactggtaataatttgattagctcctggtttggaatggtgcattcctggtttggagatagatctttacagccgggtatggttgttcaggttggttgggcctgtgcagcatgggtgtgctgttcagtgttgattaatattgatgattaattactctattgttttacaattcttaaatgtttgctaaatgctgcttttgcaaatgagccatatattatgccattgtttggtatccttgtacacttgcatatttgttgtgcggcttgcggagtattccatgtactcaccttgcaataatcaatcaaacctcggttgaagacaagttgcgaaggagaagacgtttggcttataccctagttgagctgcctgtgggagtggagccggagcttcgctagaccgtaattccgctgttgttttctcttttcttttgtaagtatgtaacattattattatgatgaatctgtatattaaattgtcagtttgtgtacctcggctgattcctggacgaggatttcatgcacaaattagttcggaaattactagtgaatttctgggcacgaagattctattgtctacaacgaacaagatcgcataagttaaaaatgcatcggcttgtagttgataaaattaacagaaggtgagaattttaccagtgggacatcgtcagggaaaaggtttgtcaaatacatggacggtgattgatggaacaggtgttttttccattctatccaccatcggtcaaaggccatgctcctgaatgtccttagtttgatgttgtcaatattgccaagaggtggtcctggtagattcagcagccaatccatcatatggaatgatgaaatctctcctctactttgaatcctgtcggcaaagaataggctaattggcagttgacccatgccgaattgccttgcagcgcttgttggatgatagaattcgtaggtcatctggatattcttatcttgatagatgccaacagggatgatacaggggctgatagctgttgagaatacttctctggatttatcatatttttcagagttgatttcatcgaatcgaaaatcacatgttagttcaaagctagcagatccttcatatgcaaaccagatcctatcattcttggggaacccatcatagaaattgttgaaccactccttgaaaggttcggtcgatagcttggacacggcgctaaccgatgctgcttctccgaaggacatacatcatcagcatgtggtgcttgtttctccatcgtccctgacgatcggctcaaatcttgggaattctacattggctagtgctggctgattggcaacttttctggtatgaagattcagccaaatttggagtaaccacgatggaccccctgtgccgattgtttttccagaggctatcttgtcaattgcagtattgagggtctgatacaagtagcccagcagatacttgccaaggggaaaatgcttcttttctaccagattttcatctacccgttaccagtttgcggtcggaccataggttggaccacagaataagaacttttccagccacatcataagaaaagctgtgttcatggcaaccggcccagtcacatcactcttggggtaaccggcctagttcccatcttcttggcaacataacctgaccaaccacctatgcttctggttttgaactcatgggtaagttaggtgttcaggctggacaagttagctgatgaagtgatatctagaccagtgatcatgatgatatctaatagtattggggtcatcggtccttgagagaaaaggaacgtgttcatggctgtggaccaaaaataggtggatgctatcatcatgggttcattccttgccatacttgctgcagttaaggccaaagcttgcgatatgtcgatttcgtcccagtgggctaatttgctagccaacatcctgttgtaccaggcaagccagctgacttcggttgatggccaggatttgaaggtgcctttccaagggctaagatctggattggcaaatctaaaggggattcggttggtttctccattgatgaactctatggggtctaagttgccgattgggccaaggaaaaactggaattcatcggctacgctaggaattgcaacctggtgggtgagatgctacagaggaggaaaatcgaggattgagcgaaagaagaaccaaatctatgaggaaaagaagggatttagctgatgggtacttacttcgacgtattcggtggccgatgagctcggtggactagcgaaggttgacattgtcgttggcagagattggaatcgtcggaatcgtctgcggatcgccagaaagcttgaagggtgtcgccggagaactcaaaggagaatattggggaaagtttttggctagagcggttaaaacggaagtgacgccgtgaaacgagaagagcggtggttactatttaaaagggagcgctgtaacggccaaaacggaatcggtttttgaaaccctagatcggctcggaaaagaaatttgagaaaatccgccacattacaaataattacaaatatagcggacttggggggcatgtgttgacgaccaaatttggtaagatatgaaccaggttcgacattggaatcgaggcggattcggtaaagagatagattcgaagaacagagtatgcatcggctgcaaaggcatcggctggagtctgcatcggctaagatggatcggacagaggacatccgatacagctgatagaggtgatgtagccgattctgatgacgatggtttcaaggatttttctagaaacgatcaaagtgcttcacgaggattgccacgatagagataaagctcttggataggaaattgtatctattaattaggatatttcatgtaatttccttagagatatgttggggcaaaagtctgccgcaaagacttatggtattttagagtttgttagagataagtgtcgtgtccggcggggacatattttgtaatctcgggtataaatagaacccgaacccatgtaatcaattatcagacgatcaatacactttcggtgcatcgccaccctttttacttttgttctatttcgacgagttcttactttcgggttgagcttcatcgattcgatcttcaactagaggtaaacttgtcatgacggcttgcgttatcaggattagtgcttccatctttatgacactctaatcctgttcatgtaattcatcgagttatcataaatataatctttgtgagcgtgcgggccgacgaggcggagccggaggtggctggcgatgggtagaggcggcggcgctcctcgaggaggcgaagcggatggcgctccggcggccttccgcgagcgggaactcgcggacagcggccggaagaacctggagaagaagacagggagtttagggagcaaagaacaggcacggcgccgagggaaatgttagccggaagcggcaaggatcggcgaagctcaccttggacggagggaagcggtctctcacgatgattcgcgaggagggagggctggacgggctacgcacgatgactgcggtgccgaggaaggcgacgacacagcgcgaggtggtcgggaacggcgtcgagaggcgactagaggtggctgctatggtggcggttcgggtggtgtggtggagtgacggttccagcggcggaatggaggagcggaggggatgccggggtacgacatgacacagcgaagccgtcggtggcggttgcgcggagcggtggtggcgggagcaacggtggcgaccggctagagggcgtcgtcgggcggcggagctcgggcgcgcgctgcggcggtgtttcggaggcggagagggtaaaaggagtaggggccggggtgcggcacggcacggcgatgccaatggtggtggcggcacagcgtggcggcgtgcggctagaagcatggcggcgagcggcggagctcgggctcgcgtgggaagtgcgggagaaggcacgacgggctcgggaaagttggggaaatgagcgaggggagtgcgggaaggagttttatgggtgcgggacagcgggagggggccggggcgatgcggattcggggcagcaaccaccggcggcgtggggtggtgacgtgggcacgtggcggggcaaaccagcgcagttttcttgggggaaaattggggaaatggtggaggaggtgggggggtgcagttccaccacttgggcttgagcaggaagggctgggtggtgcggattttgcgacggagtgggcagcaatggcggccacgggcggttactggcgaggtggctggaggaagggggaggagctgacaggtggggcctcgggtccacctgtaggcgagggaaggagagaggaggtcggggggcttatgtggacttagggagagagggggagcgagcgggccgagcggcccaaagaggagaggggtgggaggcggccgggctggaggggaaagaaggagggagagggattgggccgagggcggcccaaaaggatggagagggaattttatttgttttttctttttatgtaattggttaaatgaactttgtgactttaaaatcatttcatgagctctgaaaattcgcggaaaaatccggagagtactttagggcacagagaatattgcaaaatatttccggccaatgatttttaagggaaaattttaattctcccattattccacttcattaaattgctttaacttttatttaatttatagaaaatgatttattaattgatttttaatcccgaacgaaaatcggggcgttacacctggccattcagaccgggatcagaccgccaggcccgctgccggctgtgcacagcccttgcacaagccggcaacccccacacaataaaatccaacaaaaaaaatttttttggagcaattttgaaatgtatgagttgaaatatttcttatcatccataataattgaaaattatgaagacttgcaactaaactcacttaagtgctaggaggtgacctattatggtctatagggtttttttggctaaactgattttcaaataacttttaaatgatttggtttttgaaatagatttgaataccaaaaacatttgaaaccttctcctctaccaactttgtttaacacttttctcaaattcctcctcaaactcattttgaagataaatcccattttggccaaaaataaaaatctagtttcttcaaaagaggaccaaaagggcattttcattgaaacttcatttttcttgcaatgtgaggcttggaaaacatatggggaaccttttgaaatatttttcaagagatagttttcaaattactttgattttgcaaaagttttgacttatgttgacttctagtttatttgctcacacacaaagagagttagagcacatgtaagagtgcaaaactcccccttaatgtgacatgctccattttcgcaaataagagccaaatgacaataaatccaaagcataagcacaaataagagcaaataggcaaaatgaacaagaagcaaccatcgtgcacaatctcaagccacattagagaaatcaatcacatttaactcattcctcaatttgcaaaagtgggtttcatcaagaggcttggtaaagatgtcagctagttgatcctcggttcttatgtggctaatgactatgtcactcttggcaacatgatctcttaggaagtgatggcgaatgtcaatatgcttggttctagaatattggaccggattgttggctatctttatggcactatcattgtcacataggagtggggttttggtgaaggatataccatagtccaacaaggtttgtttcatccaaagcaattgggcacaacaactacccatcgaaacatattccacatcggcagtagagagggctacggagttttgtttcttggatgaccatgacacaatggatctaccaagtatttggcaactaccggatgtgctctttctatccactttgcaaccggcataatccgaatcggaatagccaactagcttaaacttagtacctttttgctaccacaagccaatagttgaggaatgctttaaatatgttagaatccttttcatggccactaagtgacactcgttaggagcggcttgaaaccgtgcacacatgtaaacactaaacatgatatccggcctagatgcggtaaggtaaagcaagctaccaatcatagaacgataaagctttaaatctaccggtttacccccctcctcctcatcaaggtcgagatgcccgttggttgccataggtgtcttgatgggcttcgcatcctccaagccaaacctcttgagtagatccttgatgtacttggtttggctcatgaacgtcccgtccttgagttgtttgatttgaagttcaagaaagaagctcaactctccaatcatggacatctcaaattccctagacatcatatcaccagactccttgcaaaatacctcattagtagaaccgaatatgatatcatcaacataaatttggcaaccaaagaaatcatcaccaatgatttttgtgaaaagggtggtgtcaacttttccaattttgaaattctttgacaaaagaaaatctctcaatctttcataacaagctctaggagcttgttttaaaccataaagagcttttgagattttataaacatggttaggatttttagggtcttcaaaaccgggtgattgttcaacaaagacaagttcggcaatttcaccatttagaaaagcacttttcacatctatttgaaaaagttttatatcaaaatatgatgcaaatgcaagaaggatacgaatgggttcaagtcttgccatgggggcaaaagtttcaccgaaatccaagccttcaacttgtgtgaagcctggcgccaccaatcttgccttgtttctcaccaccaacccgttctctcttgcttgttcctaaagacccactttgtccctatgacattgtggtctctaggtctttcaaccaaagtccataccttgtttcttgcaaagttgttgagcttttcatgcatagcatttacccaatccggatcaccaagagcttcatctacatgttttggcttaagacaagaaacaacaagtaatgttcacaaatcgaagcgacacgagatcgagtttggacacccttactaatgtcacccaaaacctcgtaaattgggtgatccttggaaagagcggtgtgtatccttgttagcataggtggatcttgtgccttctcctcctccacttaacttgagcttttcttggcatagcggaagtagataactcatcttgagtggaggtaaatggcttgttttccacttcaattcgcttgacatctccaatagacatgttcttcatagctcttatcaagccttcatcacctacatcatccaaattcccgtgcccctcttaggagccaatagtctcatcaaattgaacatcggcggtttcttacacaataactttgttcttgttgtagaccaggtatgccttgctattggaggcatatcctagaagaaacccttttcatcacaccgactttcaaatttggttagtctaacaccctttcggtgtgatgaaaagggtttggccccttgatgctggtgggggagtactcccacccaccaaaactagccgttgggggcgaaatcccccaactctatgtactgccggtctgaccggatgtgtgtggccggtcagaccatgctactctacaacggctagttttctagccgttgtaggctgtcattgggccccatcggcttggccggacagactggagttgggtggccggtcagactggcctcggctcggtcagaccgcccccagctcggtctgactgaatgcggctctagatcgccacgccgagagcaccacagggagaggtccccttggctggtctgaccggcattcacccgtcggtcaaatcggccgacctacgccggtcagaccaccactaggcggccggtcagaccggccttggtcacacagcaagcacaacaggaaaatgagacaaagccaaatctaaatgcataataatctaatgtggcaatttaaatcatctctttgctaggtcattacccctcttaatagtacagtaaagctataaataaactagcacaaattgattgaccaacacctcgatcgatttagaactcaactactagtttaccgtcatctatactttgctttgcgccatcaatttttagtccatcgataattatccatgcgcacacatgatgtgaacctaactcaaaacacataactcgatagaacggttagtccacaattagcgcttgtcattaattaccaaaactaacaacgggggcctagatgcttcaaagatcatgcacgatactaaaaggctagagaacaatggacgtggtgataaagaatctatatagtatactgttggcggatgttaaatgctgattctataccgccaacatctgcataaagtttagataataaaacatccaacatagtgataggtgcttaatctcacatattccacaagtgttggtgtgtacagttgtatgcagaagataaaccctgaagttgggaggcaaatcagactaaagtgaggaaaattatgtatccatacaaggaggggttgttaacttcatccaaacatcagtaaatcaacccaaaaactccgagaaatggatagaggaaggtccatggagtccaccgaccgaaggctaggccaggagggcccagcccaggttcggccgaacccccttgatcctggggtttggcgtggacgctctagatgttctcttgcagttaagggagttcttttgatgtgaactttgtttagcaagcatggtggaataaactcattcatagcacaacaataataatatcataaagaatatcacagagttccacaaatagcacataaatcatgatgcaatcgactgcataagtacgcagcccaaatagagttcatccaaaagctacatcgagctaatcatcaaactactcgtcaatctaggtggggggtgtgtctcgcgctatccaaaaaccatatgaagcgagagcgaagtcgcagtagacctccattctagtcgtccaaccatccgcaggatccttgcgcgggaagagggtatcgcatgctcatgcaaatctgagtccccacggctcagaggtggtggcctccggatctggcttgggcttcttgcccggggtcgtgtactcttgcgggcagtgctgagggtgcgagggcgtccaactcacagttgcggggcagttcggacatttccccttctcacaaccgtcataactgccctataaaaggacctcacttcattcactctcacacacacttccaagattgagctgaattataagaggctctattgtactatattgtatactagaataggaagagagtatagtagaagaagtcggaagaattccggagttatcggtaatcttctcctctgtttattactctgaattcaatataatattatcttgtgagaattatctcttggttagttcctaaatagcatacgggattattgttcactataatcaactaaaatatagtgattgctttggttagttataaacactaaagtagattctaactgcttagacgtggtgttt

SEQ ID NO: 70858 - DNA, 3656 bp, Oryza sativa
cgctcccccccactgaggtaacttgtatcacattgcatatttctcttatcaaattacatatttgctttccaattgcatcttataaaaataaaaacaacataaaaatgtgcaaaatagaaaataccaaaaagataggataggtttgagtcatgctaggtaagacaagctagttctccttgttgaaatgatgaatagttgctctgttttatatctctgatatatgggttcttggtaagtgctctctcaaaggttaaatataagtagccaacaattatctgggaacctgaggtaaatgagctgcacttgctgatctgagtctaagttgttgcgagatatgagatagtaaatacgagttactatgatcctgatactagtttgacttgaattccggatattttgtttttaaaaatgataaatttgagagttcctcatttgatataaattcctaccagagccaaaaatatgccatcatgattaaaccatatacattttggttgcttgccattccattgaacattgtcaaactcttgtgacttgtatagatacttctcatgctctatgatcaagatcatacacccacatatatgaacatgctaaactaatacactaggagctaagcaatattccattccatttccatattaccaccaaaataaattctccatgctttcatatgcttttttctcctaaagagaaaagtccttttgaaaaaaaagaggagggaaaggcatggttatgaaaaaaaaaattcatgctccatcaagcttgatgtaacaccccagcccgtttgaagcctagtagtgtgtgtttggcccatgtggtgtttggcccatgtggcccagaagtggatgtgtagtggtggtttattaccaccttggaagtttaggtgggtgaggtcctgcttataagccttggtgctccaaccatggtatccctgggttaactcttttacacgaagcgaggacgaatgtgtaagtgggataccatgcgaacgtgggtccgctcaacgtgtagagcagactaatgcggattttggaggcagggtgttacagttggtattagagcgtaaacctccgctgtatgatgcatgtgctttgggccatggtctgcaccggagggggttctgggcctctgccatgtaaacggtgtgctgccggggcgttagcccttaagcgggggtgaatgtaacaccccagcccgtttgaagcctagtagtgtgtgtttggcccatgtggtgtttggcccatgtggcctagaagtgaatgtgtagtggtggtttagtaccaccttggaagtttaggtgggtgagggccggcttataagccttggtgctccaaccatggtatccccaggttaacccttttacacgaagcgaggacgaaagtgtaagtgggataccatgcgaacgtgggtccgctcaacatgtagagtggactaatgcgtattttggaggcagggtgttacacttgagcatgatgttgaaaagaaaaatgtagccatgccctctcctaagcaataaaagaaggatttttgggagaagaaagtaagcacaaaggagaagtgttttctttatttttcttcatgtaccatttccaccatacaccacacacacattttgcacgatcttgatcttgagtatgtttagtcatctgctttagtctaaatttttgacttagtaataaatgtgaatgcaagtatgccatgtttgatccctaccgagctccacatatcaaactctagagtaggaatcataaaggcaacatttggtgaggaattcatattgatacacttagagagattgagtgaatcaattgaagaacttggttttctttttcaaaatcatttgaaaacttccgaaagaagagttgaataaagattgggtgattggtactctaaattgctgttctttcttttaaccgcccaaggcaaggagaagcagtgtctcgtgggaatcaggggtaagggtaaccaccgtgccaaagattatttaatctcagagagagtacatataccttacacctgtatgtttgagatatgcagcatagtagcaactcctgatcaacaaccaagtctttgtttactttcgtccttcactcgggacgagcaaaggttaagcttggggggtgttgacggtcgttatcgatcagttgcgaccgtcaatattaccaaaatagaggagaactagtgatgcttgcaatgcatatattgttaaaataataatattccactagtattaggtacactaaccttttgtagagaatgacaataaagtggaggagaatcgacatcaactcagacgataaatcaatcggacggtgtcaagaaccagacttatgtatgaatgggtcaagaacttagaaataacacaacatattgggccaaaattcacaagtctacgaaggaggacaacaaaggaggccgccagtcgaagatgggctgggttgagccaacccatgtctcggggggtttggctgaacctcccgtggcgccgatggatgcagggtttggatggatggctgggattgatccccaatgacgggtggatggtattaccgaccattccaaccgtcgcaaccatcattacctacctataaaaggagctcctcttctcacttcactcacacacctcaaacaatagctctctcatttctctcaagtttagtttagtagtatctagctggtggaataggaagatagtagaaatcaggagtccggaagtcttcggaagagttcgggtatggctctagcagctttcctttcttcttttgtaagctttgtacttttattagaatactcttctatatacatttacggtattgaaatactttccgagaatacgagtacctactttacactatgttcatgttatactgaatatacggctagcttatctgggagatgctttggtgcgggtataatgtttgcttatgcaattactctatgtcatgacgatgatagtacgttttgtaccacagttgtcgctgccaccgtgtctctgttgttgtcaggacctacaaaaacggaatcggctcgctgccacggttctatttttgtagttttcagaagtttctgtcggttagttttggagttcttgagttgcatctggagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcctggccgagtcccactcgcccctttggccgagtccgactccctccctctcttccacggttccgagttgtgtcaaacaccttggcgaatttttgtttggtgtcggtttcgagatctgtttggaaaaacggaaccggcataaattcagcattccattttttttttgtataattttaattttgggtttagacttttacatttgagtccctgtaaattttatatttatgtttgagtccctgtaatcttacattaaggtacttgagtcagtttttgttaaaaaaaatcaagaaaaaagtgagaaaaaaaaaggcagaaaggtgaaaaaaaaaagaaaacaaaaagccgcaccaaaaaaaaacag

SEQ ID NO: 70859 - DNA, 2673 bp, Oryza sativa
agatggtgagagcccatgagaaacttacaggagagagagagagagaggaaaaattgacatgttttgcaagtatgtatgtgtcatctgtagtatgtgactgtgagtgggtccatgaacaaactgtgaagttgatgtatccttctcctgctgcctcccctgaacctgaagaaacaaagtaataccccaatggggattttgttctcttccccttttcttctaccactactactgtttctatacatgcatgaatgactcttctactgttctatacttctacatgcatgatgcatgagttgttctttgttttaaaaaaataaatttaacctcgtgcaatcaattcattcaatgctttcacctaataatgagtaatgcaaggaggaggggggcatgtgcagtgcatttctccttctctaagcaacagggtggtggtgatgcactagcagtagtaggagtagtgaaattatggagaaaaaattcatagtagatgccccaaggaccattaaagaagtgatgtgccacaagcaatgccgacacctggggattttcatgtcctgatcttttactagtctattaatggccggtctctacctttctgttccctcgggaaggaaaggcacaacaaaagttagagtgtacaagtgggctcaatttgccctaataggatacaaagaaaaaaaggctagctaagttgatggtctaaggcacacaaaaaggccactaaactccaataatccgccagattccccacacagcatgcaggtatcaaaagattaaaaaaaaatggagatctgtctcctgcttttgttgcctatgttagaaaggtttgtacgaggctaaaccacagatttattgctctgtccggtcaataatccaaagcagcagatgcctggagaaaggaacatggaggcctaactgaactgacgtggtgctatcagcctcttaattaacttcaggcagttacctcgtgtcaactaatgaaacacaaccatagctaattaaaacaaaagtactcctacctgaagaatctagagtgaaagctttgcattacctagctaggccaccaagctaatttggaggcaagagcaccacttggtatgtatgacgactgagcaagctgcaagttgccctaagaaggtaggtacacaatttctacatgcaggacagattaagtataaaactaaggttagtactagaatagagatttgattaggaaaataaagaatgagatgcaggtctcagattcatctgaatggggggcttcctcgcggcaattgtgctagtgatgattaaacttaataggttaactaccgtatcaacagcaagatttcctgtctgcttgcaagaaccgtagccatgtgcagggggagctctccctaatgacaaaagatgaaccttatccgaggcactccagggttgcatgattaacgcctttgaaccccaaataatatatcttagcattagcagaaaagagtcatgtgagtgccataatgataaagtagaccctcacttagtctacttaacgcataccgagaaaaaggatctgtttttttatatataacaaaaaggaggccttgtcaaaggaacaactgccaagtacagactaatcacgtcatctatgttaaaaatatacagctgattgtgcatctctgtctggaactaaacccctgtcctacctgcctaattttagtctctactcaatgtagttactgccagggatagagaatacaggtttaggcaaaaaaaaaattaggtgggttaaaccaaagaattactaaacacgatgcatggtggtgagcaggcaatagaattaactaccacatgattaaaaacggttatacgagatgagattgaggatgcgtcacatgagtgactcagtgacccacacacccttggctactgggactaccagaacctgacccacaaaactggatgcagccatgcaggggcccaactcaaaaaccggacctacaagacgctatgatatacccaccaccaacaccaaggaaggcatcactactgcatcatcagccacaaggccagaaagcccgcaagatcccatttttcgctacaagaagctgctgccttcatgtagatcatgaatgggcatggtccacaaagagatggctaacccagatgaatggtcatctcttgtaggcattatttgcccttttcctgagtactaccttcaagtggttctagacgccagcttttgtacacaaacagtactttccttgaaaaacaggtgtatcatgcgcatggtggaccagtattggactgtaaggaccaaagatatggccggttctaccatgatagagaaaactatagaacagtcagtaagttggtaagggtgagaaatgacaaggacaaacatttcccctatgttatgccgtaagtatagacagtgaaaagatgttttcagtcgttgatgacaaatgccttgacgtagcaacatcataaagtaactgatcatcatgatcaagagaatatgacaaattagttttttaggagtacacttgtcgacatcctagcgtaaccaacagctcaggttttgtctattatgactgatgaacatattagaggcttttaggtaatgaaaatctgaaccaatgcgcttgctgtttttgttccagaatatcaataatttgccatactgaagccaacactagatagata

SEQ ID NO: 70860 - DNA, 35368 bp, Oryza sativa
  unsure (1)..(35368): unsure at all n locations
ggggggggggggagattgcgagaaaggagggcgcactcggtggtggtggactggtagtagtagctttcggtggcgagcgtctccataaagcggcggcggcggcaaagatagggtcgtcgtaggaggggtgctgtggcgacaagaatctgcaggtatcggattataatcttctttcttttctttctttctttctctcttttgttctcggtcttcttctgcatcttctcgcttcctggcttcccttttctctgttgcaatctgttttttggaggtaaaataaacatgttcttgggttatatctggcgtgttcgacggatttcttttggagactgtgctgttgcgagtgattaaaaggggattttttttcttgatgtggtggatttcttgccgaattttggcacctctttccgttgcgagattcttccagcgttggcattgcttgccattagccaactttgttttttttttccttcttctttatctgtcctgttcctctctgacgccaggctgcacctgcaatcctcagatattcatcattcggctgggcgctcagagatcaaagcaaagttggcgattactttcttgatcattcctcggaagtgctcgtcaggtgatgcccgcattggaagatccttcatggatgttcgcatggtgaagagcaagtccctgcccatgattgcttctgccgccgtcttcttgctgctgctctccgccgcgctgccgctctcgcagtcttacacttatgagcaagatggtatgtactgtccttttggtggttttgactgttgcaaagattcagaattcatagctgtacatgatcatgaattgatgacatcattagggacccagattatttatggtttgatgacggagctgtcttgtactatcacattttactccaaaaatgtgttctgtggcaccttatttttgtgctttgtttgtgtttatcagtgtttgcaataaatggcttgtacactgcacttgggtcaccttcagtgcctggatggattacaaacggtggcgacccctgcaatgaaggctggcagggtgttgaatgcgtggtctcaaatattacctccatgtatgatctgctattacactttcgttttgttaatgttgtttgtttgattacctgtttatctggttatctgaacaatgtgatatttctggtagaactctcaatgctgcaaatttgggcggacaactgggtaacacactggggaatttcacatcgctaatcaccttgtaagctgatcattcgtgaagtttaagattattggtgatttcctctcgaattgacactgttattgacttggttcttaatgcttcttggtttacccaatgtagagatcttagcaacaataatatcggtggaaccataccagataatctgccaatcacattgcagcgtttgtatgcccatttgatcattttgttactcttccaaaccatctatgtggttattttaatcttttactatggttttgcttgtcaattacagtttcctttctggtaaccagctaagtggtagcattccaagtacattgtcgacacttacgcttttgacaggcttgtaagtatattgttgcctacacattcacaagacttcataaagttagtgctttcagtgataattcttgcatttgcaggtccctcaataacaatcatttatctggagagataccagatgcattttcaactctaactggacttgcaaatttgtaagagcaagtttaagtttgctctaagtgttattctatactagcatttgttgacaatgtgaagtttcttaccaaagtgatcaaccttcttgaatagagatttttcttccaacaacttgactggtcctttgccaccttcaatgggaaacttgacagcattgactagcctgtgagtattgaagtttattgcactgtctttcaagttgacttttcactagtgtcaagtacttaatgttatactatgatcacaggcatattcagaacaatcaaataattgggttgcttaatgtgctgcaagatctccctctccaagatttgtatgtacacaaaactacagttttttttacttaattcttttctccaagaagttcaggaaacctgctatttcagtaaagataatttctctctcttttttcacgccttgttttctgtggtgactaattcaacaggaacatagaaaacaatcttttctccggtcctgtgcctgtgaaactagagaacataccaaattttaagtaaggaacttccccttgattgagttgtttctgtcgatcgttgctctaactttaatgtttaaaaatcaattccattgctcgtatactcttttaatattaagaatcaactagtttttcatgtgcatatttgtgtttagcgaaagaagaaaagttcattcaaactaatgtaccacacaggaaggatgggaacccattcaataccagcatagccccatcagcattgcctcctgctgcaccgacaccattaccatcagtatcacctccagcagggcatgtccccacaaaagaaccttcaaattcttctattgcaccagcagggaatgccccatcaagaaaaaacaatgtttctgcaatgaaatttgttggatacattcttgttggggtggtatccgcggtggttctcgtgctaatggtgatgttttgtctatccaagtacaaagaaagaaaatcaagagatgatgtgtatacaaaaaaccagttaggaaggtctcctcaaaagcttggagaacctaaaatcaaggaagtttcagacatcaaggaaccaccagttaaactcaagaataatgctggaaaaggttgtcattgttctcttggcaaacaaatgacttccagtttttttactttattttttgcccattgactaaactgatctcttgggcggtgacagcttcaaatgtgatttctcatacaagggaggagcagaaattgaatgtgtcaacagcaggtgaacaattttatgcctaaaaaagtgcacatgccctttttttattcgtcactattctgcaagttttagtatggtaaagcttaatagaaacattggcatggcagctgctttcttcctctcttgattttgacattccaatatttctttgcagcagcttcagatgcagtttatgattcaagggaagagcggaagccaggttcatcaatgtcaggtaaatgactcgaaactaaattacatgcagaagtgctattttactgctctgcgagtttgagtatgtcaaagttaacatgagaacttacatggcagctgctcctagggtggttacaatggaacaaaaagagcatgtgattgatatggaaaaaaaagataattttgtggatgaacaactgcatcctccacagtctgctgtactgcgtactgaaaaggtcactgtacatcccagcgtgcgtactagaaagggaagagtaccttcagctgggaaattggatttaactactaccgtcaagtcattctctattgcgtcccttcagcaatataccaatagtttcaacgaagaaaatttgataagagatagcaggtttggtaaggtatatctggcagagcttccggatggagaggtacaaaactgttgggcagattttctagtagttactttagcaagaatttgttgattataccatcgtcacttctgaactgtgatatttgctttgcatcagctactggaagttttgaagattgatgctgctaactcaagaataccagcggatgcctttctagagctagttgtgaacatctccgaactgacgcatcctaacatactcgggcttgttggatattgtgctgagtttgatcagagattacttgtatatgagcactgtagcaagatgactctacatgatgaacttcattatgttgatgactcaaacaagggattatcatggaatgctcgcctccaagtcgctgtgggggcagcaaaagcattacagtaagcaaattataacttttctatttttttcttcccaattttgtgaagtgattctattgatttgtgaaaatgctatgtgtatttttttttttgtagatatcttcatgatggttgtcaacctccaattgtacaccaaaattttgaaccgtctattgttcttctcaacagcactttagttgtgcatatttctgaatgtggtcttgcagcactgtcatcaagatcagtatcccaggtacaataatgttaatgaaaatattttggcatcagactctttggtgatgctctggatgttcagtatttcggatgccctcatgcactgctatttaagtatttatagcatagctgtgcatttgtaattataatgaaggctagtgtaaatgaaagaattgtatttaggaatgggtattgctgattgctatgcattttcatcacattgcatcaattgagatgacagagtcttttgtttgtttgtttgcgaggagagatgaaagagtttgttatagaaaagtgatcttgttatatttcgcagggatgcttagctgacagcagctaacaaatttaggcttcagataatatttctttctagatctattctcaatctcattttttaattgccatccttgtattccagtatagacgccccccgtgtcaattgacattgctaacttgtgaagctgttcttcttttaatctgcttaggaattgctagtgtttccgaaacacatactgtcatgtttagcagtagttatatactttggaatttggatcgcaacagaataaggttgctagtttatttttgactttttgagtgaatgttactatttctttattgataaatagtgtactcttttttatgtcagttgtctggccgtatgcgcaccttgttccattatgaagcccccgaagtgcatgaatctggattattaagtgatcgaagtgatgtttacagctttggagttgtcatgttggaacttcttacagggcgtaaaccttatgacaggtaacattccaaaaggacaatatcccagacccacttccacttagctaagtatccttgttttgcttgaagatggtttctaatttttctcatggaaacggaactgcagttcacgtccacgtgctgagcaacacctggtgcggtgggccacttcccagctttacgatatcgatgctatatcaaagatggtagatccctctattcgaggccaatgttctgaaaaggcgttgtcgcgttttgttgacattatcagcagttgtattcaggtaagatatttgatattaccatcaacaccaagatggatcggtgtggctgacctgattcctcttatgcagcatgagccagagtttaggccctcaatgtctgaagttgtccaagatttaactcgcatggtgagtgatgcaacaaaggcttccatgtaggcgcttccaaaaggagaaaaatcccagaatcctcaattagctcattgctgaaaattcaagagttatctagtcatattacctgcttgcaagttgatcgctcaagcattcgaccaggcgtaggcagatcaaggaaagttcaagcagcgaacttgtgaagtggcgatgtgcagattgctgcatcccccccccccccccccctctttctccaagccattttatccctgataggttccccatccttagacaataatgctcctctgtgatctctctataatcctttagactgtactctgctatcaacacctcgaagtgcctggtttcagatcacatgacgtgatctccgtagttttttagacgatatgtaaatatactcagaagtcagaagtgaagaaacttttgtacgtcagtatgtcgagtttatgatgacggttaggcgcagatacatcagctctaggaaatctgaatattttcctgagcattcacaagtttgtgtactacatatgcattctagtcatacactatatatgcaacttctagcagatcatcataaaccctatgtaagcattctggtcatacacttcgtgatctcttctagcatgagaaaggtttgctttgcattgcacatcttatctgctctgttagcaccggggaatacaccagggttcataaaactgatgaaatacaatcggattttgtgaaaaaccgacgtttcaacgtggctccgcagtggttctcctctgaaatttcaatgggtttcatccatgcgaaaaccgccgtaccgccaatgtccaacatggaagatggtatcggaattgtgaaccctggttagcacttaagtagattcttgtttgtctccaggaaaagaaacgagtttagttccaaacttcttcttcaaactttcaacttttctatcacattaaaatttttttacacacataaacttttaacttttccatttcatagttacaattttaaccaaacttccaattttgacgtaaactaaacacacccctagtaagtttctagcatagcattgttaacttgattactctgtccgtttcatattgtaccgtttcatattgtaaaatgttttagtttttgtccgaactgattttttttttagtttaatcaaatttatgttaaacaatatagcagtattttcaaccaaaaataagtataataaaaaaatattcaatatattcaatggttgatttctaatgaaattaagttggtgttgtagatgaccctatacatttaaaatatttaatgaaatgttaaaaagttagttaggtggtgtttagatccagggacttaattttagtctctgtatttagacactaatttggagtattaaatatagactacttacaaaactaattacataaatgaaagctaatttgcaagacaaattttttaagcctaattaatccataattagagaatgtttactgtagcatcacatagtctaatcatagattaattaggctcaatagattcgtctcgcgaattagtccaagactatggatgggttttattaatagtctacgtttagacactcattctaatccaatgcccatagtacatttgcagtagcacacgagtattctgcgaggagtacgttttatcctctgcaggagtaaaaacgtgcgaagcgtgcaaaagcaaaagcactgcagtgctgcgtgggcccgcaccacctcacgttccccccctctccgagattagtaattttcattgctatcgagagagccagccagtagatagaatccgtccaaatccgaaaaccacgcgacccaacccaaaagattaacaaaaaaaaaaaaagacaaaaaaacagccggcgaaagtgaaacaagaaaccgccttcggacagagagaaaccaccgcgacgacgacctcctcccacacgcctatcgtcatcctcgcgatcgccgcattcatccatccactccccccgcacgccgaaggaataacctagaccagagacgaccaaggagagcgtctccgatggtggtggtggtggtgggaggcggaggaggaggaggaggaggaggaggggtgaagaaggaggagggggaggaggaggcgaggggaagaggaggaggaggcggcgtggtgggagggtgggggacgtgggaggagctggtgctgggcagcgccgtcatccgccatgggggcgttgcgtggggcgccgtcgccgccgaggtccggtcccgctcgccgtgcgccttctcgcctgaggtccgtgcttcccccctccccgtctccaaccctaacctggtggtagtgctcatgagtcgtgcccaatggctgtattgtcggtagttgtaggatactatgcattagggcatggatttagccatttaggggtgcttaatttaagtattatcatcgttggatgatttggtacatttccatcaaatggtcttaggttgtgattttagcgatgctgagaatatgtggtcgtgttgcttggacgggaatgagctttacattccaaacaaaatgaagcaaatgttaaggaacacatgctgtaattttgactcgcaacgagggaatggaatgaaaatgtaaccttacagccattggccttacagtaaagcacccattgcataccttgttcttgcttcgataccaaagtttgacagtttgtgcaatgccaagggtgattcgtcttacacttgcgtcaaactaatttgatggaatgctgttgttagctcatgcctttcttacaatagtttgggtatgtgagagcattgagcccattgtctgaaacattttggagcttagtacaatcagttttacagatcaaattgtttctagtttccaaaaaggagcaatgcattttatccgcctgcatgtctgatgcctgctggaagttatggtagacatttgcttacttgatattagagttccatactaattatgagcttacccattcttgttcgcaggaatgtgaagctaaattttcagagatacaagcacgctactctgcatgcgagtaagtgttgcatcattctttctatgttgtactagcttgtccacatgaattcagtcttataacgtcttgcagtaagtatgtgacgataaattagtaaattgctaaccttgaactttaacctgtgttgagtctcctgtcttggcctattgtatttttcatgcgggaactggatgaactctgaaactgattacacaagatgcataatttgtgtctcatggcacataaaagctaaatagacacgatttataccttatattatttgccttctttaagttggcctatgatttctaggatctacaattagaattacagcaggtgatttttttcctactctctgatatagttttccaattaggacaagtttggtggtaaaatggtgttttgctgtctagcagtgaactggcttagattttagaaattgttgtatgagggcaagggcactggtggatctggggtagagccgtagaggtagggataatactttatgatcaattgatcattgttgagttagctttgggatcatcagcatgagattcaaagaaagaaacagcaagtctctcaagttgggcacagttcgaacagtgcgtattttacaaaaagaaaaaatcttgctatagagaagtattttttaaaaaacaaaataaatccatttttcaagattttaataattaatagtcaatcaatcatgtgctaatgactcgccacgtttcaaatgccaccgataagctcagcctaactcctgatttgaacgtagcctaaagcagtagttgaaatttgaacagtcgattcaactcttaaacatcttttaataagatgtgctgagtttaagttactctcctcatattcagcttttacctagagccaatatacccaagacatttcaactggctgtggtctagtatgcatagtgttttgttctgcagtaaaacaactcacctgttggccattgatagaacatatcatattcattcaacttgcttctttgcagtgcttggtttgaggagctccgtaagcggagagttgctgaattaagaaatgatctgaagaagtctgaaaattttattgggttagtgtttatgttgttacatttcagtatatgtctaattcttgatcttctttttagcatttcaaatttaatttcacaataatttagtttgaatataaggcctatgattattgatttcagaaaaatggtcattccatctggttttcatcttttgtacacttacataatgtgaaatctggtttcctttttcctgttccagatccctgcagtccatgatcaaaagcctcagcaatagcaagcatgatgatggcaactctgaatgtcacactagtcatactgagtcatgttcaaataatgaaaatacagctgataacaattcatcaagcaaagcattgtccaaagatagatcatctgctgctagttttacagaggaagcaagcaacagtcagaaatctgaaaaggtgcaacactgcgatactgattcaattcaagtgaacaatacttcagcagaggctttggtaaaaccccttgttgaaaaaaaggtttgtgctgaagatggtttgctttggggctctagaaagaaaagggccgtgagggataggaggacttttctgatggctgataatagttgcagagctggcgagaatacatctacatcacacatacagacagatggttcctctgaaggctatgcaaagaagggcttgaaaactccaaatctagaatctggtgtgtctgtcgttgagaaagcaaaaccaaacttggcagagattttgaaaactatatctactcaaagtgactgttatatgttgcaacgccgacttgatgtccaggtatgatggatagatcttgtaaattcagtcaagtcttgtacttatggaaaattgattagagttgcacgctgtttgttctgatagggtatcaagcaaatgaaacctttgtggatactaagagtttttagaacccattttagcgacttcaaaataaagtatacatgtttatataactgtttgtgctggaagaaactttcagtgcctttctgcagtttatgcatttcaagatgaaaaaatagcagacactggtatgtttacattctatcttatttgtcacttttgtcacacctgcagcggaagcggactagatacaagaagatgattcgccggcatatagacttccgtatccttcattcaaagatcaagagtggcgcaacatcttctaccaaggagcttctaagagacattctactgtttgtgaataatgtccttgccttctatccaaaggctacgttagagcacatggctgcaattgaacttcgaaatattgcattcagaacagtgcaagagagcgcaagcatgccctctaagagttgtggagtaacaggagcagcaactgcccctttagtgaagaagaacacccgacccgtgcagcctggaagtcatgggcctcatgatgcaaagagaagcaaagtttctttaaaggggactggaagtactgtcaagcagggtgaggccaagggatcgcgtggtggttcatcagtgacagctaatgtaaaaactatgcagagaaatccaccggccaagaagagaggcgttgggcggcctccaaagaatgggcagaagcgtgctgctgcacagcaagatagccctaacaaaggcaggaagaggacccgacgctgaacttcggctcaaaatgcccaaatatacaaaactgtgtacagacagcgtatagctagaccacatagtgtcgtctctttcagtgtttacttgttacctggcaaagactaggtcggaaatcagaatgttgtagcagggagtagtactgtatttcctgttgttgtcttaaaaggacagataggaaagaacatttttataggcagaaactatcaacttagatatatatagtatatctcttgctttgtgcaatgctgatggtttcttgatcaaatgcatgctatgatactaacgcagaaagtttacctgcaaattttgaacttattaggggtatatattcagtacaatgtacagtggcttgtcattgctcaagaatcatgatctgtatagtacctgtcagtctccagtaactgcatgatctgcatctgtatagacgacagtcaatacttactcaaggcgtgtttaggattgatgccattttaaaccatactatattttttaagttgttaaatatgtggatccatttaatttcttgtcaatttttaataaatacataagaaataatgttaaaattttgacaatattgttaaaaatttggtaaggtttattttggctacaatctaaatggctcctcattcctgtttattttaggagggagggaaccggtgctttgattgatgatgttattgggccggtatgtcgttatgatgggccgcggcgggccggcccaaaagcagcgagcccgaggaggagccagccaacaaacaaaccgtgcggaaaacccggtcgccagcggctagcccaaaaaaaaagaaagaaaaggagaaaaaaaagccgccgaggcggctcgcacccgtcgccatcacggcaaatcaccgcgcggcgcgagtcatgggtgcagcgaatgcgaaggcgtgtgtgtgggagagagatggggtccgacgtggagccagccagccgtgggaggtggcggtggaggtggaggtggaggtgatctggggtttcatcattcgtgttccttgtccttttgtaagagaaaaaaaaaatagtacttacttacattgtgaaacggagggagcagtaacttttgctacattttctagtacatactccctccgtcctaaaaaaaactcaatttggaaggggaggggatgtggcaccagtccagattcattgtcctaggaggggtcacgtcccttctaggttgagttttttttggacggagggagtagtttctttttcttctaatttcgtatttacgcgagacacaccactgcacggattgagatcctctgcagtcagatgcacgctgcctttgtcacttacatgtgggcatagagaacatcgggtccacatatcagtgacaaagtcatataatcttgatcctcactgcacatgcggaacgcgcgtacacacactaaatgactactatataccgttacacacgagcttatcaccgttacacatgcaggccatatagacatgccggtgagtgtaccatcaacccatcatggagaatgtatcgtaatatgcgactatacctttaacacgttctaaataatagatttgagacgcataaggatccggtgcagtcgtagtagagactgcaaaggcagttgggaccgttttccatcattagatcgagaggcaatcaacgatccagacatgtgctatatcagttttaagtagtactaactgctactacaatactacagggaaagaatttctgatccaatagtagctctaggacagctatagctactgcaggggatcccaatcctgtttgagatcaacaacaaattcatgacctcttttctatagtgaaataattagttgatgtcttacatcttgctagaaaaatacacggatgaatgtatacatattgtagaaatgatggataaatatgtattgaaataaagtggaaatgatatgggacatgcttatatattaagctctaggatgtattaaatagtaaatgatatgctatatttgtatgtgatttaaaatattttgatagatttgtatgttaagctttaaaagctagcgggattcaaatatataaatatattccattgtgagcgcacttctatctatcatgctctaggtgttgactagatgtagcacggtcatttgataaagtaccatactctacatcttattaaattttagcagaatatgtacacttgtttttgtttttgagaggatacctaggagggtgtaggtacacatgagttatatacaaagacaaagcctacgacaaggctggcctgtacaaacattacttgtaaacggttgcacatcacaccacaattaaacatcatcacccaaaggcagcatacaacatagtcttctttcgggtatgctcctcatggaataaattatcaaacctaagctcttcctctttttttcttaaacgttggaactgtcaaagcaaaagcagttctggtgcaagaacataaaaatgagctttcttgctgtccttgtttccacagcattaaagaataagcacagcacccttaacagccaatgacactaacacacaaacagttcctcttgttttcgaaggttggactaaccatgctacctatttctagcctaaatacctaggagatcttccctacttgcaattcacgggtagataaggttattattgttgtgaattgcagcaatcagactgatttatatccccatcatgtgatccaggcctggctgaggagcagctcccatgcctgcgcctgtcacattaagaagcaattgctggagccagcgccttgttgtaggatcatcctgtggttgtcaaaagttggtgtttcaaacctttcatttagtattaatttatcaagtacaggaataagaaattggtggcagctgatgggttaatatcactcaccctaagacagttattgaacgtgccatccttcagcatgtcagggaggcaagtttgtagtgcagcacatgccctgcatagacgccgcgtagaaaaaaatagcctgttcagaatatttaagtaaaataatttgatagcacacaaatgtcagcacagacctggaattgtctgacagcctaaggtaacatcggataatgtgcttcagcaaccttgtggaaggctgctcagcaagtgaaactaccatgtttgctaaaacactgcctacagcaaagaaacgctcagcagtggcacaaatgtagcgcaatccaacatcatcgaggagaatcttctgaacaatgaaggtggccacctacaaaaatatttgactaaatcagtgaaataataatggttcattaggcctagcttggcaaatgagatttatttctggcctcatttgaactttgagctctcatcaacaaaagaagcttaagttcctcatgagctaccaacttaactatacctgtgtacctgtgtacaaacttaactatacctaccaagtttaaacagttaggtttgggtcataaaaaaatggaattaaaagtggcagcaccatatagttgccaaattgccaacctcctctcaatacatatagcacaatccaccttttaggcttataaaacgaaaggtggcatttgagcttaacaaagggaagcctggttgagaacaagaaaattccaaagatgagcggcagcctgtaataagaagattctaaagatgacaggtggcttacttcacactaacctggacaggctatcattattcatggtagcagaaattttaacctagccaagctacaattcatggtaacaaaaaaaaaaattacacacaaacttcagacagcatcatcacatacttaaagaagaaaaagatgatggtatttagataaacatgagatggttagcgacatacagtttttgacagctcacttcccatttccatggtacgcaaacacagaggaattatttcagtttgcagcagaaaactgataacttcagtatcatcaacctgcgtgtattacatgtgaaagaagctttaattccatttgaaggaaaaaaaatctaaaaccagttcaacacgaaaaaaagaaggtagaaaacatcaaagagtacacatgtttgtttcaaagtaattcaacatattacaaggttacaaattctgttttgtgcatttttcctcagaaccctgccagagggctagtttccaataaccaagctctgtgtctacttatatataaaattggtttgcatccaaacttaattcaaatttctacaaccccacataattcccccccaaaaaaaacatggatacttggtagttacagtgctacaggaaccaggcaaaccactaaacagaagtaaatggctggttaccacgaggatcttggaaatcttttgcttacaatttatgcctgctgttctgcctaatacaagaaggatgcattcttataaggcctcatgcctaactactgaataataataacatggctcttcgccaagatggcagaatagaattactgaaatgtgtcaattgtaatatatatcatgttcgtatcactggttaaacgattaactcatgtaactacatagatgaattaccttaacaagtgcaccgatgacacccaggctggtgagtcgcaggtattcaaaaggtcttgtcttgctggtagtattcaagaatgggtacaggtacaggggaatatgagctgaaaagaacaaaagaaaatgagagagggaaatggaatttttcacagaaacaaaaacaagagctaaaaggttctttagtgtgttattttcttatgaagattaagactttacctcgatttttgttagcacgcttttcaaactaataaaccgtgtgtttcgtgcgaaaactttctatatatatgttgctttaaaatatcaaatatatctatctgtcaagtttgtaataattaaaaattaattaatcatgtgctaatagctatcttgttttacgtgctccaactttatcttcatcttcatgagtttcaaacactagtactacacatttaggaattaggatacgtcaaatatagattacaaaagcatgatcatacacgcatatgagagacagacatgcaaaggaccatgaccattaccagttaagaaaaggatcctggtctcagggtgagatgcaacacactgaaattatttttgaaaagcaaaaaagaaagagttaatcagcaaatctatgtcataaatccaacttgggtaactcaaaaggcaatttctactgtaaaatacatcatgaaatgcaagcaaccagaagacaacttttccagcattaccgccctatttcataagattatgtacctgaagaagtgcaagtgcattgcagactcggttcgatgcacctggtgacaatgttgggggtgaaagtgcagagtagattgacacaatttcctgtatgtgttggcaagtatggatacaccaagtgagtaagattgctgaaatttgagtaagtttggattctaagcaacaagtgctaatttgaacagcatacaatatttgacctcaacagcaaactgatgacttgagagtaggattaaaactataaattatttgtgagtttaatcttcaagcatgcaaattgtaaacatatacgaacaggggaatcatgcagacctgaagaagtgcagcaactgttccaaaagaatgccaaagaagtggggccagatcttgaaatatctctcttttctgaaaagaaaggattgaattttttttgaccaaataaactggcttatcatgttaatgactggaacatgaagtctacaattattttgatcaggaaaattacagaactaattaggtacaaaacaaaaatttctaaattagttactacaaagaacatagggttctaaaattttctttagcaaaacattgctgttgacaatgaagccatctgctctggaatatggtaaatctacaatccaggtctgtgtgtatgagcggtaatctgtataaacactttacagcgtaaaacgccttaaagagttaatggaactctcgaaggctacccataataaactgagtctaattcgctattgtgctacccaataataatggtaatctagcgggaagccgggaagtttcaccgaccacaataattagagatgttaatgttatcttgatcaaaacgtagtgtaatagcccatttcatgatagatgcgcatcaaccatacggtaaccctaacaccaaatcaccattcaccaaccctaaaaaaaccattgacattcacaatgctaaggcgaaaccttcccccacaggcagtgtgaattccacaaattaccaccagtgccccagatagggtaggctatagaaccctagaagaacgcgcgctggacctttgagagctcgaggagggcgttctcgcgaagctcggggtcgcagaggtcgagcaccagctgctccgccgacgccatcttcatatccttggctggctgccccaccccgccgcccacgccaccgccgccgatcggagaaggcgatggcggcgaggccccggcgaaggagggcggaatggaaagcgagggctgcagattcgccattatccccacagcaactgcacaacaccaacgaaaccaccatcaccatttcttcccaaaccacaaaattatccaatcaaaaaacacacaaactcgatcaattccacacatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggcgaaagccgaggggagagagatcccctctgtcgccccctatggcgccacacggacggccaggatcaaccgatcgccgagatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcacgttgccatgtgatgcgcgtgttgcgatgtgagactcgatttctcagttctcgtgatttgggctggaacgctagcgatggaaagttagtgtgatagtgtcatgaatttgttgaggtcttcttgttagatgtggatttgttgaacggtgggtttgttatatccgcactcgtaattctctcgtgttaaattagcaatagaagttttgggttactggatcgaagttttgctgagatatagttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacctcttttatggttgatgtggagcttatctgctactgaattagatacagatttgtattcttgtttcccatttgttcaatccaaataagtgatgcaagtggttctagctatgttgtgtagagtgttgatgtttttcatccatttctgttgtgcagactgagaaggctttcctgaagcagccaaaggttttcctcaggtagggttcttctgctctttcaatgctttatgtattctgtgagcagttcacatgtcttaacgatgtttttctgcttcattttagctcaaagaagtctggcaagggtaagaagccaggcaagggtggcaaccgcttctggaagagcattggccttggcttcaagacccccagggaagcaattgaaggtacaataggttatttgcctctttgtttagctgattctgtctaaaagttgtatgctgtacagaagaactttggtgttttcactgtagccactgaatgatttgtagtgcgttaactttaaaattgtcactgaaagaacagttgtttgtcatgcattgacagtatttgttaagttgtttttatacactactattgccggtatgtttgactagcaatttaaattcatctgaatattacagacctgagataaatgctactatttgttttaagtattgaacagttgattaactgcaattctttctagggacatacattgacaagaagtgcccattcactggaactgtttctatcagaggcagaatcattgctggaacatgccacagtgccaagatgaacagaactatcattgttcgcaggaactacctccattttgtcaagaaatatcagaggcaagtaaactaccatggattatatacttatgtttcctttccttttctccgttctaacatagggtgcaaacctcccaccttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactgtgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgttaatgctcgatatgctgtgatccttgattttcctggctggctatgtgttgacgcttgtttgttgtgtttcttcgaaagagtattggtggatatgctgtgcctgtgcatgactgagattctgaataaggttttcccaaacccaaacctgacctaattcagtttttttgacaaggcttgaatcttataagtttatcaatggacctgacatcttcctatcgcacctaagctttgggaggatgctaatatctggtacaacgtttacatttcacaatcaaacacaactctgaaatgttcgaatatctgaaatgttagcctggtacaccatttacgtttcacaatcaaacacaactctgaaatgttcacctttgtccttcagagaattagagttcagatcaacgaaaaatgttcagtctcgtataactgctacagtcttgcactccaagacgatgcgatcgaccacaaattaacgagaaatcactgccatttttttttagcatagacgatccatcaaatgagtaatgcttgaagtttaattcgcacgaagtgcaggttggggtgatgattgttagtggtaaagctgcaagaacaccgctctgagcttcttcccggccggagtttgggccttcttgggccgatgtttacggcccatatagagaggggtgtatctgcatcgctagggtttgcctccgcgccgccacctccttcttagcaaagcctcgtctccactcccctgccctcccgcctctccggatcccccgcgcgccgccgccgccgcccgcccgccggtcgatacccctccgcggcagccatggctgagcaggtaaggctcctcccagtcttaccctcgagcttctccgtcgcttgcttagggtcagttctatggtgtccttgttatgtgactcggatcttcttgtcggtgttgctcagtggtattgcgtgatttggcctggaattgtagggagggaaaactggtttggtagccttgcacatcagtatgttggtcattattgtcgattatagatttgatttggggttctagcctagtctcatgagtttgttgaggttttcttgttagatgtgggagtagttgggcggtgggtttgcatagtaccattctcaactctcacttgatatgttgtgacttgtgagccatgttcatggtagcaaatgccaggtgcagttttgtggttagtgtggagcttatctgttagagagttagatataggtttgttatcttgtttcccatttgttcatgcaaacgagtgatgcaggtggttctagcagattttgtgtagtattgatgttttacatccattcctgttgtgcagactgagaaggcattcctgaagcagccaaaggttttcctcaggtagggttctgctgctccttcaatcaattatgtactattctgtgagcaattcacacgtcttgacaatgtttttctgcttgattttagctcaaagaagtctggcaagggtaagaagccaggtaagggtggcaaccgtttctggaagagcattggccttggcttcaagactcccagggaagcaattgaaggtacaatagagtcttgcttctttgtttagttgttaccagaattccaattcattacattttagattcttgcttactatcttttgtgtgctgtagagaagaattatggtttgttttactgttaccactgaagtgatttgtagtgcattatgaacattaaaaattgtttctgaaagaatcgttgcctgtcatcagttaacagtatttcttaaattcttttgatacactgttgctggtatgtttgactagtaatttaaatgcagctgaataatgctatttcttttatgctaattctttcaagtactgagcagttgattaattacaattccttgcagggacatacattgataagaagtgcccattcactggaactgtttctatcagaggcagaatcattgccggaacatgccatagtgctaagatgaacaggactatcattgttcgcaggaactacctccactttgtgaagaaatatcagaggcaagtaaacaattatggattctacttatgtttcttttcctttttctgacttgggttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattatcagttcacccagctagtactatgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgttaatgctcgatatgctgtgatccttgattttcctggctggctatgtgttgacgcttgtttgttgtgtttcttcgaaagagtattggtggatatgctgtgcctgtgcatgactgagattctgaataaggttttcccaaacccaaacctgacctaattcagtttttttgacaaggcttgaatcttataagtttatcaatggacctgacatcttcgccgcgaggcgaggggggtgtgggcggtggaatccggtggaatctgggcgaggcgccacccgtgccccctcctctgacccccgccgcgcgctgcctcgttgcgttgctccattccgcccgcgcccccgtgctcgtgccagtgtggtgtgcggtgtgccacccgcccccctttcccaatccctccggtctcccctggaaaaacattttttctcttcccaaccactaacacagcaccggcggccattaacgcgctccgccgcctccgccgatcctcggctccggctcctcctgcagacgcgtccgccgcagcggccacggcggtaagttcctcagttgtccccttctccgcacgaatcctagatcgttctgctgcgtggggttcggaggtatctgctatccgatcgcgtgctcgtgagatttgcctccgcttttgattgggagtaatcccagcgagcccccggcgacggcggcgagcgctcgcgaagctgcgagtggaggatcgaactgtcgaacgtcatttcgtcatcaagcatagcacgcttttttttcccctagtctagtcgccgatgcattatcattcccacccatgcttcatcgcgcatcttgtgcttgtgccatcctcaggctccagtaaagagcaactgcaaatcgtatcgcatcgcgaatcacgcatgacgcgtacattagatttttcagttttcccgtttatgtccgcttcctcgaatttccacccccccccccccccttttttttaccagcaatccacgggaaagcagatgctaaagctggagtatactacttttcttgttttcttccctccttttggttcgtgaggtatgcatccaaatttatgtacgcctcatgcctatgcatttctctgtgagggaccactagggatcatgcgggtcatgtttttaccccaaaagagaaaatctgacttttttttctctgcatacaggatgctatgaatttatcagacctttcttcttgatgtcatgagacagtccgcctttattccacatatttagaattttagatagtagtgccttgtggataaggtgagttcgcttgtgctgttttatttgttcatttctggtgaagtatatgcttgccgaactctctaagctggctcaatgcaaagtaatgaatgatgatactacccacttgattccacagaatggtagcgggagagatagctgttctaagatgagactgcggttgcatctgctgattctttgcttgatcattttatttctggtttataacatggcgagttaccaacataaacagacaaaggtaacactcatctacgaaatgtctccctgtagtttgcttgacagatatgactgaccttattatgggttgttgcagttggaagcaaaatcccgtccatttgatacaattacggtatgtaaaccaatcagctccactagaaggaaaagaactttgtgctatgttaatctggaagcatattttcatttgttgctgggacgctgattttgtcttctatgtaaatatttaggtgtctgacaaagtgtcttctaaggtgtctaaaagatctgccaatagggttggttttttaccccatggtatagtggaaccttactctgacatggagttgaagccattatggctcacaagaagtgcgcaatcaaaggtaatttgaaaaccaagcctattcttgtatacagtgtgttgctcagtacaatatatttgttggttctatttcagttttcatacataaagcaggctttagttgctccacctttctgagtacgaggcctgaatatctagttatctgacgctctgcgaattttggctccacaggattctagccagaaggatcggtgcttgcttgccatccctgctggtatagatcagaaaagaagtgtggatgctattatgaagaaggtacttaatttgctacctcaggaagtgatagtttcctcatgatggtaactcttgaatgttcagtttcttccagagaattttacagttatgttgttccactacgatggtaatgttgatgggtggaacgatctaccttggagcaaaagtgtgatacatatagctgcttctaaccagacaaaatggtatggcatctttctgcccttcctctgtgagaagagcctgactttgagtgctcttgctgttgaatatactttgcttcaccttgcgatttctactgatctggtgtcgtcttaattcaagataagataatgaggcatctattttttaggtggtttgcaaaaagattcctccatccttctgttgtctccatgtacgagtatatatttctttgggatgaagatctggaagtagataactttcacccaaggaggtatggtatttcataaatacttgatgttgattttgagcctcacattgcctagctgttgtataaatgatgttgaggttagacatactgaagtgctgaatcattcctagtacaatgtactgaatcccgtaatcctggttcaagaaactttgtataaaattatcagtgcatcttttaaatgtaagaatcaactactgactgactggtatgtgttaggctgcaaaagttaatcttggcaataatgtgatcttatgctaattttcttctcgagtattttagtttatgctatgcaacaattgtgctaacgcatgaatttcatgcaggtacttgaatatagttaaatcagaagggctagagatatctcaaccaggtcttgatcctaaattgtctgaaattcatcatcggataactgttcgtaaaaaggggtggagtttccacaggtaactttttcatgtgctgcaactttttttattattgatttgttgactaaatcaaacaacatatgcactttgatagaaaagttaatcggggaaacaaagattgtgcaaaagagggaccgccttgttctgggtatgtcttctttcttgagttatttctcattatatgacagctacttcgctgggtaactgtttgcattggttactgtttggtctagtgcagttcaatagtattgtcttactgcacagtaaacacagtaactacatttctgttacctagcatttagcaacaaacctagatcatatttctgcttggtgtaacgattatatcatctatagatgggttgagggcatggcaccagttttctcgagatctgcttggcgatgtgcttggcatcttatccaggtaatggttgtatctttcaatagcaatgagattctgaccatgtctcatatttgaatgtataattgaacctggctataaaactgtccttctgagtgcttaattcggccaggggtattacaagatggaatagacctcagagacccattcaatgttaaaattttgagccagtgacccatcctatgaacatcaagccatattgggcaaagtgatcaggactgttttttagtatacaaaaaggaccgttcagggcctgaatggcatccttttatccccttttggcagaatagttctgctcaaacatgtaaatatcaaatcttggatgataggggaaggagggagggagggaggaaaaagttgccaaaaaaaaaactgcggaaagagctgttataggcttatagcaacttgttttattggatccgtttattctaaaaaaagttaagtctccgtttttccacattactcacaaaatgctttgaatcatatttatttatgtggttctagttctcttagctttacatagtccccggattgctaatgctgcagttgtgaggaaaagggaccaatccattataagttcatagtttattgtagataaaatgacttgttgccataaggaattaatatatgatcaacctggtttttttttttggcaaaaaacacccccgtcaatttacctggttaccacaatctgaaacttacattttgtctttaacctaaatgacttttgtggactatattgcagccactaatatatatatgtttcattttttgcagaatgatcttatccacggatggggcattgattacaaatttgggtactgtgctcaggtttgatgttgcttttaaatagatgtggaattctttatagttaaactaggtgaaaccccgtgtgttactgcacgagtttagtatgataataagtagaaataatgtgtaagatagctagaccacataagcttatataagttaatgtgatttatgataatttaaatggtaatgatgatccaaatgtaaaagtaaggtgatatggctttatgagaggaaaaaggagggatataatttggaccatagaataatcatataagagctagaaacaattaaggtgatatggcttatgagcgaagagagaaataacattagctaagtgagggtgaggatgaactgtgtagatatataggatattgtaaaaaatgatggagatatatattgaaatattatgtgaattatgtgggatgatgatttaaatgtttgcattttagagctctagaatttaacaaattatatagataatataacatgcttgcatgaggtttaagatgtaataattgttagtggatgataatgtggcatctttgcatgttgagctttaggatgtaactttataaaaaggtaggatttctttggctacacgtgggcattggcaatgcagggttgtagttcatgtctcgaaatttcttttgtgaagttttattagaggaatagtcatatattttccttaattcttcatttccttaagtgatgtttcactgtaataatacttttaccttaaccttaccaccaaccatacttcctttttcatcatttttagggtgacagaacaaagaacattggagtagttgatagtgaatacatagttcatcgaggggtacagacattgggaggtccttcagtaaaggtttgtacagatctattatttttgtactgcacgacaatctctatcagaccatatattaatgcctttgggcacatataagaagataacacatcaactttttcgatgcactcattcactttcttgagttttaattgactgatattcctatccatatagctatagcttttatttttaaaaaaagaatttggggagttgaagtccttgttattgatattttactagctaagtcatagtgacatgaatacacagccacacaggactaataactgaaatgctgcatgtgatgattgactaatagttaccattgggtggaaagtgtactaagtgtgacaatagaaacatacttgtatataatttagggatgatgccattcttaattcttatatacactacattgcaccttaataactgtttcatatattaatttaatcagcgatcccatggcaaaacaatgatccacttcaccagaaaatngcagaagcgcaacaacagatgagagtatgctgtctttgccagatccttagaatacacattgtagttatatttctttatgcaacctctcaataatgcatatgacgttacttgtaaacaggtgaaggcaggccttgatatgcggacaaagtaagctaagaaactataatctggggaatgcttccatatggcattatttgaaatatgacccaagctaaaacagtagaaccaagagttgaaccgaaacaagctaaataatcactgatatttcacttgtaaactgaaaatttctctgggttaaaactacaagtcaaacattatttggcagtttaccataatttgattttttttttcaagaatacacaagttttacccatcaatgcagcattctattctcttgcattaagatgaccatggtttgtttggtcttgtaggtcaggagatattcacgatcggagcttcgggatttccagaagcgttgggagcgggccaccagggaagacagagcatgggtcgatccgtttgctcgcccacgaagaaaaaggaagagaactgatagacaataggttagcgagtgtttcgatcatgatttgtatttttttttcttttgcaacaccagttttggagcgtagagttttcggtcgccacattatgtgtagaaaatttatgaattctttacaggtggtatctacagtttttttaaggtaacacatgacgaaactcccgaaaagtttgagcaggaaaagtttggttgtatggacatgtttggttcatttccacatattaacacactatcttttgtcaaatcttgcttgaaattgtagctaacaaagtttggcaaagaaataggtctaggtctatgactggtgcggcaaaccacagttatggcagtgactcgcttaaggaattatagcgtgcctatgtaacaaagttttatcaaccaaccaaaaccaaacatgcccttcgtgtggtactgtggctggttccagacatggggattttgctagcgtggtctattacgtccaggttctgacaaaaatcggttgaattccgcgaaatttcgaggttttgttgaggctcgaaagcagaagccgtctgagatttctatgagtttcatccaaattcaaatttaaattgataaaaaagaaaaaatcaaataaaatcttataaatagtgtgatattcatagaatctattgggatataaattttcgaaaaaattgttgtattccatgtatttactgaaatttatagtaggaaaggaaaaaataatgaaataaaaaaggaaaagaatttcagtttacctccttttctagatacggattgaaatttcagtgatttcgctcagaatttcgccaaagccctcggttttcatgagcttatcggtaaactcagggaatttgtattcaaattttggtttataaaatttgtttggaatctatcggatttcgcgaaaaccgttatttcgccacagagttcaaaacggaagaccatttcgaaatcgtaaaccctgttacatcctctccaaagctgaaactgaatctgataggaccttcagctgctcaactccttccctgtcccacgacgctacacggctgctattcggatccgctgtcgttgggcctaatataagcggagacaagacgaaaaacgtgcgatgctgttagcatgtcagattagtagaattagttgctcgcttgtcgatcatgcagggtcatgtagtacaattgttgtgttggtttttcttctctctacagctacgcttgtcttgctgctttgaacttcccatgattccatttcaaaggaaaacagaaaatctttctataatcattttttttcttttttattgtgcactcgtggctttttaggtactatttttttttgtgaataaatatgtttcaacatgcttgaatgtatgcattgatagaaaaagaacggcagtgaaatggacagatttttaccaagcttgaatagtggtgcttgaatgtatgttccaacatttcctttctacatatgccatagcttttgctattgtgagttagctacatgagatatcaaggtcatctaccttccaactcactttgacttggtgtctttttgttgctaacttgtggatccataggtcatcaggtccacatgtcataacaaaagtcatgtgactttaaagatatatgatctttatctatctcgatcaatatgtgtttcgaggagcaactagcagactgggagagtagaagcctcaaatggcaactactgcaaatctgcaatgtaatattaaaaaaggtcagtggagtaggagtttgagggataggggggagaggtggagggaataatagatgtagctttatggataatctcgattataacaaaaagataaaacaaccagtcgacaatgaaggagttagagggtgaggggggtgagggggatgagcatctttgaaaggcaacaaagaatcaaatttcatggataatcctgactaaaagttagaagttagttaatactaatacatgaaacttagatattacaacaaacgatatataggtatcagaggaattcaaggatgactatccttgaaaggtgacaataaataataagagcaagaagttaactaatacgcgaatgaatatgctagctttgttgaccatcacacgataaaaaaaacaatttatagaaaaacatggtgaaaacaaaaaaaaacacatgagtatacttatattgacatggttcacatgaacaaaactatgacataatatgcatgaaaacgtttcgccgaacgcaataagaaacactttatatgcacggtgccgatctaaaacattattgttttttttttctatcatgtcacgcattgcaaaagttatagaaaaatattacttcaaccgtttcacaatgtaagtcattctagcatttctccgtttcacaatgtaagtcattctagcattttccatattcatattgatgttaatgaatatagacatatacatctatctagattcattattatcaatataacgtgaaaagtgttagaatgagttacattgtgaaatgaaggaagtacgaggtggaatactatacgagagcccgcttgtcttctggcaggcccactggcccactcaccttccacacggattctgtaacaaaatttcgcaggtatccaccgcggggcagtcaactggcagcaaaacagtagcagaggagaagcgaagcgatccaccgttccaccgatcaaggcaggtatcaaatccggcgtggaaaagccaatttcgcaaaatggtcctcgcgatctgctgccgagcctgagcctgaagcgagacaaacagatccacccccctcgtcctcctcctccaacccccacaaagctcagatctcgcgccccatgagcgctccctctcctcggatctaaaaccattcccaccccctctctctcctctgccacccaccggaggagatctgcggccatggcgggcgccgcgggagggttcgtcacgcgggccttcgaggccatgctcaaggagtgcacagccaaccgcggcaagttcgccgcgctgcagcaatccatccagtcctacctcggtgcgtgcccgtgcccgtgccccatcctcctcctcctcttcctcttcgctgccgggcattgggtggggggatctccctgccgcgacgccgtggcgctcggtttggtgggggggtgagttgactgtgagctgtgcgtgtcgcagatgccatcaagggggcggcggcggcgggacaggaggagggcggcgacgcggcggcggcgcccatcacgcaggtgctggcgtcggcggggcgcgtgctggaggggactcaggccgagctggtgctgcagccgctccgcctcgccttcgagaccaagcacgtcaagctcgtcgagcccgcgctcgactgcctccatgtaactcatcttctccttgctagtacttgtttacccggcccgatgctcatgtagcagaaagtgtgttacattatcgcttagcgccgatcattgttgagatgcgtggggagatctctcaccttagcaccaaagctcctgtgaacggcattggtccatcgcgtgaggcaaccactttgtaccgtctaggattatagttcgttcataccggactggatcagtcctcatttcacatttaaagatgtgttgcacaatttctcgagttttttatatactccgtaattgtttaggttggaggtggggggctgcttaatttttctagtagtctatgggtcttgcagacgcatcatcgaagtatgcaatacagtaatgagctttctttgaagaggctgtgttaaagacttcaactgtatatagagtgcgatttagaaagtaaattaatgcatcagaattaatagttagcatctgaataacaattgagacagcactgcaagatccacatcaactaacttcactaaaatgctacatatagttcaaaatcaaaaaacgcaaacatggtggacacacatgcctacttaagtttaacactttttcatgggattttttttggttaatgtgccaattcattttgctagtagcgtttaatgaaaatcagagtttgactcatcatgctgctatacatatagatatacaggtatgccgtttattagttatcgtctttgtatgacgtgtaagattcatttccctgttcgtttggtcaggcagtgcttctcatcctggctgagttgcagaccatatgaattccctaattgccactacttttcattacatcaaattttggacctagaatcatgcccgtaatatatgtttaccacctttacgttgccaacaaggttttaccttttcttttacatgctacaattattgaaaaatgtcttttcttttttttttttgcgggaattgaaatgtattttctgattgacctgttccattttcaattaccagaaacttattgcttatgaccatctagaaggcgaccctggtttagagggtggtaaaaattcccctctatttactgacatcctgaacatggtctgcggttgtgttgataacacctcctctgacaggtacacatcactttaagatgatattatgttggatcacacttttgcacatgcactgaactgggtgacatctgtgttgcagcactgttctccaagtcttgaaagtgcttctcaatgctgttgcttcaaatagatttagaggtgacctacttaccttgctaagcttattttccatgttgctcaaactttccatttattaggaagtttaggagctaacacgatattgtatatggcatctttgaatcatgctggcatgctaggcaaatgctaatcttattatccattatgggttggtccctgtgggcagaccttctcctgaagttttacccactaaatagtgcctacgggaattagatgaacatatcaaacactttgtgtacatagcactgcaacagggattatctaattttcgatgctattttgtttcttacattttctttggtgaattcatgaagaaattgcagttgtcttttacaaaaatcctgtaagtgaacacagtggaagatattaatctagctatcgcctttacaaggcttgtgatgggactttcatgtatctcccttttccgtatccatatagaagaataacgggagacaccatacataattttgagctgtttgtttgagtgcagtacatggagaacctttgcttggagtgattagagtatgctataatattgctctcaacaggtacatgttatatagccacctcatgatctgctgtattttgacttggaaacctgtctgatactttacaatatttccatagcaagagccctgtgaaccaggctacctcaaaggccatgttaacccagatgatcagcatcgtattcaggcggatggaatctgagcaggcaaaaaattttccccataacttctattggcattatgcaaagggagatgatttactgaaggaacgaggtgtgtgccttgccttttttgtcaggtttctgtaccacctgccagctctgcaatgaaagaagaaccatcatctagcacagaggaatcagagaatggtgaagtatccactggtaaccaagctgatgaaaaaattactcttggagatgcgctatccttgaatcgagctacagaagcatctccagcatctgttgaagagcttcagagtcttgcaggaggagctgatattaaggtagtgaaattgctttgcttattgtttaatgttactatcaggacatttcacactaatttatatgtattctattagttctatctgatccaaaaaaatcattttgcaggggttggaggctgttcttgacaaggctgttgaacttgaggatggaaagaaagtatcagggttcgttaagctttaacctgtctttagtgctgtatctgtgatgctacttacctgtccttcataggttgtagttacggattacatatgacccctaaccctcctccttttccagtggaatagacctggacactgtgaacataatacagcgtgatgcactattgctcttccggactctctgcaaggtttgtattcttattgaatagcttacaatgtacataatgttactttgaccggagttgaatatcatttacatccttgtagatgagcatgaaggaagagagtgatgaggttgctacaaagacaaggctgctatcactcgaactgttacaggttcaatcacatctttgttcttcggatgttgctaatcctgtttgtttcgatggtctgtgctaactctttagccttcagggattgctagaaggagtcagtgattcatttaccaaaaatttccacttcatcgattcagttaaagcctatctttcctatgctattctgcgagcggctgtgtcttcatctgcggttgtttttcaggtaatttcttaatcgttttttcaattttttatgcatactaccttgtcattatagacttgtagttataataagggttatttgtctgttattatcatattgaccgtcttttacttctttgcagtacgcttgtgggatatttgcagttctattgcttcgttttcgagagagtctgaaggtaaaataatatttaattaagttcacattatggacatactgtttgcact

SEQ ID NO: 70861 - DNA, 590 bp, Oryza sativa
ccccagatagggacctaaatgtaagaatgacagatcgctataattgatagcgatcctcccaaatatctgcgtcctataaaggccttcgtcggattatggaccggactttgtgttcgcgttgtaaactttgggccttagtgaaggcccaacgttccatacgtccgggaggcccatcgcttcggatatcgtgggccggaaactgttgctccctcgcttggagccacggaggcccagagtagatctggcccgcatgttggccagtatcccgttccgaaggcccaactgctttattatccgttctctacttatgggccaaattcgtagtagctccgaattttgggcctcaaaatgggctgatcgatcctcttgtaccatcgagaagcccagagtcacattcttaatcgctgctaggcttacagcttgctagcctgaaagagaacacttctgcgaataatcattgataatccagatttgaaaaaaatattgataatgacatgtgtgatcgagttgctcgaggaggtcggtgaatccgagccggcgggtggcggatgggggattgccgtctgtcggtggcctgcttcaccccaagt

SEQ ID NO: 70862 - DNA, 6953 bp, Oryza sativa
tagtatatttcagtagtgggaattgggcgtctgttatttactcacttattttaggtattttgttcttctacttccttctgcaattggtagcgtgaagcatacttattgttctgttgagattgtgtggtagtattttggtacaaggatatattggtagcgttattatgtttatagcgtggtcattgctctgctgagactgaggtagtacttggtacaaatatatatttggtattccactttttcatgcccatgtttaacctcaacatctcttgattataaatatattttgggtgtcacttctttgcagttatggcactatttttgtgtttgatcatattgtactgtgcttaattttgtgcaatgattcatgtgtttctctgtgtaagaactcaatgttccttttgctcttgttccttgtgttctttattataacctcttgtgctctttattattaccttttcccccctgtagtcttattctattaatgttggtttctaaaatcttttattttgaaacttttctgctgcttaaaactctgttggtgttttatgaatcattgtgtctagtccctgtcctttttcttgagtttttgaggggacctgattatttttctcgaactgtacagtttaagttttcatgccagcttgattactctatgcatattatacatacttatattttgtattcatatataagcttaatgcattaaagtgctggtcaatttaatgttatgtacttgggctggaaaaatggtgttctaacgacctttttgggttatgctcctaagtttccaagcctaaaagcatccatgcttttgcatcatgcactgtttgatatttcttgcttgtttgaagagaagaaaaaccaacaaaggaagtgtagtttctatcacacagatataagactttgcaatccctgctgttttgacatcaagcatctcgttctggtgatctagtcttgcatcaaattttaattatggcatgatttagtgtagagttgtacacatacaatgcaaaaagaaaccatgagggtcagaaataattgaactcccagttatatttttcttctgagaacactatgttttactttcatctttgctttgaacaatttccatgcttttccaggagcaattttctgtcactgtctgtctgagagcctcattttctttttcatcctgacacaggttgaggagattcctgacaacttcccctttaaaattagtgatgaaaagggctttaattcaattactctcacaagaacttaccagggtgagaatattgaggttctagtttccatgcccagtcttgtgactggcgatgaacctgaccgtgagaatgaggctgatgaggacagaaacgaggatgatcaggaggaagaaactcagaaggccccaaaatctagcattcctctaactgtcaccatctcgaagggagaagagggaccaagccttgaattcatctgcactgcctatcctgatgagatcctcatcgatgccttgtctgtgatgccatcagagagtggggaagatgaaatgatcacgtatgagggccctgatttcaagtaagaaaaccaaacctagtgtatttaaatttattgaacactcaaattcttcaactaatcactgtcaccgagtgctaatgttcaacaccttgccctttgtctgctgcagtgaccttgatgaaaacctgcaaagggcattccacaagtacctggagatgcgcgggattacgcccatggccacaaacttcctacacgagtacatgatcaacaaggacagccgagaatacctcatctggctgaggcggctgaaggattttgttaggaattaatgattaacacaatcatttccttgccataagattagttttgagggctgtgaaccgctcctttctataagtatacatggaccatgaattgtgaatgtatgcttatttaggcgtttaaggtcgttgtcgtgaccaagttttttggcagtatcataatggctcatgagtcatgaacctggatgttggaaccaatggaaatgcttcagttaggatattctgtgattttcatctacactgatgttgctttgtttcattcctttccctttagccatgtgcactcgttacttaaaagtaccagacatgcaaatctaatttgctgaaaacacatagtttttctctaaattcacacgtcttctgattgtttgggaactatggcaagtagttcttcacagctatggcaagtagttcatcacctctgtgaagaacttggagtattcatgcttaatcctacagccgtcactgcaaaagccttcgtagccttcccatcccaactccagaccacaactggtggttgtttgggaactatggcaagtagttcatcacctctgtgaagaacttggagtattcatgcttaatcctacagccgtcactgcaaaagccttcgtagccttcccatcccaactccagaccacaactggtggttgtttgggaactatggcaagtagttcatcacctctgtgaagaacttggagtattcatgcttaatcctacagccgtcactgcaaaagccttcgtagccttcccatcccaactccagaccacaactggtggttgtttgggaactatggcaagtagttcatcacctctgtgaagaacttggagtattcatgcttaatcctacaactgtcactgcaaaagccttcgtagccttcccatcccaactccagaccacaaccgatggttgtgcactggtggttgtcctcaggtaggactagcaattggccacgcctcctaacgaccttccacatcacctcctggacggcatcctcagcgatctttcggcaccgtcggcactcctggttggtcctcttgttcccggcatcggtcgtcgccgcctcatcaccgtcgccctcaacttggctgatgtactttttcccagtggcgcgagcctcatcggacttgtagaggaggaggccgagcacgtaggccgctgtcttgtggcccgcggtggcagccttgtcaaggaggaaaaggccctgggccatgtcctgctgtgcgaagacgagcgtgacaccgatgatgaagcaagtgtccgggttgtccgcggcgacgaggtagcgctcgttctccacccacttcatgttatctagcctctccagcgcacacgtttcccgacgtcgcgctccttgaccgccgcgtgcatggccttgcagctgcagtacgtgtttaccaccaatacacacacagtcaatatacaaagtatttccatatacatatataaataagtttatattaacaagttaacatatgtagcacgtagactgagtaggtcggcaattggctccggtgaggtagcagccacaaggcaggcgacgtggacgatgttatcgtggtaaagcgccaactccatcgccgccggtaccggtgacaacctcttcctcttcatcatcttttccctcactgccatgctccgggtggtcaccatggtgccctacgagtgagacacttacgcgtacgtgcgtggatgtgttaattaattattaccaccttgatcccttgtaagctctcctaacaataaaacaatagcttcgcttagctatttgtaactcgcgccatgataattcatccgttcgtagtaggaatcgattagtgtagtccgaattggatttgaataatatgtttggttcggccacatttggaatcggattattcacatttgaatcggccacattttgaataatatgattaattgattattcacccgtttgttttacataggctggaatcggattccggcccaacttaaatctgataccgatacgggctcggtgtctctctcgccgccgccgccgtcgacgacgactcacgaggctcgattccatctccggcgccgccgctcctccgcctccgcctccacctcggcctgccacctccggcgccgctacctccgtgaagtggccttgctgcttaccgcccccaactgtcgtccactcccactcccagaccccgacaaccaccgtgagcgcctaaaatggcggcggcatcccgctccatgacggcgagatcatcggaatatgcttgcgagggaagcagggcgatgaagaagtcatgggtggattggcgtagcggccgacgacctcgcggttacggagtagcccatggatccacgacgatgacgaggccgacgaggacctgattgtaaaaagttaatatccagatagggacctaaatgtaagaatgacagatcgctataattgatagcgatcctcccaaatatctgcgtcctataaaggccttcgtcggattatggaccggactttgtgttcgcgttgtaaactttgggccttagtgaaggcccaacgttccatacgtccgggaggcccatcgcttcggatatcgtgggccggaaactgttgctccctcgcttggagccacggaggcccagagtagatctggcccgcatgttggccagtatcccgttccgaaggcccaactgctttattatccgttctctacttatgggccaaattcgtagtagctccgaattttgggcctcaaaatgggctgatcgatcctcttgtaccatcgagaagcccagagtcacattcttaatcgctgctaggcttacagcttgctagcctgaaagagaacacttctgcgaataatcattgataatccagatttgaaaaaaatattgataatgacatgtgtgatcgagttgctaacgtcttatcaaatcacagaaggatctttataaaagtaaatacttttatcttactgatttaagtatattattattgcttaaagtcaagacaaaactaagtatggtggatattcagagtttataatggcattattaacgaggccaattaatccacaatcgtcaagcatctctgtccgtcgcaagtgacaatgacactatctagcaggtgacattgaccatgctcaatgctgcatgatctggcaaggtttcagctggtttttctgaagaaaactaggggcggccaaatgcctaagctgtttcaggcttcctttcctgtttcaggctgttgcctatcctcttcctactgcatctgttttcatgaatccatgacattgcaacttggacaagatatacaagttataatgatgtgttcatttttcattaattattgcttagccaatagctagacatgtcctcaatacatgaccttatcttgccaaattcggtgaactctcagcacacttgattaatttagtttagcgtattttctacatcaatttgatactagcttgcaccaacaagtcatttcaacgtacaaagaaaaggttaaacgacatatactgatataccgaatttggtttgctccgacatttggttcacacagagtatatctccatgaatgcaatttagatttgaagatcatgacataaacgctccgttggttaaattccttttggtacatgtgggcttgagtctccgactcataacagatgatcgtatttacaattaattatttttctagtaataaacaaaatgacgatcaatagtgaggtatttgttgtgacttgactttgccaatcttagtctattttctcgaggatgttcatatggataacatttgcgtgtgccgattgttgggaacaatctgcgtgtgcctatatagggcctgtttgggggagctttagattctgagaagcagctgtttggtagccagcttctgatctgaaaaagttctaaacccagcttctccaggttctagcttcttagttcatttttcagaatatataactacagattctcaaaagttgtggactgtttggggcagcttctagcagaagcagcttttggaaaaagctgcagctgagataagctcccccaaacagggccataagcgtgcacatttgcattatatttttcccaaaaaaaacaacatattacgcattacaaaataaatttcaatacccaaacaaaatatcttttatatgtttaactcaaaattttccttcagtttttactcaaatttgtgccacatcacaaaattttttttaaaaaaacataaacatgtacttactcgtactacatacacaataatggaaaaaaaattatcattattaaaataaggtagggtaaaacaaacgtgaggaggtggatgacactacgcgcccaaccttcccccccccctctctctctctgcttcgaattcctcacctcacctcacctccaggcggcggcgaaaccaccagccgcttcgcttcgcctcgattccaaccctagccctacccctatccgaatcccatgcagacggaggcgcgggtcggggtcgtcgtcgacggcggccgcgccgccatgggccgccgccacatcggcaccgtcgcccacctcgccgccgggggcttcgccggcgccgtcagcaagacctgcaccgccccactcgcccgcctcaccatcctcttccaggtgagcgcgtccccccagcatttccctgcctgagatttcgctcttcgtccgtacgggcagtattgggggtggatgtactggatacggcgaggaggaggaggggattgggagctactgctactgcggaggcgaattttgttaattttccttgtctcgcaagtggaattcggggaggaagatgtttcctcccctcctttttttttttggatgtagggattggttggcacgagcagctacgacgtttgttactaataaccttgttgtgtgttgctttaacatgtgtttaataaatgatttgaccataaaggagtctcccttttgaacacatagggatttctcttcctgtgggtgaaaccagtacaattgtagtacagcataccatgtgttgttgttttggaatcctgtgtgccctaataaggaactgggagtaaagaaagcataagacaaatatgacttcttttgtcactcagaaacggtgggagtactccagtagtgagtagtgactggtgaaaatgtaagcctgaggg

SEQ ID NO: 70863 - DNA, 5822 bp, Oryza sativa
tccccctccccccctctttcttctttgagcagtcggcggcgagatgccccatccaccaacgccggcccaccgctgtcttccagcctgccgcctcttacggccatccctctaaagccggcaaactccccctttttccccctccccctccccccctcttcccacccccaccccaccccgggaccctaattcgttggccctctactggagttcgggttcgctggtgccggagaagaagaggtggtcgccggagttggtgaagaagaacatgaattgtgaagcacatccagtgatccaaaatttacaagatttgtggttagattttctgtcgacatagctttagcaattccgaatatatatatatatatatatagctcctccctttatttgaaaaagcacacatccttccttatatgcaattttgcaaattaccgaacgtgtaatttgtgaagacatctactacacaaaaacctttgtacctgcgtttgtttttgctcctgttaccaatttatgagtatgtacattaacagctgtagtccattaacaagtgtcactcatcccatcaaactggtggcatgtaaagcaactatctccctgaatttctctatacagtatttgaattaaccatgtatatgtgtcaaaaagagaaagaattaatcaaaagaactcggtaggagaccatgctactcctactcctaccatggtttccgctgttccgtctcagtactgtccgcgttgtggcgcctcctcagctccgcccagtggtcgtacgcgtcgcgcagccggcgacggaaccgtaccatgtccagccgcacgttctggccatcgaggtaaaccttcttggtgacctgccaccccttggcgttcacggtgtccgggtcggtgagcaccgcgtcatccttggcgtactgccggtacagcgagctctccgccggcttgatcttgtacggcatgtaccgcagcccgagccgccgcgccggctcgccgtagtatgtctcggcggcccagtcggtgccgagcggaacgacctggatgaagacggagcccggccgcatgaagaggaagtgcgtcatggccgcgccgtgcacgcccaccatgacgtccgatgcgttcagagcacggtacatcttggcgagctccgtatcctgacgaggctggagcacggcgacgcggaacccggcgccagcagctgcacgcaccagctcggcctcgttctcgatcgcgcgcgacccgttccgtgacacgatcaccagtcgtggcttgtcgtccttgagcgcgctcttcttcctgatgctgccttgggtcggcgtccccaaggccaccgccgcggccttctcctcctcctcgatgatcatctgtatgcggccgcggtatgcgtcgtcgagcatccgacggaagtcctggatggtacggttgcccggcattcgtgcggcgtcgatggcgagctcgtcgtggatgcgcagcccaacgacggcctccgggaagcagtgggtgcggcggtcgttggtgaagtcgataggcgcgtaatcggagagctgctcgacgatgtggccgtacttggtcatccaccagtcgtggtactcgagcatgacgaacaccaccttcttgttgtactggcgcgcggtgatgtagagcgggattatgccgtcattgaactcgtggtacacattgccggtgtacccgccggtggagaacacgacggctgggacgtcgtgccggacgtcgcagctagccggcgccgcacccccctcgggcacggcacggagccggagctcgtcgatggtgctcatgatgctggactcccacttccgggtgtaagggcggatgcgctcgtcccggccagcggcggcggtggaattgtccggcggcggcacgagcaagaagagagaattggaagcggcctccgtccggacgtccccgcgcatgatgcacacgtccgtacgcatggcggtgcggtcgcagcagatggtgccgttggacacggccgcgcacggcggcggcggcggcgtctcgtcgtccaggcgcgtcctccccatctgcagcaggtcgtcgaccgcggctgagaaagggctccctggcagcagcagcagcaggcaggagacaagcgcgaaccccgcgagcatccgcagcagcgcgtcgtggccgtgcttccggtggtggcacgcgtagtccacgagccggcgccggagctccttcatcttgccggctccttcctcggccaccagctgctgcccctcctctgccgtcgcatcccctttcctctgctgctggtgcagcaggagggtggccctatggtgttgcaccatgtcacccaaatcaatcccacctccgaccacaagtccaggagagaacaagaaagaaacagagcaagacgaacaagaggagaagatgaggtaaaaagagcttttcgctccgagttgccgtgcaaagaggctagtaccactcggtggcgtgatggtgtgtctcgtagagtctaaatgtgggtggggggaaggcgtgaggaaggaattggcattcccccgctaataaaaaccgcgtttcggtcagggtggctatagcttgcgggggaagggaaattggctgcgccgctgaccactggagatggactggcactggaacgcagcggcgtgtggtgggtggtggcaccgaacgaacctgcctgcctgcgtgcgtcgcgtcgcgtgggttgggacgttgggttggcggctgcagcttgctgctgccgttggttggaagcatcccacgggatggaaacgtttgcgcgtgctttccaatcgtttttttgtgggcagcatgggaatgcgtgcgtgcgagtattaggccctgtttagatgagactaaaacttttaagtccctatcacatcggatgtttgaaaattaattataaatattaaacgtagactattaataaaacccatccataatcttggactaatttgcaagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccaccttagctgtctacagtccatgttgcactgtagctgttttgtgcgtctgggactgtatcacgcattgacgctacttcttgccccattggttttccacgcgtatatttttcaaactgctaaatgacgtgatttatataaaaaaattttatatgaaagttatctttaaaaaaatcatattaatctatttttttaaaaaaatagttaaaacttaattaattatgcaataaaatgaacttcgttttgcgtgcctggtaggaggggttcccaaccccctcctccgaatactacatgtggttccatttaggggtgaggtgatggagcaagggaacgattttttttgctttttgagaacagaagggaacgaattggagatgatattactactgctatagtacttcccttttctttctttttttcttttcgagaaaccagtttcctttcttttctgccagggaagttcggttcggttattgcttcccagtcctgccgctgaactttcgaaatagaaaagggggccatttctattcctacgtgtgagtaaaacaaaacaacgataaaaaaatactatgagctaaataagaacaggagactattgccttttatttttatatacttgctgcgcatcaatctgaccattacttggtttctggaatacagcaaagatttttcttttgaaagaatatactagtagcaaagatgacgaaatgtcctaggatggactaaaccatatcttctttgacacggaagctctttttccgtatactcctattttattagactgtatttagattaaggggtgtaaagttctggcgtgtcacatcggatatacggacacacatttaaagtattaaatgtagactaataacaaaacaaattatagaattcacctgcaagctgtgagacgaatttattaagcctaattaatccgtcattagtaaatatttactgtagcaccacattgtcagatcattgagcaattaggcttaaaagattcgtctcgtaatttacacgcaatctatataattagttattttttttatatttaatactctatgtatgtgtctaaatatttgatgtgacagggtaaaaaaatttaccaggatctaaacagggccttatccgtgctaaaagtttttcttattttttttaagaaaggtcataagacccataagacccagcttctattgaaagccaatccgtgctaaaagttggagaaaattttgattcagacttcaaatgtggggaacagtgggggcaccctgaattgaatagtgtttttctttttggcccttaggtaaacagtgcatttgggagtatatgtgagcaatgcaattactgggtttccagccagctaaccactattaggctgtggtcgggactccccagtacgcaaaacgaaacagtgtttagcacgtgattaattaagttttagctttttttaaaaaaaatggatcaatatatttttaagcaactttcgtatataaactttttacaaaaaatacaccgtttagcagtttgaaaagcgtgcgcgcggaaaacgaggagaaagggttgggaacatggacaaacgagttgtcgctctactacatacccggatagggaggacttaagtgatcttgagggctgtcaccacctctacacctacatcaaacgttgccgattaccaaatttcactgttaacaaacgtacagtgggatacgcagcaattactggataacaattacctaaacaccacgtctaagcaattaatatctactttagtgtttataactcaccaaagcaatcactatattttagttgattatagtgaacaataatcctatatgctatttaggaactaaccaagagataattctcacaagataaatctaaattactcacgaagaatattatattgaattcagagaaataaacagaataaaagaaatagaagaagattaccgacaactccggaattcttacgacttcttctactctactctcttcctattctagtatacaatatagtacaatagagcctcttacaattcagctcaagcttggaagtgtgtgtgtgaagtgaagaagtgaggtctatttatagggcagttatgacggttgtgagaaggagaaatatccgaactgccccgcaaccgtcattaggatcaacggtgatcaggggggttgggttcggccgaacctgggctgggccctctcgggctggccttcggcctgtggactccctggtctctcctttgtctgtttcttggaattttgggctgagtctttggtattttgatgaagttcacaacccatccttgtatggatacttgtttctcctcactttagtctgattttcctcccaacttcagggtttatcacctgcatacaaatatacaccaacacttgtggaatatgtgagattaagcacctatcactatgttggatgttttattatttgaactttatgcagatgttagcggtatagaatcagcatttaacagccgccaacaaaaccccccacacttagccctttgcttgtccatgagtaaaggctagtgtagaatgaatttcttcaagatatgaatcaagcatacaaatcattcacaaccatacctattcctgtgaactttatcagtggctatcttaccatcttgagtaattgatagatggaacgatctcgattccagttctt

SEQ ID NO: 70864 - DNA, 29648 bp, Oryza sativa
atttgcccccgcaaatctcgccggcgcattgatgcggccgacctcccgcgcggtttcttcccctcggccgctctttcccccttccaaccctatttaaaccctccccgcgcctccttcgcccgtttccgcccttgccgcaccgtctccccgctggaatcgagctcgcgctgtcgccctctctctcctccgtcgccgacgacctccggccggccttctccgctcgccgggaccgtctcccgccccggcgtcgcctcctccggtttcgccgcaccgccgtcgaccccgtccaccccctcgccgagtccgccgaccgcaggaacgccgtcgaccccgtcgaccagagccgcgccgccgccttcctccgctccggccgcctttttcgtcgtcgccgtcgacctagggtgagccgtggaccgccgcctcttttcccccttccctttccctctctcggccgccgctccgccgtgcctatggccgccgccggcgaccataggggcgcgggcgccgcctcctgccggccgcgccgagtggccgccttcgggcacgccgagtggccgccgcgtggggcccggccgtcagccgcccgcgccctcgggtgcggctgaagcgtggggcccacggcgccggccggtgcgagcccgggtgcgcccggtccaccgtggaccgtgaggctgccgcgtgggccccactcccgtggacccggtccgcgcgccccctcccctcggctgacgcaataaaccctttttaaattaaaatttaaatgaacaaatccgcaaatattcatttaaagagcatataaacttcaaatggccataacttggccatttgaactcggaattggaccgttcaagtctcttttttttccttaagaagtcaagaacccatttttgtgcttcgttcctgcttgttatatggagtttattagagtaaaagcccttttattttccgttggtcgtgtagacgttgcagattcggaagatccactcttcgtggaggttgaagccgacgtttgggaaagtgagcaaggcaagtcacatcatccttgaacatattgaatcccagtttataaaattattttgatttaaattattgcattatcgctttgttatcactgtttattaaattcccgcgttatcactgttttatctagccatgcctatttacctttgttatgaccttattattgttattgttattatttccttgttcaccctagaagaaacaaaaccccaactagtggacactcatggtaccactagtatgattttaggtagatgcttcgctggttaattaggcaacattaggtggttttacaactctagactttgggaatactcttatcacctggacactatggaatggttggattattgtggaattggattcacacctccccctctattcaaaaccctcaaaatggttttaggctgggctcggggtgcatggttttgacagtagcacctcggccatatatggaccggtcttcgggcctctgttgcaaagcactaccgtacttccacatgtctagtaggtaaggcttagtttgtggcttagtctggttataaacaaaagtacacggatggagatggacgaagtcaggggtcgatggacatctctagggcaaatgaaggctacacgagctgcggcccggtagtcgagatgtcatggcacagggccggtgtcctgctgctaggggctcagtcctgcctacctgtcctgggggttccggccgtaggtggggttgggtcggtactcttgtttatggctaggatgggttggaaactatgtcatgtcttccgtccgtataccgtggtggtatgtggcacgtggttacacgtgaggaaaatgtgtcttgtgggtaaagatgtacacctctgatcagagtataatctattcgaatagccgcgccctcggttatgggcaagccgagcaatgtacccaatttagtgttttaattcttaaaacctgcttaacaactaaaatgtggaatggttggcctaggttggcttgggacgagctggcacccagggtcgggttgccagttcggtctgaatcatcgtaggccttgggttaaggcaggttcgtgtgggttcacagccttggttaataatattgtatagctctaggacggtgtttacaaaatagctttgagcaactaagtgtcttttaatgctgtttactgcaaaccctaaccccctatattatggctcccttgtactcccttgtactcccttgcatttattctgcacttgtgggtgtgtcttgttgagtacggtggttgttctcagtcttgctcaatttttcccaaacccagaagaggagcccctggatgatgaaggctttggtgtctagctcgtgcctgccgtcaagcgcctgtggtcatcgccctagtcttccgctatttttcgtttgtcttcttgtgtgctgggtcttcgccgcccatgtaataaattaattaattacgcttccgcttgtctcctgggacaaggaataatgcacgcacgtaaggaacgcccgttgggttatttccggtcgtgacaagttggtatcagagcccccttgaccctaggacgagccttagatcccaagccttagcaatattttcgaaataaaaatcctttcttatttgtgaaaatcctctagtctctctctgtcctgctgcttcatttatcgtcaaaatctgacctttaaaatgttgcttttctcttttgtttttgtttgtagatggcctgcgatgttttctactggaatcaaaaagttcaaaaaacgccaaaacatgatttttggaaatattggagtgtattgggtgcattcatggcaaaaactcacttcgtgattcgcgcggcgaacttttgtcaattaatgccaatattggcatatattggcccacacggttgcgatgtttttgaccggaatgaaaatgttcaaaaagcaccaaagcatgatttttgaacatattgcagtgtattgggtgcgttcgtggcaaaaactcactttgtgattcgcgcggcgatcttttgtcaataaatgccaatattggcacacgagggtgcgatgttttctactggaatcaaaaagttgaaaaagagccaaaacatgatctttggacatattggagtgtatcgggtgtgttcgtggcaaaaacacatttcgtgattcacgtggcgaacttttatcaaataatgtcaatattggcatatattggcccacacgggtgcgatgtttttgaccggaatgaaaatgttcaaaacgcatcaaagcatgatttttgaacatattgcagtgtattgggtgcgttcgtggcaaaaactcactttgtgattcgcgtggctaacttttgtcaattaatgccaatattgacacacgagggtgcgatgttttctactggaatcaaaaagttgaaaaagagccaaaacatgatttttggacatattggagtgtatcgggtgggttcgtggcaaaaacacatttcgtgattcgtgtggcgaacttttgtcaattaatgccaatattagcatatatcggaccacacgggtgcgatgtttttgaccggaatcacaaacttcaaaaaagcgaaaacatgatttttggacatattggagtttattgggtgcgttcgtggcaaaaactaacttcgtgattcacggggagaacttttgtcaattaatgccaatatcggtatatattggcccaaacaggtgcgatgtttttgaccgtaatgaaaaatttcaaaaagcaacaaatcatgatttttggacatattggtgtgtattgggtgcattcgtggcaaaaactcacttcgtgattcgcgcggcgaacttttgtcaattaatgccaatattggcacacgagggtgcgatgttttctactggaatcaaaaagttcaaaaagagccaaaacatgatttttggacatattggtgtgtatcgggtgtgttcgtggcaaaaactcacttcgtgattcgcgtggctaacttttgtcaaataatgtcaatattggcatatattggcccacacgggtgcgatgtttttgaccagaatgaaaatgttcaaaaagcatcaaaacatgatttttggacatattggagtgtattgggtgcgttcgtgacaaaaactcactacgtcattcgcgcggcgaacttttgtcaattaatgccaatattggcacacgagggtgcgatgttttgtactgtaatcaaaaagttcaaaaaacgccaaaacatgatttttggacatattggagtgtattgggtgcattcatggcaaaaactcacttcgtgattcacgcggcgaacttttgtcaattaatgccaatattggcacacgagggtacgatgttttctactggaatcaaaaagttcagaaagagccaaaacatgacttttggacataatggagtgtatcgggtgtcttcgtggcaaaaacacatttcgtgattcgcgtggctaacttttctcaaataatgtcaatattggcatatattagcccacacgggtgcgatgtttttgaccagaatgaaaaagttcaaaaacgccaaaacatgagttttggaaatattggattgtactgggtgcattcatggcaaaaagtcacttcgtgatttgcgcggcgaacttttgttaattaatgccaatattggcacacgagggtgcgatgctttctactggaatcaaaaagttcaaaaagagcccaaacatgatttttggacatattggagtgtatcgggtgggttcgtggcaaaaacacatttcgtgattcgcgtggcgaacttttgtcaaataatgtcaatattggcatatattggcccacacgggtgcgatgtttttgaccggaatgaaaatgttcaaaacgcaccaaagcatgatttttggacatattggagcgtattgggtgcgttcgtggcaaaaactcacttcgtgattcgcgcggcgaacttttgtcaattaatgccaatattggcacacgagggtgcaatgttttgtactggaatcaaaaagttcaaaaagagccaaaacatgatttttggacatattggagtgtattgggtgcgttcgtggcaaaaacacacttcgtgattcgcgcggcgaacttttgtcaattaatgccaatattggcacacgagggtgcgatgttttgtactggaatcaaaaagttcaaaaagagccaaaacatgatttttggacatattggagtgtattgggtgcgttcgtggcaaaaactcactacgtcattcgcgcggcgaacttttgtcaattaatgccaatattggcacacgagggtgcgatgttttgtactgtaatcaaaaagttaaaaaaacgccaaaacatgatttttggacatattggagtgtattgggtggatacaaggaaaaaactcacttcgtgattcgcgcggcgaacttttgtcaattaatgccaatgttggcacacgagggtgcgatgtttttgaccggaatcaaaaagttcaaaaaacgccaaaacatggtttttggacatattggagtgtatcgggattgttcgtggcaaaaacacatttcgtgattcgcgctgatggacccggagttcctctcaacactcaaggcttttgttggcccgatctttcggtgagttgtgataactacaatttgggagaaacgttgacgatccgactacaaccgtacgagacgttgtgttgcgccttagcgatcgatacacctctctgtgggttgttgatcttgccggtgcagatcaaccttattcctgcaagcaaatcgaagaaacaagcaagaacaagataaaaagcaatctgatattgcaaataggaatttaatacaaatgataagttggggttccgaagaacaagcagacggacggtctagccgacacgcgcgctgtaagcaagtagcaatggctaaactttaatctatcaaaaccccgagaaactctaaaggggaacctaactatttaagaaggtgggaggacgacctaagggaaccctagggtcgtgctccacctggttggggcgcaccccacttgggccccacttgggccggggtcccagacgaagttacaagcccattataggtgacgcagcaccttctttttgtgatttcggccgactgggatggaatttggtgatgaagctggatccatttgaaagatgactccgagagctttccatcaagtactcatggacccaaaagggagctcgcatgcatatttggcggccgtctgaagtcgattctgttgcaggtggctgaactggattgcagaacttggacggcctgatcttgatgtgaacgacggttgtatctatagtagtcatggtcacatcacgcgcggcgaacttttgccatataatgtcattattggcatattttggcctacacgggtgcgatgtttttgaccggaatgaaaatgttcaaaaagcaccaagacatgatttttgcacatattggagtgtattgggtgcgttcgtggcaaaaactcacttcgtgattcgcgtggcgaacttttgtcaattaatgccaatattagcatattttggaccacaccggtgcgatgtttttgaccggtatgaaaaagttcaaaaagaaccaaaacatgatttttggacatatttggagtgtattggttgcgttcgtggcaaaaactcacttcgtgattcgcgcggtgaacttttgtcaattaatacaaatattggcacacgagggtgcgatgtttttgaccggaatcaaaaagttcaaaaaacgccaaaacatgatttttggacatattggagtgtattgggtgcatacatggcaaaaactcacttggtgattcgtgcggcgaacttttgtcaattaatgccaatattggcacccgagggagcgatgttttgtactggaatcaaaaagttcaaaaagagccaaaacatgatttttggacatattggtgtgtatcaggtgtgttcgtggcaaaaacacatttcgtgattcgcgtggctaacttttgtcaaataatgtcaatattggcatatattagcccacacgggtgcgatgtttttgaccagaatgaaaatgttcaaaaagcaccaaagcatgatttttggacatattggagtgtattgggtgcgttcgtggcaaatactcacttcgtgattcgcgcggcgatcttttgtcaattaatgccaatattggcacacgagggtgcgatgttttctactggaatcaaaaagttcaaaaagagccaaaacatgatttttggacatattggtgtgtatcgggtgtgttcgtggcaaaaacacatttcgtgattcgcgtggctaacttttgtcaattaatgccaacattagcatattttggaccacacgggtgcgatgtttttgaccagaatgaaaatattcaaaaagcaccaaagcatgatttttggacatattggagtgtattgggtgcgttcgtggcaaatactcacttcgttattcgcgcggcgatcttttgtcaattaatgccaatattggcacacgagggtgcgatgttttctataggcatcaaaaagttcaagaaacaccaaaacatgatttttggacatattggagtgtatcgggtggatacatggcaaaaactcacttcgtgattcgcgcggcgaacttttgtcaattaatgccaatattggcacacgagggtgcgatgtttttgaccggaatcaaaaagttcaaaaaacgccaaaacatgatttttggacatattggagtgtattgggtgcatacatggcaaaaactcacttcgtgattcgcgcggcgaacttttatcaattaatgccaatgttggcacacgagggtgcgatgttttcgaccggaatcaaaaagttcaaaaaacgccaaaacatgatttttggacatattggagtgtatcgggtgtgtttgtggcgaaaacacatttcgtgattcgcgcggcgaacttttgtcatataatgtcaatattggtatattttggcccacacgggtgcgatgtttttgaccggaatgaaaaagttcacaatgcaccaagacatgatttttgcacatattggagtgtcttgggtgcgttcgtggcaaaaactcacttcgtgattcgcgtggcgagcttttgtcaattaatgccaatattggcatattttggaccacacgggtgcgatgtttttgaccggtatgaaaaagttcaaaaagcaccaaaacatgatttttggacatattggagtgtattgggtgcgttcgtggcaaaaactcacttcgtgattcgcgcgacgaacttttgtcaattaatgccaatatttgtatatattggcccatataggtgcgatgtttttgaccggaatgaaaaagttcaaagtcaaacataatagttttttctcttttctttctttcttctttctttcctttccttttcttttcttttttttttgggtgcggcttttcttttcttttttttatgcacctttctgcctttttttttctttcttttttttttattttattttacaaaaacagattcaaggacctcaatgtaaggctatagggactcaaacataaatataaaatttacagtgactcaaatgtaaaagtctaaaaccaaaattaaaattatacaaaaatggaatgctgaatttatactggttccgtttttctgaacggatatcgaaacggacaccaaacaaaaattcaccaaggtgtaaggatggcacggtgtagattgaaccgaaaggagagggagtcggactcaaggggggaatgccgcatggaaggtggttggactcggtgagaatttctgaaggaaggaaaccgattccttttctgcgtggccccaaatagaaacgaaagtaatctaatctagtctaatcttctccttccatcttcctcatgtgcatcttctcccttcttcctcacgcgcacatgcacggcagaaacaaacacacacaaggataggcaaactctagatgcaacacaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaaagccagcagctcgacgtgacgatgcaacacaaaattcaacaaagcaaaaactgaagagaacaatgcaatggcacaatatggctaggtaaatgatacaaatttttttgtatggctattttctggttatgggtagaaaaaaactcaccgagcaacgaaagtctctgataccacctgctgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaatttgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcaaataatgtagcttcatcagccttctcctcattcgcgagtgatggaagtgacatctcaaacatatcgttcttctcattttggagacttttctgaacttcctgcaaaacatcagtgataggaggcacaagcatatcttgttgctccattggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcataaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttatcttttctttctttcttctttcttcttttcttttttttccttttcttttctgattttttttggtgcggctttttttttctttttttttgcacctttctgcctttttttctcactttttttttatttttttaacaaaaactgactcaaggaccttaatgtaatattacagggactcaaacataaatataaaatttatagggactcaaatgtaaaagtctaaacccaaaattaaaattatacaaaaaaatggaatgctgaatttatgccggttccgtttttccaaacagatctcgaaaccgacaccaaacaaaaattcgccaaggtgtttgacacaactcagaacggtggaagagagggagggagtcggactcggccaaaggggcgagtgggactcggccaggaggtggagtggatggcagccgaattttgtgtatgggataaaaaggatactgatttttaaccaatccaatctactatatctttccaaaacaaacttgacttcttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaattctaaacgaactagacgctaagaccagcaacacgtcgtgacaatgcaacacaaaattcaacaaagcaaaaactgaaaagaacaatgcaatggcacaatatggctaggtaaatgatacaaattttttttgtatggctattttctggttatgggtagaaaaaaactcaccgagcaacgaaagtctctgataccaccttgcttgaaccttgagttcctctcgacactcaaggctgttgttggcccgatctttcggtgagttgtgataactacgatttgggagaaacgttgacaatccgactacaactgtacgagacgttgtgttgcgccttagcgatcgatacacctctccgtgggttgttgatcttgccggtgcagatcaaccctattcctgcaagcaaatcgaagaaacaagtaataacaagataaaagcaatctgatattgcaaaaaggaatttaatacaaatgataagttggggttccgaatacaagcagacggacggtctagccgacacgcgcgctgcaaggaagtagcaatggctaaactttcatctaaacaaaacctgagaaaccctgaaggggtaactagctatattgacattaattgacaaaagttcgccgcgcgaatcacgaagtgagtttttgctatgaacgcacgcaatacgctccaatatgcccaaaaaacatgttttggcgctttttgagctttttcattccggtcaaaaacatcgcaccctcgtgtgccaatgttgcaattaattgagaaaagttcgccgcgcaaatcacgacgtgagtttttgccacgaacgcacgcaacacactccaatatacccaaaaatcttgttttggcgttttttgaactttttgattccggtcaaaaacatcgcaccctagtgtgccaacattggcattaattgacaaaagttcgccgcgcgaatcacgaagtgagttgttgccacgaacgcacccaatacactccaatatgtccaaaaatcatgttttggcgttttttgaactttttgattccggtcaaaagcaacgctccttcgtgtgccaatattggcattaattgacaaaagttcgccgcgcgaatcacgaagtgagtttttgctatgaacgcacccaatacactccaatatgtccaaaaatcatgttttagcgctttttgaacattttcattccggtcaaaaacatcgcccctatttgggccaaaatatgccaatattggcattaattgataaaagttcgccgtgtaaatcatgaattgagtttttgccattaacgcacccaatacactccaatatgtccaaaaatcatgttttggcgttttttgagcttttttattccggtgaaaaacatcgcacccccgtgtgccaatgttgccattaattgacaaaagttcgccgcgcgaatcacgaagtgagtttttgccacgaacgcacgcaacatactccaatatgtccaaaaatcatgttttggcattttttgaactttttgattccggtcaaaaacatcgcaccctcgtgtgccaatattcgcattaattgagaaaagttcgccgtgcgaatcatgaagtgagtttttgccacgaacgcacgcaatacactccaaaatgtccaaaaatggcgtttttgaactttttgattccggtcaaaaacatcgcaccctcgtgtgccaatgttgccattaattgacaaaagttcgccgcgcaaatcacgaagtgagtttttgccacgaacgcacgcaacacactccaatatatccaaaaatcttgttttgccgtttttttgaacattttgattctggtcaaaaacatcgcacccccgtgtgccaacattggcattaattgacaaatgttcgccacgcgaatcacgaagtgagtttttgccacgaacgcacccagtacactccaatatgtccaaaaatcatgttttggcgttttttgaactttttgattccggtcaaaaacaacgctccttcgtgtgccaatattggcattaattgacaaaagttcgccgcgcgaatcacgaagtgagtttttgctatgaacgcacccgatacactccaatatgtccaaaaattatgttttggcgctttttgaactttttcattccggtcaaaaacatcgcccccgtttgggccaaaatatgccaatattggcattaattgataaaagttcgccgtgtaaatcacgaattgagtttttgccattaacgcacccaatacactccaatatgtccaaaaatcatgttttggcgttttttgagcttttttattccggtcaaaaacatcgcaccctcgtgtgccaatgttgccattaattgataaaagttcgccgcgcgaatcacgaagtgagtttttgccacgaacgcacgcaacatactccaatatgtccaaaaatcatgttttggcattttttgaactttttgattccggtcaaaaacatcgcaccctcgtgtgccaatattcgcattaattgagaaaagttcaccgtgcgaatcacgaagtgagtttttgccacgaacgcacgcaatacactccaaaatgtccaaaaaacatgttttggcgtttttgaactttttgattccggtcaaaaacatcgcaccctcgtgtgccaatgttgccattaaggacacggatacagatggatgaagtcgttgcgacgatggatatctctgaggcaaatgaaggctaaacgagctgcggctcggtaatcgagatatctaggcaaatgaagactacacgggtcggtgcccgttagtcgagatgccatggcactggactagtacgcgggtggtctcacccctatgcgtgtggcgcacccggtctagatcctgttgctcggggctcaatcctggcctgcctgtcccgagataccggccgtaggcagggttgggtcggtacttttgttcacggctaggatgggtgaagggttatgtcacatgtttacgacgggttccaaggccatggaatgggatgtcaaaagaagcaccatctattgactcggctgacaaggagattcagccggaaaagactgtgccgtaggagtactgcgacacacggttgctgctgtttccccaacgaaaggacgagcagttcgctcgttttgtgatccagaagatccacatcaaagtgccgttgttggatgctatgcaagtgccaacatacgcccgttatctcaaggacatactcaacaacaagagaccgctgccaacaacggaggtggtcaagctgacggaacaatgcagcaacctgatactccacaagctcccggagaagaagaaagatccggggtgtcctatgatcacctgctcgatcggggcacaacaattcgaccagacctggtgcgaccttggagccagcgttagcgtcatgccaaaagacgtcttcgacaagttcaacttcacagtgttggaaccaacaccgatgcgcctccaactggctgactcatcagttcgttacccagcaggaatagcggagaatgtgccagtcaagatacgggatttcttcatcccggttgattttgtggtgctagacatggacatggggaaggagatgccgctcatcctagggcgtccattccttagtaccgcaggagccaacattgacgtgggaacggggagtatccgtttccatatcaacgggaaggaggaaaagtttgagtttcaaccaaggacggaacaatgctccatggtcagaataaagtacgggccgaatccgtagaatattcaagtggtcgaagtggagccacccaaaacggacagcttggtgatatttatgcagaatttcctggagaaggaaacaacgatgcccaggaaccgttattggaaaacgccggtaaaatcacccgtaccggccaagaagtcagatcagccggctcagaagaagccgccgtccgcaccaaaatcaaaaaaggtgtggaaggaaaagctaaagatgcccgctccatcacctccggagacgggtgaaaaatcagtgcactaaaccgaaaggaggtatgtatccgcatatttgctttcaacaatttaaatttttgtatcaccacatatttgaatttcaaaatgcatttaggctttttgaatttttaggaaattcttcaaatgaattttccagagcaaaccaaaataaaattttcaatgaaaatttattgtgccacgaccacactgaccgttggaatccaacggctgaaagtggggccggttgggcccaccaggggtttggccgaacaccctggttcggcctaaccggccaggccaacggtcggctgcctctttctttgaggcaacgtgatgaaccctgagttcctctcgacactcaaggctgttgttggcctgatctttcggtgagttgtgataactacgatttgggagaaacgttgacgatccgactacaaccgtacaagacgttctgttgcgccttagcgatcgatacacctctccgtgggttgttgatcttgtcgatgcatatgaaccctattcctgcaggcaatcgagaacaagcaagaacaagatagaaagcaactgaattgctagatagacaagacgcacaaagatgaattgatacacgataaagtggggttctgaacaagcagatggacggtctagccgacacgcacgctgcaagcgaagtagcaatggctaaacttacaatttatcaaaaccccagcaaccctaaaggggtatctagctacttataggggtgggagaatgaccataaggatcctagggtcgtgctccaccagattggggcgcaccccacatgggccccacttgggccggggtcccaaacgaagttacaagcccaaaggcccatgacaggtgacacaacaccttgttgcttcaattgcggctcaataagatggaatttcgcaatgaggctggatccgttggaaagaggactccgagagctttccatcaagtactcacgggccaaaaacggagctcgtatggagatttggtggccgtttgaaattagcagtgcagcaggtggccgaatcggattccagcatttggaggccttgaccttgatgtcttcttgttcatccatgatatgagcaatgtttgtatccatagtagctatggtcacatcatcctccccttcttcacggaaaatcgtcgtcgttttttccatatggtgctcttcatatagtccattcaaaataacctgtttcatccaatcaaaactagacaaactcgaagtagtgtgattagcaaaaacatgtttctgtaaatgcgaacaaatgaaaatgctatgcaccaaatatattcctctatcattatattcgccaaagatatgaaaaataacattagttggacatggcaaatcaaacttagcaaataaattctcctccaaattattgagctcacaaaaatcatcaaactgaacatagcccaaagtattgaaagaagttatcaatttacgttcctcaatatcattagcaatgtgaacaacatgcttaaaatcagcacacaataaaacactagaaatagcatgttcattcactagttgtggcatggatataagtgaagcattatcacacaactcttctctatcacaaggaacagcaagtaaatcaacttgtgacaaaggcatctcagcaattggttccactaatagttgctcttcactagcatgacaagtggaaaaatgtaattcatcagaagcatactcatcttgagtaatttctgcaccatttaatttaccttttatgccctcttcagataatgtaggtgcatcagccttctcctcattcgcgagtgatggaagtgacatctcaaacatatcgttcttctcattttggggactgttctgaacttcctgcaaaatatcagcgataggaggcacaagcatagcttgttgctccattgggttctccaaaattttgcgctcaatattgcaagcaagcatgaacaattggcctatatgattatatgtcacattaacaagcccaacctgaatattggaattaagccctctgaaaaatctagtcattgtgttctcattagattcttgtaaaccactataagtgatacaaattttaaaatcatgaaagtactccctaacagttttgtcaccttgttttatatgttcaaatttctcaaagagagcacgtctatagtatgaaaacacaaatctttttctcatcagtattttgcattcatcccaagtttcaagcttatttcccacagtatgccaccaaaaagatgcagaaccgatacacttattactaacagccttaatcatttgagcattagaaaaatcatactcatcaaattgtttttctactgctagctcccaattaacataagcggcagaatcatacttaccatcaaaaactggcaatttagattctacccttgcaagatcattatcaggtacctcatatgtgatgcgtgaagaagtcgctatatctcgttgatggtgaagatgttgacgttgagcatgaccatctcatttccccgtgcgcaatcctgccatggttagtagcaaacaagaaacatacacaaaaatatgcgcgttcctattaactagtaggtagtggcagctcaaaaatcacacacactcaagcttttaaccaagctcttacaacatcttaccaatgcaagcggaatggtgacatacaccgactcaaccaagcaccccaatggaggttggatgtatcgatgccttggcaaacacttactgtacggctgcaatcaaatctgtggagctctaggtaggcttaaatatgtagcaaaggaatagcaaatgctcaaatcagataatgcaaagttgaataattgttcaaagtcaagtaccgtgctggtcctaggctagaacgtactagagacgtgagcctacacacaaatgataccacaagatagcactaggagcaactcatgcacaactctgatatatgaagttcagctcaatgataacaaaatgattttctccttttcttctttttttctctctctttttttttgtctttcctgcttttcttttctttttcttttctttttttggtgcggcttttgttttctttctttttagcacctttctgccttttttttcttttttttaaattttttttcagcaaaaaccaactcaaggaccttaatgcaagattacaaggactcaactgtaaatatacaaattacagggattcaaatgcaaaagtgcaaacccaaaaattaaaattatacaaaaatggaatgctgaatttatattggttccgtttttccaaacggatctccaatcggacactctgaaaattttcaccaagctatgcgggaagacacggtatggatctaaatcgatagaagagagggaggagtcggactcggaggaaggaaggcaccacagagaggtggagctgaatattgcggccagcactagtgtttggattcagtgcacaaaataaaaggaaacggatttccacccgatctaatcttctttttctttcctattctgttctttcctttttttttctttccttccacccaaccgaatccaaacagatcttctatattcctttccccttcttcttcctcaagggcaaaacagaaccacagcacaagcactaagcctgggtaaacaacaaacccttgatgcaacaccaaaaccgaccgataaaaacttttgaaaactacaaaaatagaaccatggcagcaagccgattccgttttcgtaggtcccgacgataacagagacacggaggcggcaatgactctggtataaaacgtgaccagaacacgaaacactaaacgaactagacgctaaggcgcaacacaacgtcttgtacggttgtagtcggatcgccaacgtttctcccaaatcgtagttacctacaactcaccgaaagatcgggccaacaatagccttgagtgtcgagaggaactcagggttcagcaaaaactgaatagaacaaagcaatggcacaaagatggctagggacatgatgtaaatttttttgtatggctattttctgcttataggtagaaaaaaactcaccgagcaccgaaagctctgataccacctgatgaaccctgagttcctctcgacactcaaggctgttgttggcccgatctttcggtgagttgtgataactacgatttgggagaaacgttgacgatccgactacaaccgtacaagacgttctgttgcgccttagcgatcaatacagctctccatgggttgttgatcttgtcgatgcagatcaaccctattcctgcacgcaatcgagaacaagcaagaacaagatagaaagcaactgaattgctagatagacaagacgcacaaatatgaattgatacatgataaagtggggttccgaacaagcagacggacggtctagccgacacgcgcgctgcaagcgaagtagcaatggctaaacttacaatttatcaaaaccccagcaaccctgaaggggtatctagctacttataggggtgggagaatgaccatgaggatcctagggtcgtgctccaccggattggggcgcaccccacatgggccccacttgggccggggtcccaaacgaagttacaagcccaaaggaccatgacaggtgatgcaacaccttgttgcttcaattgcggctcaataagatggaatttcacaatgaggctggatccgttggaaagaggattccgagagctttctatcaagtactcacgggccaaaaacagagctcgtatggagatttggtggccgtttgaaattagcagtgcagtaggtggccgaatcggattccagcatttggaggccttgaccttgatgtcttcttgttcatctatgatgtgagcaatggttgtatccatagtagctatggtcacatcacaaaggctagtgggccccacaggttagttttgaccgttgtggatgcactatttaagccaaccggccgggagaggggactccaccccatttcaacacatttccattccctctgcaaagtttgctgtctagttcattcaagctgtgatattttccctcaaatttaaatctttagttgcatatatacaagttgctttggtgaaactaaccggcaggtgaaactcttatcattcctaacccccgccgagttagtccgttcttgcttcattgtgcagaatgaggaggcgattgtctcaactgttcaaagggtccggcccttcatcaagtcatcatgacgggtctagcactcgttcatcagctaatatctcgatggaagacgccgaagctccgcgacatgatacggacatcactacctcggatacacacaacaatcctccaatggtcattcaaggactgatagcaagagctcgtgcgcgacaattaaatttagaggtgagctcgttcctatgttcttctttgtatgaattcgagaaaagattgctacctaatgaatatattgtgattagaaataatagaggggacaaggagacacttggagaaggacttagagccatggaggatcatcgaggacgtccaagtcaaggtggaggcccaaaccaattcgacctcggtgcaattcggagtctaggaccagtctgcactaaaacgggcgcccaggtcgcatacgtgctcggattggggcgttctttatatgaatggaaaactaagaagataacctttccaatggttttggtcccacatccaaatactttccgagtcaatgggtatcgaccgaacaagttgacatccagaatctgtcccggtgctgtgtcaccgtatttgggcctttgggccatgtatcgtgttggaacccattagggttgcgtcgagagggggttgcacgagcctaaactctatatatcagtaccgctaccatctttaggttttagagttttgcttagattattctgtcgagaacagtttcgccgctagatcggtttgtaagaccccaactcgtgagcttatcattcatctgcaattttggttgttttctatctcgtttttgtttgtgttcttcgattggcaaatagggattagccttcttggcgaggtcatccgcgtttcgacacgggtgataaccagaggagacgtggtgttgcgattgcggggctcaagagcgtgcgcgttcaagaagccggatcgatttgtgtcgcgactccgcccaaatcattttttatcagaacctttcggaagatcgggaaccctagtgcacatcaagtggtatcggaggccgttgtaaagtctgtccaagatgccttcactaaaatcggcttcctgaaccacatggagaggttggacaagcagatatccacgctaactgatcgggttgccgcgttggagacaccttccaatgaggaagtggtgagtggtgatgacgatgctcattcggaagacacggtgtatgattccagtggctatattgacacaccagctacaaggcaagcacggctatgacgtcgcctacgcataaaccgcacaggtatgggtggcactcgccaccaacaaggtaataataatcgtgtgccagatgatccttatgctaaggttaagtttaaaataccatctttttcgggatattatgatgctgagaaataccttgattgggagatggcaatagaacaaaagtttaatgcccaccttgtacctgagcaacatagagttaaacaagctagtagtgagttcaaggattttgctatcatgtagtgggctgggttatctgatgagggggtactacctactacttgggaagaacttaaggtagctatgcacgataggtttgttcctccatcttatcatagagatttacgcaagaaattgatgcgtttggaacaaggggataaatccgtacaggattactatggtgagctacaaaagggtgtgagacgctgtggcatagtggagggggtcgaggatgctatttttcgtttttattctggtttgagggaggaaattcaaaacattgttgattataaggaatttaactctatgaaccagttgttttggtttgcaatgcttgaagagaaggaattgcaggggcgtgaccatcagggcaagaacaaggcaagcacatacactccacgcacgatgccatctacgggactacccagggccgtttcttttcgggcgccttcccagccagcgagcaagcgaccagctgcattcggagcttctgcggcaccaaaaccatctccaccacaaccagcagagtcaggtaatggttcttcgcaggtacccgccaagagtgcctcatctgtcgcctcgacgggacgcattcagtgccaccgttgccaagggtttgggcatgtgcagaaagattgccctattcaacgggcctatgttgctacagaagatggctacatcaccacctccgacgtggaagaggaagaggaggaagaagaagttgaggatgaggatggagaagtctttggccgtgatgacacaactgactacaggaccatcgttgtgcagcgggtgctcagcatgcaggtacagcagcctgagaggttgcaacgccataatttgtttcagattttcttcgtcatcaacaaccgtcgtgcacgtgtgatcattgatggaggtagctgcaacaatttggtgagttctgatttggtcaagaagcttggcttgactacacgtacacatccacatccttaccatattcagtggttaaacgattttggaagagcaaaggtaacacaggtttgtagggtttcgttttccattggctcatatgcagattctgttgattgtgatgtggttcctatgcaagcttgttcacttttgcaaggtcatgcttgggaacatgataatgatgctacactttagtgcataatggaaagaaaattactttgctacctttgacccctgctgaaattgtagaagctgataaagagcgagctgctagtttgaaacttgatgaatctgaaaatcagcaagtggctaaatctattttcctacctaaaaaggataagctttcacctagttctaaggttgagggaattaagttgaagggtggtgttatgcttgcaacaaaatgtgacattgctgaaatttcagatgatgatatttgctatttcttgatatgcaaacaagccttagtttctctagatgatattgctagttcgatacctcgtgttgttactaaccttttgcaggagtatgaggatgtctttccagctgagatacccccgggattgccacctatgagagggatatagcatcaaattaatttgattccaggagcatcattgccaaaccgtgctgcttatcgaaccaacccagaggagactaagggaattcagcggcaagttcaagatctcttggaccgcgggtatgtatgttaaagccttagtccttgtgtagttcttgtaattttggttcctaagaaagatagttcttgacgaatgtgtgttgattgtagagccattaataatattactatccgatatcgtcatcctattcctaggttagacgacatgcttgatgaattgtgtggttctataattttcacaaagattgacttgcgtagtggctaccaccaaattagaatgaaacttggagatgaatggaaaacatcttttaaaactaaatttggtttgtatgagtggttagtaatgacttttggtttgactaatgcacctagtactttcatgcgcttaatgaatgaggttttaaggccttttattggacgatttgtggtagtttactttgacgacatattgatttacagcaagtctttggatgaacacatggatcatttacgtgctgtttttaatgctctacgcgatgcacgtttgtttgctaacattgaaaagtgcatcttttgcacagaacgagattcttttcttggatatgttgttactccacagggaattgaggtggatgagtcgaaaattgaagccataaagagttggccggttccctaaaccatcacacaggtgaggagttttcttggtcttgcaggattctatcgccgtttcgtcaaagatttcagtacctttgctgcaccattgaatgagttgatgaagaaaggggtggtcttccattgggaaaagacacaggagaagtcgtttgacactttgaaggacaagcttacacacgcaccattgctacaacttccaaactttggtaagacttttgagttagaatgtgatgagtcacgaccggaaataacccaacgggcgttccttacgtgcgtgtattattccttgtcccaggaggcaaggtacaccaaaagttgatacaatacagagtttaacaagcggaagcgtaaatagttaatttattacatgggcggcgaaggcccagcacacatgaagacgaacgaaaaatggcggaagactagggcgacgaccacaggcgcttgacggcaggcacgagctagacaccaaagccttcatcatccagcaactcctcttctgggtttgggaaaaattgagcaagactaagtacaaccaccgtactcaacaagacacatccacgagtgcagaataaatgcaaaggagtacaagggagttataatatagggggttagggtttgcagtaaacagcattaaatgacagttagttgctcaaagctacttttaaaaacacgctcctagagctatacaatattattaaacaaggccgtgaacccacacgaacctgccttaacccaaggcctacgatgattcagaccgaactggcaacccgaccctgggtcccagctcgtcccaagccaacccaggccaaccattccacattttagttgttgacaggttttaagaatgaaaacactaacttgggtacattgctaggcttgcccataaccgagggcacgactattcgaataggttatactctgatcagaggtgtacatctttacccacaagacacatcttcctcacgtgcaaccacgtgccacataccaccacggtatacggacggaagacgtgacgtagttcccaacccatcctagccatagacaagagtaccgacccaaccccacctacggccggaacctccgggacaggcaggcaggattgagccgctagcagcaggacaccagccctgtgccatgacatctcgactaccgggccgcagctcgtgtagccttcatttgtcctagagatgtccatcgacccccgacttcgtccatctccatacgtgtacttttgtttataaccagactgagccacaaactaagccttacccactagacatgtggaagtacggtagtgctttgcaacagaggcccgagcttaatcctgatagtacccgaggtacgactaacaaaacccaaccacgcaccttgagcccagcctaaaaccgttttggtggttttgaaaagagggggaggtgtgtgtccaattccaacataagccagccattccatactgtccaaatgatatgagaattcccaaagtctaaagttataaaaccacctaatgttgcataattaatcagcgaagcatctacctaaattcatactagtggaaccatgaatagagtacccactagttggggttttgtttatcctagggtgaacaaggtaataataacaatagcaataataataaggtcgtaacaaagataaataggcatggctaaataaaacagtgataacgcgggaatttaaataaagcgataatacaataatttaaatcaaaataattttataaactgggatttaatatgctcaaggatgatgtgacttgccttgctcgctttcccaaacgtcggcttcaacctccacgaagagcggatcttctgaagctgcagcgtctacacgaccaacggaatggaaaaagcaggaacaaaacataaaaatgggttcttgacttcttaaggaaaaattagagacttgaacggttcaattccgagttcaaatggccaagttatggccatttgaagtttatatgctctttaagtgaatatttgcgaatttcttcatttaaattttaatttaagaaggggtttattgcgtcagccgaggggagagggcgcgcggaccgggtccacggggggtggggcccacgcggcatcctcacggtccacggtggaccgggcgcacccggctagcaccggtcggcgccgtgggccccaagcgtcagccgcacctaaggacgtgggcggctgacggccgggccccacgcggcggccactcggtgcgctcgaaggcggccacgccggcacggtcggcgggaggcagcgcccgcgcccctatggtcgctggcggcggccataggcacagcggagcagcggccgagagaggggaagggaagggggaaaagaggcggcggtccacggctcaccctaggtcgacggcgacgacgaaaaaggcggccggagcggaggaaggcggagcgcggctcgggtcgacggggtcgacggcgttccggcggtcggcgggctcggcgacggggtagacggggtcgatggcggtgcggcgaagccggaggaggcgacgccggggctggagacggtcccggcgagcggagaaggccggccggaggtcgtcggcgacggaggagagagagggcgacggcgcgagctcgattccagcgaggagaaggcgcggcaaagggtggaaatgggcgaaggaggtgcgggtagggtttaaatagggttggaagggggagagggtgccgggagaggaaggaaaccggccgggaggtccggccgccatcaatggcgccggcgagatttgcgggggcaaatccgcctgtttgaacgcgagagagagagggaaaaatggggggaaagggagaggggatcatggggaatattttcccccactttattgcacgcggggacggcgggaggcggcgggattcgcggcggcggcggcgatagggcgcgggggaggcggcgggagcggcgggaggaaggggatgacgggtgggccccacccgtcagcgagggtggcgggcgggcccgcctgtcagcgacgcgcgcggggggaggggccgaatgggccgcgggggagaggagagagagggggagggagatgggccgagccggcccattagaggggagaggggtttttagggtttttctttttataaaacctttttaactttgtttatttcttcttaattattatttgtactctgaaaattccactaaaatttatttacacattttaggcttttaggaattatacaaaaatcctccaagccttatttgacttttagtttgcacattttaatttttggaggctttcacaaggattttaattattctaggtataattttaagggatatattttagggtcgttttgggacgtgacatgatgctagtggagttggcattggaggtgtgttgatgcaagatggtaagcctgttgcatactttagcgagaagttgcatggtcctgttttgaattattccacgtatgataaggaattgtatgctcttgtacgttctttagagacgtggcgtcattatttgtggcctaaagaattttgtattcactccgatcacgaatcgcttaaatattttcgctctcaaaataatttgaatcgtagacatgctaaatgggttgaatttattgaatcttttccttatgttatcaaacacaagaaagggaaagataatgtgattgcaaatgctttgtctaggcgctatactttcttgtcccaacttgattgtcggatttttagacttgaatcaattaaagaacaatatgcgcttgatcctgattttaatgaagtgatgttaaattgcaaagagggacgtacttggaacaaatttgttatcaatggtggatttgtttatagagctaaccgtctatgcattccagttggttcccttcgtcttttgttgatacaggaagcgcatggaggagggttgatgggacattttggagctaagaagacggtagatgttttggccatgcatttcttttggccaaggatgagaaaagatgttgagaggttcgtggcacgttgcacctcttgtcagaaagctaagtctcgtttgaatccacatggtttgtatatgcctcttcctgtaccttctattccttggacagatatttctatggactttgttt

SEQ ID NO: 70865 - DNA, 83063 bp, Oryza sativa
  unsure (1)..(83063): unsure at all n locations
cgagtacttttaccaaatctgaagactgtggagggctgaaaaatatagtcaggtgcatcgaatagatgcacctaataggtgtagcccccgactatgtggttaattgaaccaaccaaacatatagtcaaggaataaataatctaaccaaccgagtggttttgataattgtaatcaaccaagtgacttgatatcaatgtatagcatatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaattttcaaagtattgggcatacgccatgcgcacactgctttaacagatgtgcttaagtccataaaagacacattgtttcaccacacctggaaatatatggcacatgtggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgctccaaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcatcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtagtaaaacttgcgaagtagcaacaatagagtttgccggtgccgaagataataaagatgaagtcgctccaccatgatgacaaagttgtattgccgtaatgaagtgaacacaaatcggcggcaacagaagcaaaccggtagtgaagacgcgcagttgtgaagataaaagcaccagtcggaggcggcataatcagtcggcgacggaagatgatgatgtccatcagtagtggtagctgtataaaccagacgtagaggtaagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcgacggcggtcgaggcggccggtcggtgaagacgtagacgcccaacaatgacggcataataagtcagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggtggcataataggccagccgtgcaggcgaaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatgtgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacgaatcagaatttactactcgggtacttttgcaattattaagagcagaaaataaatttatctcatctctatgcttttgatttattctgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccctcggtgacagcaaaagtagccgatgtgggaacgaagcagtccatcgatggtgacaaaaacaccagtcggcgccagtggaaccaagccagtggtgtagatgatgaagcccattaacggcggcgaagtctgccaaccgtataggcaaaaacaccagtcggcggcggcgaaggccagccggtcggcgaagacgtggacgcccatgaacggtggtgtgaccaaccaaccgtataggcgaggacaccagtcggcggcgacggaggcaggccggcggtgaagtcgtagacgcccaacagcagcggcataataggctagccgtgtaggcagaaacaccagtcggcggcggcgaaggccagccggtcggcgaagacgtggacgcccatgaacggtggtgtgaccaaccaaccgtataggcgaggacaccagtcggcggcgacggaggcaggccggcggtgaagtcgtagacgcccaacagcggcggcataataggccaaccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaagtcatagacgcccaacagcggcggcataataggccagccgtgtaggcggaggcaccaatcggcggcgacggaggcaggccggcggtgaagacgtggacgcccatgaacggtggtgtgaccaaccaaccgtataggcggaggcaccactcggcggcgacggaggcaggccggcggtgaagacgtggacgcccaacagcggcggcataataggccaaccgtgtaggcggaggcaccactcggcggcgacggaggtaggccggcggtgaagtcgtagacgcccaacagcggcggcataataggccagccgtgcaggcggaaacaccagtcggcggcggcgaaggctagccggtcgatgaagacgttgacgcccatgaacggtggtgtgaccgaccaaccatataggcgaggacaccagtcagcggcgacggaggcagccggttggtgaagacaatgtcgccaccagcaatggtggcagagtacaccagccatgtacgcaaagaagccagccagcggcgacgacagcagccgacatacatgcataaacaataacagatcaaacaataattagtaatctgtgaattaatctaatttgcgaaagaatttaaaacgataaacctggcttgtaatccaagatttttaatgcatgtatgtcatcagcggtgtatggcttgcttgattgaatcagagactccagcaaaaaggtcgctgcgtgcatgtatctgtctaggtagatcatgcacctgcatgtatggcttggacagaagtggcttgatcgatgcccttgtgcgacaattgctccaatcagctgggttggagtccatatcgattccgaaattgaatctcgccaacaaattttgatgtcgacgaggaaagacgccgatgcttcagagctttgcatgcatgttttctgctgatgcttgatctgttgcttgacagcacatggcgacagatttgatctcattgcataaaatagaattgacaggaacaactacttatggaggctcataatagctgttggcttcaaatcttttgctgatcaagaacaaaactcggtgactgacgtccggtcttgccgatcaaagaaaagactcggcggcgacggtgattggatccatcgccgagattaatcttcccggctagattggatctgagttggagaagaaaagcttagggaattcgtcggcggcgaggaagttgcagctcccgaagtgaagacgaagccggcgactcgtaaagttgattccatcgcgcttcttgatagataactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggagggcaggattacaagatagaaaccttaaccaacatggtatcggtttcctaaatctactttacaatcttatcaaaccaggactttaggccgttccataatatacagggaaacgtaatacccaagtcatgatctgttacatattccatagatataagctatcccctaagactagtcggataaccatgtcgtgtgggtatggggtacccataatctccacacaaatgtttcacatttttaaatccatacattctttagaccatggaattaagaccaatgctttgaatttcactggagaattcttgccctagttataagattagattttgttcgatgcataactatggtcaccctctaggtgctttaattttagaataaccgtgcaaagactgttgaatggcctgtattagatttggaatagtccacgcatgccctgaatggttgacactattccaacatttccgtttgcacttggcagtcaaagaatgggctatataccctatactaacagtcgcatgcatcatatggaagttatcttcagaaaaacactcctgtttaatttgtagtgcatataagtaacatgcatgcataagcttgtatttcaaattaatttgatagttttttattgcaacctgatttaagtttagtgtggatttttacatgtacggattcacctaaatgtattttaatttttatgaatgcctttgcacattagcttttttatatctatactagcttgtagatatttgccaaattacaatactttgttttaagttggaataactttttttctctttcacctggcaaagcatgagtgagtgctgctacacatcgatactttctatatagtcttctatatagtcggtacccactaacaattattaaaagttaaaactcaacatgcaagtatgccacatcatcacccactagcaattactattctagcccatttaaaatcctatacaagcatgcaacatcttcactcactagaaagtactattctagcctattttaaatctcatgtaagtataacacatcatcaacaagcatgtgtcaaatcatcttactcacattattttttcaacatttcaactttcatcatttcgacaatatttaatatatacttatccataaatctcgcagcaaagcgcggggtatcacctagataatatgttggttgacaaggcaatggcatatcatgtagataagaaaaaagtgagaaggtacccacctaaatatctttatgttgtcacttccaaaacggtaattccacatgagtgatgacggntcgagatgaaaaaaaggataggttaacactaatcggaaaggcgatgacgcatagataaggaaaaactcagtcactaaatattttttgtttttttactatgaaattacaatntcacataagtgacagtgatctgaaaaataggtacaaattaaaacactcagctactttatttcttaatgctttcactctgaaattctaacttccacatgagtgacgatgatcgaagattaaaaaaaaagtagaaacaataatctcttggtcgaaaaggcaacggtacatggctaaaaatatcagccacctagtttcttaatgtttccactttgaaactgcaacctccatacgaacgacggtgataactttgataagatagtatgttttttataatatttttttagtttattgaagtagaagtggctaaagtttactaaatataaatggcattccgagactagcaatggaaaatggaagcacgtaattaatgaagccgtcacggtttgcgactgtatatggccgcctgaaactgagagcaaagtggcaccagttgtcgatcacgcgcggggcggccttgacgctatattggcaaaggttggtgtcgcatactggcacaggcacagcaatgcatgaccctacgcgaagcgacaggaggtcacgcacggcgctgtccctgcggccttgtcgcggtccacgcgacgtgcaccgatcgatctccaactcaccgtggaacgcgacgtcttccccttcctcccgacctagcttgttgctgctgacagagcgacaacgatataacgttgaaacaagcacagaattcgtcgctacgaacaaatcaatatcaattctcgggccaagaccaacaaaaactgtaaaaaggaaaaaaaaacggattggagaataacattcctcggctcctcgatcgctgattcctcgtaccgtcgtacgaatatatacgaccgagtcgcggtcgagaatcccggatcagattccacttaaccaaatcccgttcgacgccctatccgccgcgtcatctcttccgcatgcatgtccgtgcgtttcaccgccaaggcagggctgaggcagctaccggggtgaacggtcggaatcggtaaaccatatttatcattcaaactaccctgtatcgatattaatacgatagaaaaaaatttaaaaaataaaatttaaaaatagcagaaaatggtacggttataaacaataccccttatgcagaaacggcgctcagtcgataggaatttctgtgaccgttttcacccgctacatccactgctcgagctgttctcctgtttggcgcgtgcgcgctagcgagagcagagtattagtcgaataccacgaactgctacgtaccgcgcgtttatctcgtgctagatacagagcattgacgccttctgccggtctgcccccccggccccgtgcacgcgtgcgccgccccggtcagcgtccatctctgagactctgacgacgacgacgccgccggcgacggcaccggcgccaccgatccatccatccatccgtgcatcctactgtatacttacctgtctctcgctgccctgcactgcatacgtccgcgcctagctcgatccccgcaggatttctctgtaggtgacagacgccggtttgtctggacaccccctcgcggcgcgccggtgcgtgcgtcggtgcgtgcgtgcgggccgtctgcttgacgttttgaccattattcctctctgtcgatcgtgtggtcagtgcgcatgatctaagattaactgaggaaggactcatcttgtgcgttgacagcgttgtccgaagcccccggacagaacgggtctaagtttgcactgttattttgggaagttgtaaagcagcttctgcatgcgccacaactcaagcttgtcagagttagtgacggtggctgctttgatcttgtactgctccgtacttgaggctcaagaggccggcgaagtaccgtttcctgtttgcatatggaaatagcagttgcagtaggaaagggtaaaatttaactgtgcttctaaaaggactttttgcatgtcacagtttttctgtcttccatgatctagtctacgaatgttcagaacttcctccgtttcacaatgtaagttattctagcatttcccacattcatattgatgatagatagatctatctagatttattaacatcaatataaatatgggaaatgctagaatgatttacattgtgaaacggatggagtaatatcttattgctgatcggctgcaggcgcgcttgtgtgaaatgtaactccgtctggtacgagaaaaaacgtgacagcaaaacaacttgactgacaaaggcaacataagacgcggtcctgacaaatgtagtggcatgatgaagttcagaagaatttacttgcaactaaagcctgcattgtcacgtccaccgaagtgcaagattttcttttttactgtgatgtatgcgacgagaacacacgccattgaaatttgtatgaacccattcacctgttccagtttaattccaagcatgctcgctctgacaattacaatctgatgtggctcagacaaagctcccgttcctccggcagtccagccacttgtacacggttattggctatctacacacaataatcaaactgagcagagcaaatcgaagaaagatataggaaacaggaaacaggaaactgttgcattaattaatatctgatataattaatccatacttcctccgttccaaaataagtgcagtttttcactatttatatttaatgtttgatcattcgttttatttaaaaaattgttatgattagtatttttattgctattagatgataaacatgaatattactttatatgtgattattttttaatttctttataaattgtttaaataaaacggacggtcaaatgttggacataaatatctacagctgcacttattttgggacagaggtagtacttgcttttattctacttctagttcccacttgtatactacgattccctgctcaatgggtaagtgtcgaatcctgaatttttctgaaatatcaaattatccgaattttctctgtaggttcagtccatctgttgtttctatttcccacggagcaacagaaatcgcaaagactggctgccgctgtctgaccctctgactaatccaatccagagagtgctagtactatctccttcaacattaattcgagtttaggatctgttcataggtcagacacggcgaacatttctattagccatggacaaaaaaaagaagcacgcagccatgttcaaggggaaattttgactaatctctcgacacaccatcaaattggccatcttattcttaattcgtgaggtccgtctcgatcaagaattgacaggatcaaaggtcaaccaaattaagggaagcatgcagcagttgctgaatcgctccaaacgcagccaagtcattaatgtgtgtacagcattctgcgttttttttttcatgatcagccaattattattcgttgcccgtgtaatagttgcaacgggcatcatcggcagtcaatttcaggtcacaaatctatgaattaatggggggtagctttgaatttccgattacgacggttcttgcatctagaactggtcttatccagcaatcagggactcatgacagtaatgttgcaataataattagtatcctacttagttaatttatttggaagaccaattaagcagaaatggacggaagaaattcaaaccttcaactcggcgacggcgagcaatttaggaataccaggaaagttttcatcagtttaattattttatatgcagatggatgaacttactctgaaacctgattttctgaaagggaaacagacaaaacagaagattaagaacgtacatatgtccagaaagcacacacattaaactactttgtgcatttgtcggtgtcgcttcgcaccgattagaccggagttcatcaatccgcaattatccgtgctcttactcctcctgcttatctagaaccaaaatccagaagcagcatttgtccgaaattcaaacccactcattacagtgtgtgaacctttagcatttggggtcatagttctattaaaccgtaccgtgtctcccgggtatatcgcagagatagaacattctattggtaatttggtatgcaaccagtcacagtaaaaaacaacggaagaaatgataataatcaaaggttacacgctgaattttcatgctaatcaacgtccaaaaggttgtgctttttctcagggaaaaaagttaccagtatacttttactcttcgactcgcggcccatggcctaaactgcttcgcgttgtccaaagcgagacagtgtcctaaacgggccaacacaaaaggaggcctagtaagccggtgcaaattgggccagaaaagacggtggaagaggttaccatacgctgggccgtgtgtagcccaggaaatgggtggacgttggcgcgcgaggggcgggcgggcgggtggcgaggtgatcgatcgacacgcggtgggggagcggcggccggcatacgtgtccagcggcgacgggcccgtggcggccgcgttcggtacaacggagccgtatttctcggggccaatgccttcggcgcctctccccacaccgcgcgccgcgcgcaccccccttgcctgccttgccactgccagcccgcacctcatccatcgcctcctcctcgatccctctcgctcgctagcttagcatcctgcatgcatgcagcgcagcggccgaaaccgcccaaaattcccagcgcagatcgctcgcctgccttgcctgcccgtccgcctaaccgacaccgcaacaaaccacagccacacagcttctctctgttgctcgctttactgtgcgtgctgtatatacacccggtggatgagggatctagctaactagcttagctagacagcgtgtgttggtggtggtggtggtgtgtgtgtgtgtgaggagggtgatcgatcgatcgagcgatggagagcccggactcgtcgtccggctcggcgccaccgcgagtactacggcggcaacagcagcagccgggctcggcgccggagctgccgccggggttccggttccacccgacggacgaggagctggtggtgcactacctcaagaagaaggccgcctccgttccgctccccgtcaccatcatcgccgaggtcgatctctacaagttcgatccctgggatctccccggtacgtaatttaatcacttacacccataccaatcataaattaagaatttattattacagcttatatatactattatcatgcatgtatattatctaaaaaaaatcagcccaaatctccatatgcatgtgagcatgctagcttggatgtgtagtgctcgatcgatcgatcgatcgatcgatctggtgtcgtttacttgtttgtgcgatttatgcgtgcatgcatcggtttgtatcagagaaggcgaacttcggggagcaggagtggtatttcttcagcccgagggaccgcaagtacccgaacggggcgcggccgaaccgggcggcgacgtcggggtactggaaggccaccggcaccgacaagcccatcatgtcgtcggggagcacccgcgagaaggtcggcgtgaagaaggcgctcgtgttctaccggggcaagccacccaagggcgtcaagactaactggatcatgcacgagtaccgtctcacggacacgtctagctccgccgccgccgtcgctacgaccaggcggccgccgccgcccatcaccggcggtagcaagggcgccgtctctctcagggtacgtacgtatatacgtttgtgcgtgacagtctcgcttggagtcttggactgattgatctgatcaagttgattagtgtctcagctggatgactgggtgctgtgccgcatatacaagaagacgaacaaggccggtgcggggcagaggagcatggagtgcgaggactccgtggaggacgcggtggccgcgtacgcgccgtcgtcgcagcagcatgccacggctgctgctggcatggccggttcggacggcgccggaggagttgctgcagcgcacggcggcgactacagttcactgctccatcacgacagccacgaggacaccttcctcgtaaacggcctgctcaccgcggaggacgccgccggcctctcgaccggcgccagctctctcagccagctcgccgcggcggcgagggcggcggcgacaccgtgcgacgccaccaagcagcttcttgctccgtctccaaccccattcaactggttcgaggcattccttccacgggccaaggagtttcctagtgggctaagcaggagtagcagagacatcggcgacatgtcgctgtcatcgacggtggacaggagcctgtctgaggctggcgccgtggccattgacaccggcgacgccgccaatggcgcaaacactatgcctgcatttatcaatcctctcggcgtgcagggtgcaacctaccaacaacaccaagccatcatgggtgcctcgttgccatcggagtcagcagcagcagcagccgcctgcaatttccagcatccgttccaactctccagggtgaattgggattcctgaataaaaggtgccggcattatgcatacacatatatgcacatgcatacatgcatggcttttcaagtagtagcacaacattactagtaattaatcacactaatgtgtgtggcagtcgcattcagtgagcactgatcgagtagttgcatgaacacaacactaatgcatgcactacatatatatggccgcattgctcctagggcacgtacctgtacgaactaggtaagtgacctaaccagctagatcatgttcagaataaggagaagaagccgcatgcaaacacgtagatcatatggctttgccttcacatgcgtttgcatcatatatatcgcattcagaaagtagtgctgcagctaacacatagatatggtgttagcttcatgcgtttgtaccatatatagcggatgcagaaagtagctagttgcactgttcatcattatcccatgagatatgaactttatatacctttggggttgcccttctaaagtcatgcatctagagcccccctggtaatagcatgcattgatgtttcatgcgcacatatatataattgatatatatccttgtatatacgtaggagtaattcgctgatagaacggcacttacatagtacgctgtactgtacatgtaaacaaaaacttacatattataagaaaaaacgatattatagacacgctgcatagctagattaaccatctgggagaaataaagcatctatccacgatcactcaaaaacaaatgcatgatgcatgtgctagcaacagtatgtattatatatggattgaatcattgaagtgcatatatatatacgtagacgagtttttgtcaggctaaagctagactagttaccaagcccttgtcgatgccatgtgaccatgtcttcccccagcaacatggctgtaacaacagcactaatcctcccaacgatctccgtccaactcgtcgcgagaccttcccttttccgagcgtctaacagcgccacccccgtcgtccgcgcgacaaaccgcctcccagtttcgccgggacagccgtcgcggtcgcttactcgcctcgcgagcgatcgaaagctaaaggtgcatgtaagcgagcgcgtacacgtacgggcgatcggtcggtcgagacgtcggcacgcgcgcatgcatgcggctctcggcgcctttcggccttgtcgtctggctggttccccggttttggatggttgcggtgatggcacatgtagaagtagcgatcgatcgacgacgtggacgggacggggccgggcaaggctagcgagctaatcacatctcggctttggagcacgcacgataataaccccctgctggttcctagctataattcctaatcgatcttatctccagctgcagcgaattgaccgcctttaatcgcggggatagatggtaccgtcgtttttacgcggctcgagcgcgggtggctggctttggctcgtcgtcttgtgtacgcgcgtgacgccgggtgctacgcgtcgccccgcggttcgctggatcgcggagcggttttaacctccagcacgcggtttttgattggccgcgcgctacgtgttgcggcgtggtttgtgcgggggtaaatttgcatgtgcacctctgcgcagacggcgcgcgagattggccggtcaaggatgagtatgtgtatgtgtgataactgtggtaaagctttttattcacctaagacttaattaactcgacgttaaatcatttattgcatacaaactaaataattacaacaaaaaataaaaataaaaaatatattaatgtgtaaaaacatgtaaatctaaatccgactttaccaactgtaacaaaaaataataaattttatacgtgaatatttgttttatattataagttgtttgattttttctaagtgaaatttctttaagtttgatcacatatagaaaatatattaatattttcaatacaaaacaaacatattatcaaaatatatttaatgttatatttaataaaactaatttgttgttatcaatgtttttaattttttctataaatttgatcaaatctaaagaactttgactaataaaaaaatcaaacgactcatgatatgaaacggaaggagactcataatatgaaacggaaggagtataatttaatttgttgttttccttgtaaaagtcaaatttgaacatacatattttttatatttttaaactaatatattacatatcaatttatcttatcaattttctttattttttatagttatttagtctccccgttaagatgtctctatatatccgccgacaatgtgttttgctagcggcgtgtaccgagctcgatacatatggcagcagggactatggcggcgtacacaaagcagttgcccggcaaataaagggaattgatgccaattgtttttttttttaatcacaggatgctctaatctatccatcttttcgctccattttttaatagataacacgccgttaacttttagacacatgtttgatctttcgttttattaacttttttatgcaaatgcataagatataaattgtgtttaaaatacttttagtgataaaacaactcacagcaaaataaatgatagtaattagtaagtgtaggtgtagtatgtgggtgagggcacgagcgtctaatattgtactcaacagcctaagatagtttaacaaggaagatgtttttttttctcatttggtgcccccctcattcggttacattatggagtcattctatggttacattgtggtgccccctctctatttaagagatttgctaggttacaaagtccgattctaactctaaccctaaccatctattacaactccaaatccatccgtaactaaataggactaatatattcgacacatattataacaataaatttaatactgaattacacattctatttaaatttaaatttattattttatctttctaattgtataagttgaatttgaacctgcgtgtttatgaattgatatattaattatgttttagattataagtcattttgactttagttaaagttaaattactttgacaaattttgtagacaaatatattaatatatacaacaccaaattagtttcattaaatctatgattgaatatgtttttatagtatatttgtcttgtgttgaatatattactattctttcctacaaatttgattaaacttgaaacaatttaactttgatcaaagtcaaaacgattatagtctgaaagagagagtaccatatattgatatatcttttttttttcaaaatttcacagtaacattttggatgacatggacatgctataaaacgagaaaagtgtgtagtgcaaatcataaatatagtaaaagcctaaaaactatcatcattaagagtaaacaaatttattccaagtaaaacttttactcatgttgaatttggtagtaaaattttcatcctcggtgatgtgaataaaatattaggtgtccttttaatccaataatacttttcacgttttcactagatatatattgtgctacatattttcacataaaacgagaagacatgactaatatgtgcacattaattttccaacggagaggccttaagggcaggtttggttggtgactaaatttgccgcaccttataattaggcatgtcacagttttagtatgcggtgtttggttcatgccataaatctactttgcctaaccattagccttagttacgtggttcacatgtcatacattttattttgttgtctaacttggctataagcttagtttgttattttgtttgccataaaagtgggttttgctcatgccgtggctctttctgcgctccgtgcacctggcggtggcgaacggatcagcggaggcccaatgcaaaaactagctctgcacaagctcggacggccttgtctccttcctaataattctctgattcaggaatcactgaatcaggatacgatacttctccaagaaaaaaaagaatcagctacgataccgcgtgcactgacgtgaaccggacgatcgaggcgcgcgatcaccaaatcgtctttgacgctattaaacccgcggatcccagctaatcttatccccatctctcgcagtcgcagggcgctataaatcttatctccatcgaccgcgtgaaatgtagctaccggccaatcaacgtcgataaaagaagcgacaaaacaatttttactttgtacctctggtcgaaagcccgttctttttacatggatatcatacggtggatggtcaaagaatctaagccttttttccctgacaaaaattgtgactgatagataggaactgatccacctaaggttgcacctctccatccatgcactgcaactgatatgactggttggcattatctgtcttttgtttctgcttcacctgattcattgatgaggtttatgctccatatctaaaagctaatctcgagccaatggtatgtaaacatcaggggataaaattacactgttcgtaatcaggacaccagggcgggacaagaagggttacttcactgaagaatttgtcccgtatatggcacaatatcggaacgataactaattactctgtttgccttcgttttcagttttcaaatcgactgataaccttcctgcagaatcagggcattttagggcacatgacaagagatggcagattagagaggttgcaccgccggtctgccgaaaccgcaaaagcgagagcaaatcaactaatctctttttagcgcagctaatcagccaatgaagcacgcactagtatgctaatcgatcgattagtagcccactttgtcaagtgcaagtactgtttttcctgtaaaaagtactgttcgcaaagacttgacatgttttgtttggacattggagcaactgtatgggtctgaactctgaagaggattaattgttcagcacaattggtattttaagcttgaacatattttaaatctgcagttattctaataagtaaattacagctacggtgcacgaacttaggtgcaatagaaacaggtgtaacaacctatataaattgttcgcttcagacaacaatttgcttgcgtagtcacatgcaaaccaaagtcaaaatgatctatatacgcaatcaaaacatgcagccaaaatttactaccggatattctgatgttgtggttttagctttagacatgacaaaagttgatgcctagaaaagacactgtcaaaatatttatctccagttaaataggactataggttagaaatgcccctagctagccccaatgatcagactctcttcctcgatctcctttttctccctcttgcaagcgcacagcttggaagagggcaaacaacgcctcggtaccatactaggcaattcggctgtgatggtgtggtatcaatagttcctttattttatcggtgatatctattggtttgtttattcatatgcttatctgaatagattatgagcaaataaaaaatatttctaagtaaattttttatatatgcgtccttagcgataaaaaataaatgctataaaataaactacgatgaaaaactaaactttaaaattaaattcttaaatttaaattttgagttataagcataagcataaaagaaacaatgagccatacagtttgtacgttttgatgaaataatcatacgtgttatatataaaatttgggttctcacaatgataatgatttctgcatggcctctctctagctgccttcagtcattaaaaaataacaaagtttgctatacgggacacccgtaaaacatgtaattagttagggaccatctcactcacagtataattttatggattctctctctaattcctcaaaaataataaaattatcattttttacgatgcccctataacataaacaggttcttactgtatcgctcagctaatttcatgccttttgatatccttaagcaaatttttccttaaaaaagcggatcgcaacagtatttgagaagcttagttttttttaaaaaaaaaaactgagaagcttacttcacacggccataggaatacgctttgcatacacgagatgacgagaagactatttgtcacgttactcacgtactccttctgtaaaaataaaataaaaaaaaatcaacctaggagcgtagtctagattcgttcatctaggaggggtcagattcgttgttctaggaggatcacattacatccctttttaggttaagtttttttttttggacgaaaggagtatgacgtaagcttgccagtatctatgtaatttttttagagtacatctatgtatatatgtgtttttgaaatatcatatagtggtgttcttttcttttaatgatgaagattaagttttttacgcaaaacgatatagtattaacgtatgattgattgagttttaattattacaaacttaaaaaatagatcaatatgatattttaaagcaacttttatatagaaagttttcgcacgaaacacaccgtttagcagtttgaaaaacgtgccacgaaaatcttaatcttcatccaacttttgttggagaaaataacaggagtgctatgctagctgctcaaaggtccagctaacgtagcaagatcatatgactatgagactgttaagaagtaattttcaaaaagagagagagagagagagagactgttaagatgtgttgatacttgatgggcttttgaagtcggtccatacaaacaaggaataagtctattttgccaccctcaacacatgctcttggttaaatctcatccctcaaccgcaaaaccgggtataacccgtcctctaacttctaaaaccgctacaaatcagactcttaggatggttttggaggcggtttcgtcctacgtggtagttgacttgctgaatcatcaagcgggacccacttgtcagcggtctccacctcatctctcctcctctttctctttcatctttctcttctctcaccttctatcgacacagaggcatcgcgcagcaacaacgcattggggaggagctcgtcggctggccgcgttgcgccgcacgcgggggagcagcctggctcgagcacgcaaaggaggcgggagggcgtcggggcatcgtctgagaggggggaagaggggggtcgtggaggatgaggcagccaactacgcatggggaggtggtcatcagccggccgtgcgcaaggaagagctcgtccaccggccgcccgcagggaggatctcgtcggcctaccaagcgcggggaggggcacttcagcatggtggccacacagggaaattcgtcgatcttccacgtcggcccggctcgagcgcgcagaggaggtgggtgggcgccggggcattgtccaagagggggaaggagatggtcgtggaggacgaggcagaggccgcacaggcaaacccctccacgtcgacagcagcgacggtcggcgaggaggggaggcgtgaccctcgtgctccatcccgccgccgcctccgtcaacgccggtcggcgttatgcacctgagaggagagaaaagttatagagagaggagaaagggtaactaacgtgtgggccctgaacgtgcagagatgtagcctagagggggggtgaataggctttcctgaaattttctcaacaaacgcagcggttaaattgacagggcccgaaacctcctggtgatgaacaccggaacttcctggcagtgatgagcagcccgaaacttccggagttcttgagccagaaactttcgggcaacagacaaaaacgaaatatgagaagtataacaggtcctaactagtgaaaatcaggcacagggttgcacaagatgaaaatcacaagataccagcagattcaaacactgatcaagcacaagagagacataggcgatttttttttccaaagttcagatcacacggatcctactctccgttgaggtgctccaaagagccaggtctcgattaaccccttgcctcacttatgcaaagatcctagaagaggtccacagccttcaacacaacacttctaggtcgttttctagaattgagtgaccaccaagatccaactcacaattccttctagaaaaggccacaagtgcaagttgctctacctaggacaacctctgaaaactcagcacaagaaacttcactcacttacctcgtttccttgcggaggtgagaaaaacctttacaaactttctcgggacatccacaagatctttggaagctcatgggcgacgcctaaccgtctaggagaagatctccaagagtaataagcccaagtgacagcccacaaggtatccaaagtgctcaatcaaacctaatcttcaagccatctccaaaacactcctacactctcgtctaatctctcaatctcacaagataggctctagatttgagtggaggaagcaaaggaagcttgggagtggctagaaaaccctagaacatgaatgaacagaagtggaatggccaaaaggtgacctggggacgaaattcatatatataacggctaggtgatatcatctagccgttactcacaagtttgaactagaaacctgccaggaggttccggacaaaagtgccaggaacttccgggcagcacttaggaaattttttgcaaataaacggtgcccggaagttccggccagaacctccgggtagccctctctgtctcggggagaaaatcatttttcaaaaatgattccaaaaaatcttttgactcatggatatgactaagagcactttgtataccctagaaccacacttgaaacccctcttaatagtacggtttttcctaaactcaatttcgaaagtgaaaaacctagtctaaccaccttcgatgatttttgcacttaggaacatttgaattggggggggggtctccttgcattcttagccatcccaactcgctttgggactaaactcctgtgaataaacttgataaacacgttagtcccctttaaccaccttgtcattaatcaccaaaacccactagggggtttaagtgcatgttcaatctccccctttttggtgattgatgacaacatggttaaagcacacaaaaagataatagaatttaaattttgaatgatgagagaagtgtgaagctcctcctaaagatatgcatataatgaaatgagatgaatacaatatgcataaaaacaaaggaaagctcaaaagaaacttcacactaccctcaatcaaataagatgcagaagtgagtgcttgaatgatgagtgatatgcaagaagaaagactagatgacatggcaatcactcaaaaagatgaaaagaacacatcatcacatcaaaatgcaacatccatatggtctaacttactgataaaaaggataataaagcatctaacagtcattacatccaaccataatagaatacgattacatgtccatatagagagagataaaagagaggaaatctgcctggccggaacctccggatcacaggccccagaacttccggccaaatgaccagacaacagtcaaggcagcaaaaaggatttaaatgacccccttcaattcacaatttctccccctttggcatcaaggcaccaaaaaggcgagaaactatgaagagaagaagaggatcactcatctccatcagagggaacaatctcggtatcgccggagagatgagactcatcggactgagcagcggtgtcaccctcatcaacatcaatgggggcatcctcagcagctgcctcggtgtcaccctcatcaccatcatcatcatcatcatcatcatcatcatcatcatcagaatgggaagattcttcattgaagaaggtggatggaccttcaccggcaacgttgcgggctgcctcataagcctcaaatggatcaacatagacctcatcctcagaatcatctgacacttctttcctagcctctcttctatcttccttctgacgcctttcgatcttcttcactttcttggcagtcttagcacacatacagaaaattgcctgaagtgccttcttgatgggagaaaaactcgaggaacttggtgggccactagtagaaggaccagctgaagtagaaggaacagatcgagggaccactggagaagagaaaggtggagcacgagggcgaaaaggattatggtgcccatctttgatgtagaataccccggtgactgtctcaatcatcttcataatgaaaggagcatagatgcaaccccgcttaggctcaagaatggtgttggcgatctcataccaaatcaatttcatcacattgaagggaggctgattgtagcgcatgcgactgagaagatgagcatgcttggatggcaaagcagtagcatctccaacctttggaagcaaagaccaatgaaagatggagtacaacaccttgtagttgggatgcaatccatgagtagatcccatgcaagtcctaggagcatcctttgcatacatgaacttggtcttgatcatggggagagatgcttcactatgaatgttgggcctattgagatcctcatcatctaaccccaacatctcagcaaactatgccatggaaatcttgtgcctaacaccctcagtcaaccacttcacataaggggttcccttccttgtagtaccaaagaatgctgtcgcatagaactgtgcaatgacctcctcattccaatcatactccaaggcaagaatatctccaagattcttgttgtggcacacttgcatcacttggttgaacacttcattgttcttcttcctcatgtaagcccaatcaatccacttcatctcaaccactggattttctctagccataatcactgaattataccaatccaattgagtgaaagtcctgaaacgaggatcctatgactccttaggctgagtctctggatcaatcaaacggtcccttctgcacttggcaagctgatgaaggtagttggacttgggtcttccaatgtggtgcataagagtggtgtcaaatccaagagtcttgtagagccgaacgggattctcatgagatccaacaggaaaatcatgagatgcccttccagccccagaattgcgaccaccacctctcccacgacctcttgtattagaaacatcacttccttgaccactatcaacatcccgaatctgaactggacggttgttggattacctggtaaacctaggacaagtacgagtactgctaccactgccgcatcaaccactttctctttacccaaacgaccacgaggaaaacgaataggaggactcttatcaccggacacatcctgagaggctttctgtcttttctcacgaggcatagtgcttactgcaacaggaatcaacaaattggagtgcagtagttaggcaaaatttgagagaatcaagaatggcaggctggctggacagcgcccggaggttccgggtgcaagaacaccggaacttccggccggcaaaaaagaggaacagaggtttcaaaaatagccagtgcatgtgaacaaatcctatagatcggtgatctacaaggtagcagaaacaagactatccaagtggttttctccctaggttcacagatttagagatcggggcaaaaacatgatgaaccaaaagagaagatcaaaagtgctaccttgagagaggaaactgcgaatcgatcacggaaagaacctcccagccatcaatgtagatgaatccacggagaataatcgaatttgattggagggaaaagaaaatcaccactcggggcactgtagtggcggctagggctggcgtcggggagggagaagaatgaggagagagactagggtttctaactccccctaagaatatatactccccgacacccggaggtttcggacagggaggcccggaacttccggcctgacagataaagggcagtcaggcccaaaaccatggtagagacaaggaatcaaaaggaggaatagatgtatataactagccaacaagcaatcaatacaaaactatggtcgatatacatcacaaggagaagataaaaaccaaattttcgcaataaaaggcacacaaaggaatttcgcaaagattttcaaaaaggtttttggataaaaagagggaatgtttgagctttattcctagtatcaagaccatcttctacacaagaagtgatctcaagacacaaaagctcatttttttttaatttacattttagtgacatatgtttggctataaattagcaaaccacccatcacctaatgttgcgagaatctaagatattgagctcactcctaagctcgcaaaatcttttctcatctaaaggtttggtgaaaatgtcggctaattggctctcggttctcacatgggtaaggcatatgtctcctttggtttcatgatctctcaagaagtggtggcgaatatctatgtgcttggttcttgagtgttgaacgggattgttggctattttgatggtactctcattatcacataggagtgggatcttggtgaagttgtagccaaaatcttttagggtttgtttcatccaaaggagttgggcacaacaagaaccggcggcgacatattcggcttcggcggtggatagggcaatggaattttgcttcttggaggaccaagaaacaagggaccgcccaaggaattgacaagtcccggttgtgctttttctatcaaccttacactcggcataatccgaatcggaatagcccaaaagctcaaagtcacaacccttaggataccacaagccaatattaggagtatgaactaaatatcttagaattctcttgacggcaatcaaatggcactctttaggctccgcttgaaagtgagcacacatgcaaacactaagcatgatatcgggacacacattgagcgatataccttttggagcgatataccttttggtccacacatttaccattgtcgtcgaggtctaggtggccattagtaggcataggagtcttgatgggtttggcatcttccatcccaaacttcttgagaatgtccttcacgtacttggtttgagagatgaaagtgccctcttgtgcttgcttcacttgtagcccgaggaagaaggtcaactcacccatcatagacatctcgaaccttttagtcatgatactactaaattcttcacaaaaagaggcattagtagaaccaaatattatgtcatcgacataaatttggcatatgaataaatcactcttaaatttttttagtgaagagagtagtatccgcctttccaatttcaaaaccatttttcaaaagaaaatctcggagacattcataccaagctctaggggcttgtttgagcccgtagagcgccttgtggagcttgtacacatggtttggcaactttggatcctcgaaccccggtggttgctccacatagaccaactccgagataggtctattgagaaaggcactcttgacatccatttggaataacctgaaatcatggtgagcggcataggctaaaaggattcggattgactcaaggcgagcaacaggtgcgaaggtttcaccaaaatcgagaccctcgacttgggtgaacccttgcgcaactaaccggactttgttccttacaaccactctatgttcatcttgcttgttgcggaagatccacttggtgccgatgatattttggtcaggtctctccaacaacgtccatacttggttgcgagtgaagttattcaactcctcttgcatagccatcacccaatccgtatcaccaagtgcatcttcaaccctggttggttccaaagaagagacaaacgaatagtgttgacaaaagttagcgacacgagaacgagtagttatcccctttcttatgtcaccaagtatgttgtcgacgggatgatctctttggacagtgtgatgtattcttggatggtgcaccgaggggacctgagcctgatcaggatgctctacagtgccctcggcatcaatcccatccacaggcacgccttgactgtcctctgcccggaacttcctggcagatggacccggaacttcctggcttggggaggtccggaggatccgatcatctggtcccggaacttccgggtcaactgactcttgactcgatgtagggctattggatgtcgatgacgaaggttgatccctatcttcttggtcatcctgcgtctcgactggtcgtatgtctccaatagccttagtacctatagcttgacttggatccacatcacctacaacatgtacaacaacttgctctccttgggagccattagattcgtcaaatgtcacatcccttataacttcaacaataccgaaggttttattgaagacacggtaggcatgtgcatttgactcatagccaagtaagaatccctcgtccaccttaggtgagaacttagatgaacgaggcctcttactcaaaataaagcatctactcccaaagacacgaaaataggaaacatttggtttcttaccactcaagagctcatatgaagttttctttagaattttgtggaggtacaggcaattgatggcatggcatgcggtgctcacggcctccgcccaaaagatatccgaagtcttgtacttatcaagcattgctcttgcggcttcaataagagttcggttcttcctctcaacaatgccatttttaggaggatcataaggggcggagaactcgtgcttgattcccacttcatcaaggaattcctccacttgtgtgttcttgaattctcctccattgtcacttcgtaccctcttgatggtgagatcatagaggttttgggcttgcttggcgaagcgcttgaagacatcttgagcctcactcttgtcatagagaaaatacacccaagtgaagcgggaaaaatcatcaacaatgacaaaaccatacttattacctccaatacttatgtaagccacgggcccaaataaatccatatgtaaaagctcaagaggacgtgttgtagttgatgttcttgataggatgtggattcccaacttgtttcccggcttggcaagcactacacacacgatctttctcaaatgtgacattagtgagcccgaggatgtgttccccctttagaagagttgccaaattccgcattccaacatgggctagtctacgatgccatagccaacccatggaggatttagcaatcaaacaagtttccggattcactctatccacatcgaaatcgacaagatagagatcaccctttaacttgcctttgaatgctacggaggagtcatcccttctaaagacggtcacatcctcatcggtaaacaagcaattgtaacccaacttacataattgagaaacagataataaattgtagcttaatgaattgacaagaagaatattagagagagattgattattggagatggcaattttacctagaccaattacctttcctttaccatcatctccaaacacaatattctcacgagttccgttctccttatcaagacttgtaaacatactcctctctccagtcatatgattggtgcaaccactgtccacaacccaacttgaaccaccggaggagtatgcctacaaaagaaatcaagcttgggatttaggaacccaaacctgtctaagtttgggtcccttgatgttagttaccaaagcctttggcacccacacacaagtgcggtactcatcattgtaattcacattaaaataagcaaccactttgccctctgaatttttggaaattacatatgaatcatagtaaagaccatctggctggaacctcctggcattatgcccggaacttccggtcatgtcttgtgcacggccattggcccgaaacttcctggcaaaccggccggaacttcccggtgggaatttttgagagacagagactcccacccagaggtttcgcccggtttgtccggatgttccgggtccctggcagctcacaagaccagtcacctcacttgcttgtggagctttaccttctcgcacaaacatcaagcattctttcccatttaccatcacacgcttaggcacaggacttccacccgaaaacccgagctcgtgtccatccttgttaggatgagcggtgatggtcttgtaaaggacatcttttgaatggtatgtcttcatgcatccatatttcaccaaagtgctcaacctttcattctctttcttaagagcttgcatagcgtcaatattagtagcataagagttcaaatcaatatcgtaacacctagcacaaccattgctagtaaaagggttagaagaattagaaaccacatttggttgagaggtgctattccaaagagtgtcaaattgaacttcaagatctttatgacttttgtctaaattagcaaatttttcttgaagagtttcattgacatccctaaggctagctaaagaaccattagccaaattaagctcattagcaagttgtttatttttagcacattctttagctaagctctcctctaaggcaagatttcttttcttctcaagaataagcaattcttcttgcctttcgagtgattgttctttactatccaaagctctcattaacttagccaaatgttgcatagcgggtttgctaaagctcttaagcacatcatctaattaattatcactttcctcatcactagaatcaacatcaagagaagtttgagagggcttttgagtcatcaccttgcggccttgggccatgaagcaagagtagtggtaggagtcgtcgtcatcatcactcaagttgttgaagagacactccttgcttgaagaggatgacttgaaggcgacggtagcaacaccaccttctccttcaaccttgtcttttgacttgggcttgggcttgacctcgggatcttcttcatctccggagtgccacacttccgccatgtgtgcctccgccacatgagcacgctccggcttcttcttgcctcccttagccttagcttcatttgacttgggacaatcggcaatgaagtggccatattcgccacaattgaagcacgctctctttgattgcctctttcccttgtcatcatccttcctccctttgtcatagccactcttgcgaagaaagtgcttgaatctcttgacaataaaagccatttcttcatcttcactttcttcacaacttgactcttcttcttgttttgccttcaaagcaacttcttgattttttatcatggcggcattattcaccatttgtctcacttcacgagcttcctcttcttgcatctcatgagacacaattcttccaagaatgtcacttggggtgagtctcttgaagtgtttcctttcccgtatcattgataaaaaagagtgggatttcttggaccaaatgcacgcagaagtctcttgaccacaaagtgatttgtcatgtcctcactcccaagtcctttaatcttgttgacaagaatcatcatcctatcatacatttcttgtggtgtctccttgacatccatcacaaatcttccaagccttccttccaataattcaatcttggcctcacgaacggcgggtgatccctcatgagccaattgcaaagtatcccatatctccttagcctcctctagtccatcaaccttgttgaactcctccggactcaaggcggagagaattgcattagaagcttgagcattgcggtggatgaattgttcttgccccgaagtgagctccatgtcatcatggggtatatcaatacctgtacaaacaactttccaaatacttggatgcaaagagattagatgcaacttcaccttgtgcttccaagcgtcataatatgtcccatcaaattgaggagtatgcccggaaggcatggagacgaagtagtgagagggaatagtaagtttgctgtaatcaaaaggtatagtagctcccttgggtggtggagttcccttgctgcttgcttcatcttcatttccattttccccattctttccccctaagtccaacatcgtggatcactcaaagcggtgaagcttgaatcaagagcacctcgctctgataccaattgaacgtgcagagatgtagcctagagggggggatgaataggctttcctgaaattttctcaacaaacgcagcggttaaattgacagggtccggaacctcctggtgatgaacatcggaacttcctggcagtgatgagtagcctggaacttccgaagttcttgagccaggaacttccgggcaatagagaaaaatgaaatatgagaagtataacaggtcctagctagtgaaaatcaggcacagggttgcacaagatgaaaatcacaagataccagcagattcaaacactgatcaagcacaagagagacaaaggcgattttttttccgaagttcggatcacacggatcctactctccgttgaggtgctccaaagagccgggtctcgattaaccccttgcctcacttatgcaaagatcccagaagaggtccacagccttcaactcaacacttctaggtcgttttctagaattgagtgaccaccaagatccaactcataattccttctagaaaagaccacaagtgcaagttgctctacctaggacaacctctgaaaactcagcacaagaaacttcactcacttacctcgtttccttgcggaggtgaggaaaaccttcacaaactttctcgggacatccacaagatctttggaagctcatgggcgacgcctaaccgtctaggagaagatctccaagagtaataagcccaagtgacagcccacaaggtatccaaagtgctcaatcaaacctaatcttcaagccatctccaaaacactcctacactctcgtctaatctctcaatctcacaagataggctctagatttgagtggaggaagcaaaggaagcttgggagtggctagaaaaccctagaacatgaatgaacagaagtggaatggccaaaaggtgacctggggacgaaattcatatatataacggctaggtgacgtcatctagccgttactcacaagtttgaactagaaacctgccaggaggttccgggcaaaagtgccaggaacttccgggcagcacttaggaaattttttgcaaataaacggtgcccaaaagttccggccagaacctccgggtagccctctctgtcccggggagaaaatcatttttcaaaaatgattccaaaaaatcttttgactcatagatatgactaagagcactttgtataccctagaaccacacttgaaacccctcttaatagtacggtttttcctaaactcaatttcgaaagtgaaaaacctagtctaatcaccttcgatgatttttgcacttaggaacatttgaattgggggggtctccttgcattcttagccatcacaactcgctttgggactaaactcctgtgaataaacttgataaacacgttagtcccctttaaccaccttgtcattaatcaccaaaaccccctagggggtttaagtgcatcttcagggccgatatgtatttttattgttttattcactgacaggtgggtcccgtttatgtttgttttatttgagtaccatgtaagcgccacgttgatgccacataggatgaagaccaagtcaactcgccacgtaagtgccaccgtagaacaaaatcgcctccaaaaccgctcgaggagttgatttgcaactgtttcgggagttaggggacgtgttatacatgattttgtggttgaggggtgtgattcaaccgggtcatgagttgagggaggcaaaatggacttattcctaaaaaatacaaggcctgagcccatgcggaattatctatgattgccacttcaagttgggacctactagtatgcaacagccagaaaaagagaaagaagataattagataaacatgacgttgacagatggattcaaatagttttttctttgctgattcagcactgatattgctgatgtgacaccgtgttatgttagcatacgacttgcagagtttgcaatactccaaaaaccagtttagcatcaataggattattagttgcaaggatttaatctggcttttacggccgaaatagacatttgaggtttagttcgggaaactgagctcgcacagtatcatcctccaaataatacagcaaggtacagcgaacggcttggtgcagtgatgctgtcagtcttgcgtgtgctgcgccgtgcgagcatgggctgcctgaggttgcaaacgcgagccaggcagccagcacagcaccatcagccgcgtcactccagctacagaaaaatatcgtactccgtcagaatcttggcccgctgcgttattatttataatctgctaattaagaaacaagtggtactaaccattcaaaccccatcatccattgttgcccccctaatgatcccatccacgcccatcatccaagcgtgcaagccagaaacggtaggcagcagttgggccaatgcattaaacaaaggagccatccgctgtggacgtgatcatgccgtggatcatcctagcaccagcaagcaaacgccttttttttctagattctccttggaatgaaggccggaatccgagccgtccatccctcgatccaacggcgcaaaatcgatggctaccaacaaacagctcacgttagctgcctcccctgggaacccccctgggaatgggatcgatccggcgacccggaaaaggcgccgattctgacgccgaaaggcgggcggccctgcagctgagccgaaacgaggctcggctacgccgtgcgccgcctcgccgccgtcgccgcgagcggaatttctttccggtcgatcgcgtttgggatttggggatctctttacgcgaagtcttgtggtaggctcatcggcggttgattggagctggagtcgccgagcccttttgggtccaatccagatatatatacttgcctttctgaaaaggcacgggccgtgaccaatgcggttgtgtggatgtttctttacctcctggggccgggcagattgatcgatcgatgttctctcacgtccggaccacaggttttgcgatggaaaatggtcactctctcggtgctttacttcgctacttcaagggtttttaattggtagtgatggtggttggtttacgtatgtttcatgtgatggtcttgtacagttgtgcataccttcaacactatctttatatactttgagcacacatcaacgctcactccttatagcaatatgtataatatgtatgtactttctaacggaccatactgatataattaagaattgagtggatgaattgaagataaagtattgattcctatcacgattacttacagcggacgccggacgaactcctacacatggcgaaaaggggatataaagaggatgactacgcttttaagtacatagtgcctgttttgatcccctgataaaattttacattctgtcacatcgaatgtttggacacatgtatggagtattaaatataaaaaaaataactaattacacagtttgtgtgtaaattgcgagacgaatcttttaagcctaattgcgctatgatttgacaatgcagtgctacattaaactaccttgtgggaacattttcgcactgcatggtaagaagtcgcgaacagtgggaaagcaacaggatggaagggattgagagccctcggacacccctacaagtcgagaacgacaaatatgaagaaggaaactttaaatttttaatataaaaggtgatctgttggagctgatttttaaccatttatccaaaaatcttgtacatgtattatcttattgggaaaaaaaggtaatacagtttagcataagaagaagaaattaggaatgattatagtgttgccaggtagggcaatggataataacaagagggagaaaagtatagaagcttactccctccggttttattttaattgacgttttggacaatgacacggtctacaaaatatacctttgacattatttttctattataatatacacaagaaataaatgcatgtttatttttattatagtgttttgaaagacaaatctatatatgttgttctagtttctttaaactaaatatttttgaagttattgatggtcatagttattgaagtttgactttaactttatccaaaacgttaattattatagaaccggagggagtaggttttactccctctgtcccatagtataagggattttggaggatgtgatatttctgtccggatttatagttctatggaatatcacatccctttaaaatctcttatattataaaacggagagagtaggagggatcaaaattgcagcagaccagcactattacatagagtctctctaacaacagtacaattaagtccgctacaaactaatgaacgatagttactgtgaagctccttttgaactgtcatatgttactgtagcaatatagtccgaataattagagtcgagagcttttgccacctctcgcatccgactgttctccgttgcattttcatgtagaagatctcattccggtttaggaagaaaaaaaagccatagttggaaaaaagtgcattttagatccgggtcatagatttgttctttcttttttatagaatagtaagggcatgtttggattgatgccctacaaaaattttggtagtgctaaatcttggacaagttttggtactactaaaatttttggtagggtagagttgaaaatgtttatttggattgaagtcaaaatttacccataagagataagtttataggcaaagccaaatttatagcataggtagagttttagcagaggtgtttggtttgcaatcctaccaaaattttgataggacaaattttggtagggtagcaatttaaattggccctaactctcggcgacagctacaaagaggccatatacaaattttcgagatacgcaatacggcgattttccattgcaagggggcgcaactctagcataatccggacgaacacttgcctccacacagagcgaaccaaatgcacgggttaagtagtaccagtacgacgtgtccatcccgttcaacacttgccccccgctctgaccgccgctgccgccaaggcgacccggtcggcggtctcccctgctcgccgcttgtttattcctcgcagtccgcgctccctcctcccggtaaacaaacgactcctgcagcctgcaggctactcctaccgctacatcaaccgaggaaaaacgtctgtcgcatgtggtgtgtgtgcattaataaaaaaaaatactatttataatattcgtaagtaaattgtactccctccgtctcaaaataagtacagttttacactattcatgttcaacgtttgaccgtccatcttatttgaaaattttttatgattagtatttttattgctattagataataaaacatgaatagtactttatgtgtgactaaatgtttttaattttttcacaaattttttaaataagacggacggtcaaacgttgaacgtgaatagtgcaaaactgcacttattataggacggaggtagtaacataaatttattaaacctaattaattttttattagcacatgtttactatagcatcatattgtcaaatcatggagcaattatgattaaaatatttctcgtaaattagtcgcaatctatgtaattggagtagttacttccttcatcccacaatacttgtctttctagcattcaaaagttgtcccaaaatattatcacttgaaagtagtacttgccacattaaccacttctaattcaaatttcttctcattatactcccaaccaccatcttacatccaactatactccctccgtcttttaaaaaaaagtaaactctggctatgcttttttttacggagggagcacattagttactaaaggatattatagtctttttctcttaatcttagtatatgctaaacaacctagaattatatgtattttgctacggagggggtatattttttaacttatgggtgtatttagttcacgccaaaattgtaagtttgattgaaatttgaacgatgtgacgggaaagttggaaggtgtgtgtaggaaagttttgatgtgatggaaaagttggaagtttaaaaaaaaagtttggaactaaactcagcctatatttaatactccctctgtcccataatataagggactttgagttttttttcattgtttgaccactcgtcttattcaaaaatttgtgcaaatataaaaaacgaaaagttgtgcttaagtgctttggataataaagtaagtcaaaaaaaataattctaaatttttttgaataagacgagtggtcaaacagcaccagcaaaaacttaaaatcccttgtattatgaaacggagggagtactttggtatatgtgttcagacgttcgatgtgacgggatgtaaaattttaacgtggatctaaacagacgatcaaacaacatcgacgaggagtaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgatttagcttttatttatgtaattagttttgtaagtagtctatatttaatactctaaattagtgtttaaagacagggagacagggactagtccctgatgtaaacaccacctgaaacaacgaccgctacgctaggtccatggtcgtggcaacggcagcgcgtcgggagacgagctgagcaagcgagacacgagaccatcggcggccacgctcttacacgccatcaaccgcgagacacgactcacacgagactccccacccatcctcctccgtgcgcgctggaggaggtggaggtggaggtggtggtgtccgctgccccccgcaataaataagcctacctccatgttcccacccccctctctctctcttctccgtctcgcctcgtcacctcacctcggcatcacccaggtgggagggggtccgccttgacttttcgtgttcgggtttgggtttgagtgccgcatctgcaagcttgtgcgaggggggaatctctcttccttgctgtggtggcggcgggcgggagggcggcgttgatttcgttggggtttgcgttgcgtgcggaggacggggttgtgtttgtgtgtgtgtttgtgctgatttgggcattggtgttggtggtggaggaggatggggaactgcgtggcgaggagcgggacggcggtggatgcgggtggtgatggaggggaggatgggaagaggcggaggaggaggtggaaggcgccgcgggaagatcagctcgggatggtgcccggccggatcttctccaacgacggccgcagccggacggcgacggtgtacacgcagcaagggcgcaaggggatcaaccaggacgccatgctcgtctgggatgtaagtggaaggtttctcggctctctctctctatctctctccccctatctaattcccgcttttctcggcgcgattggctgacttctcgtttgattgatcgtgaatggcaggggttcggcggcgaggacgacggcgtgctgtgcggggtgttcgacgggcacgggccgcacgggcacgtggtggcgcggagggtccgcgactcgctgccgctgaggctcatgtccgcggcgcgcgacagcggggcggacatgccggccgccgcatggaggaaggccttcgcgcgcgcctacaaggccatggacaaggacctccggtcgcacccttccctcgattgcttctgcagcggaagcactgccgtcaccgtcctcaagctcgtacgtgccgtggacaccggacatgacacgcatctcctgtccatcacccccccgtcctctcaaaaatgtcaaatcgaatctgcctactatgcgtctacgcacggcggctcacggggcgatttctgcatgcagggctcggatctctacatggccaacattggggactcgcgcgccgtgctcggctccagggaggccaccggcggcggcatggtcgccgtgcagctcaccgttgatctcaagccggatgtccccagtatgccactcccctgcttccactcacccgctaatcgtgttaggaggtcgtgctcttgcgcttatggtgctggttgtgatttcaggcgaagcggagaggatcaagaagtgcaggggcagggtgttcgcgctgcaggacgagccggaggtgccaagggtctggctgccgttcgacgacgcgccgggcctcgcgatggcgcgagcgttcggggacttctgcctgaaagattacggggtcatctcggtgccggaattcttccactggtctctcacagaaaaggaccagttcgtcattcttgcatcggatggggtaatttgctcgaacctatcacttgaacagataattcattgttctctgtttggttgttggatatttgcccgtgcagcgaatgagtatctctgtccctgcaaaatcctactttctttccgctggaattagattagttgcgatgtagtgtcaatctgtcacactttcgcattccacatgttgttagttgcacatggcgggcctagcgtatccatgacatctcgtgcatttctttagaagctaaaagagacgtgattaacatatccacgaatggtttaggcttttgacttcaaaccgctgtatctttcaggatttatttctaaaactatcatgattgcaggtgaaataatttaagtatcctccatttgtgccttttgtgactgcggcataaataatgattagccagcttaacagtcttctttgctgcatgcctgcatcgtcacccactttttgttatcagctgtactcaaactgttaaatcttatccttattcaacttgactcggttgattgatttaattgttgttgatgagatcatgtgcacctttcaactgtagcagttagaagtgagcacattaagctaatggcatatggagtagccaataaaattaggaagtcctaatggtcaataacttgttttcctgtcaatagtctacccatctgaataatgtgggtattctaccagacaaacccaaactactttgggggaaattacacgatagatcccagttcacttcaattccacgaaaatgtcataatacctagaatataccacactgttgactttcacttaactccatcatcttcacctctcctcttgttcatccacatgttgtcatctttcttcatcgatgcatcatgtgcctgctgactggtccacaccgcctcaccctgcggataaaacgtgacccaaccagtaatgctcctttccttatcgtgatcgcatactagtacctcgtgtcaccaatcatgactgcgctagggcattgacaggccacaccgctgtgaccatgactgttcacaatattgccaacacctttgtctagtgtctacgtgcagccacctgcatccacaacaatcttttgctacagttcaagaaaaaagtgcactgaaaatgcagcgtgttggaagatggggttttttttgggggggggggggggggggtggggcgcagagcagcaacataaaaggggagcatgggcgatgcagggctggcagtgctcattttgtttagtggttgtggtagcgtcattgctaagaacagatgagatgataacatagggtgctggtcagcaacaatagtaatggagggtggacacaattagctgctatccattaaattcagcaccaatagtaatggagtatcttttttttctggtattaaaatgaactgggttttttttttgtgatatataccaaaactgaatcattcagtggtatagtaggacatcctacttttgcttaaatgtttcaccaattaatttctgccactttgtaatggagtggctttaagcttgtcatttgtcaatcacttgaagtggatggttttcctttcttttttgagcattaggtgggaatcacgtatgttcaatttttttactattagggggattgaatttggtgacactcaataggtagtaccaaattaaggcctatatgtattgactttataaactagcggtgtcatgcatgatcatatagcatgaagactggttagtgtatcttaaaggtcactgctatagagtggcaatctgtcagtatgaaagagctgtgcagactattgcattgtggtttaatatagtttaggtagtccatatctaatcaaacagagccttattctgttacacatattactttacttcagctgcaacttcttggtcttttccctcctagtctcctgggctgacaacttctattgacaagtgaatgtgtgcactgtgcaaatcaactttccttttcatttttatgtcaattttaatactgttgttatgtgtgttatgtacttgtcaaggttatattctgagaaaacttataattagtaaccatctatcaaaagtttctatccttgaatgtactatctaatgtatactgccaaaaagtgatgtttgaactttttaacctattatgaaatggttgcaattggcgaggaaagatgtccattttacccatgtaataatggtatctagtatcacgcaaaatgattttataagaagaaaatagttaggtcgatgtcaatcactgtctaccaagttgatattgcagctgtgccagaggagagcaagcttctttagttcctttttgtattgaatgtagtttgaaaagtcgaaagactttagtttggaatctggaaaagaacagataagttacttggtctgcttattcatgccatagaagctctcaatttgtcattgtcttttcatgtatgtcatatatcccttgtttgcatgtatagttcttactgaagttacacaagctatgcacatacttggctgcctttgtagagtttgcactaacaaaaatcttgcaggtatgggatgtcctcagcaatcaagaggctgttgatatagtgtccgcgtccccaagcagatcaaaggctgcaaaatcccttgttgaggcagccactcgtgaatggaaaaccaaatatccaacatccaaaatcgatgattgcgcggttgtttgcttatatttggatggaaaaatggaccatgagcgtgactcaactgcctcattggacaacatcagtattgaagagggttcagttgcagatcctaatgaacctcaggagcaggagcccaccttaactcggaatttcacagttaggacagttgcaggcagcacgcaagagaagaccttagcaggggtggatgcgaggattgctggtgtagcgaacgaccaaaattggtcaggtctcgatggagtgacacgggtaaactcacttgttcagcttcctaggttttctgaagagagggcaattggctgagctgcccatcttatatttacccccgttattttcacctattgttctgaattttagcgtagttgttctagagaaaggtagatgtgggacgatcttgtgatttggtgcggtacttggcaagcgtttcagccactatgcatagaagtcgagttgcacgttttagcccaacaaaactgcacattgcataggacagaggctctcttttcacccatcttgaggcatgtcaactccatacctcgaagatgaagcacaaaagagcaggccattgctccaaatctgcaattttgctgggttaaaactaacaaaagacgacgccaaacacagtggctaaacgcacgccaggccccagtcacccctgggatgatattgtcgggtgacctgtaaattctccaccggcgcttgctttgcttttgtagagaggtgatgtccagaccattttctccgctgcatgcttagcttttgttgacacagggcggtgcgctctgtcgatgtcggattgccaatctttgccccctttgttttgttcgcggtctgtgcccttgcttttactctcctggagccatcatgccaccgagaaaaatggcagtctcaatacttttaggccccctttgattccaagggaattcataaattttagatgattttatttctataggaattttttctacaaagccctttaaatgaaagaaatgaaccctatggaatcctatgaaattcctatggaatgtctcttcctatacaagtttttcctatacaagttttgggggaattttaacaagaggtagaacctcatggaaaaaattctttgagtctttatctcttcttaaattcctgtgttttttctgtggtccaatcaaacgatcattcctacgtttttcctatgttttgcaattctctgttttacacttacattcctatcagaatcatatgtttttcctattcctacgattcaaagaggcccttagccttaatggtggtgaactggtgactgatggtgcatccgtacaccaccgtacatggcacacgctgcatcttgtctgaaatggcatgtgaccggccgagcgttgctgcgctgtaggcgtgcgctggtgagcaaaatttgtccggcgacggtggccggccgacgcacgggcgggtgcaccgtgcaagagagatgcagggggagacaggcatccggcagaccggcaccgtaccactaccgacgggctgcacgggcacctatcacgtgaagtagatttgccgtccatcctgtggctgaccatttaacgaatcttacagcttttattgggctttcacacgcacattcacgcgcacagtctcacgcacgcgcgcgctgttcatacgtggctcgttgctgttgcctgtctcggtgcgccagccatgggtggacgcgaagtgaccgctcggtgactgggcggtagcgtgaggcaaaacccaaaaaagatgaggtgatcgaaggaataagatttttcaccacaaccgtagtttcagcggtcgagcggccgcgcacgcaacaaggtaccttcggtccttcaccgatcactggccgctgagcactatttgcatgacgcggttgtggtttgagatcagaggtgcaattgtaataaggagttgcggttcgactgaggtcctgtttagtttcaaagtttttttttccaaacttccaactttccattgcatcaaacatttcatacacacacaacttttctatcacatcgtactaatttcaaccaaacttccaaacttcagtgtgaactaaacacagcctgattgatacaaaacgaacggctcagatagctagaaaacactattcacgaattacatgtgaagaatctatactgtagtgattattgtagagtgttagaggtacaagagggtagcagagcaaatctgagactctattgtagcgattactgtagagtgtcaaaggtgtaacatggtaccagagcaaatctgagcccttggctttatcgatccaacggtcaaaacgtgttgtgactgctaaagtagtagtagtagtaacgactgcatcggatctcaattccgcggttataggggatcgtgaacgtttgtggtctgcgaaagcaaaatgaaagctcacccctcccccagcaagtgacacggcgaggagagaagacgtggacgagcagccgtcgttcgatgacgaacttccttcagctagccccttcctctgactgagaagagaagatgtagtcgagccccttctttctccggttagcttcccttaacaagatcgatccgggaaccaggccagctcttttctccaccccccccccaacacacacaccacaccctgccccgaaaccctaacaaaagaattcaggcgcacattcaaaaaataggattttcagttggcggaaccagccattgaagcccacgaaatcctagcaagtggcagcaaaaacgtgcctgccaccaccatcgccagggagtggcatcatgttcgagctccgctagtccatcttcagtcttcccttgaggacaagactacagcggcggtgcaacaacagtagcagttggaggtaagcatcacaaggtgttcctcactgtgtttatgcaagaaacctaatcgaattcatacgttgtgcaggggcatgctaatcttctctgtatcgttccaattgtatcggctgttataaaaaaaaaagaattcatacgttgcttgctgcacggtcaaatcaaatgcatgctttgcttgctgcttattgtaattgtgctatgctactacctggtcttggtgcatccatattacccaagtttcacaagcagcaagcatatgctgaatagttgcgattgttgtacccaatactagcaggaagatggaccgacggagtttgagaactgcgcccaaggtggcagcgaggaagcaacgtttctcggcggcgcatcctagcggacgagctccgggtcattccccgccgccgacgatggcggcggggtgaacgcatgtcatcaaactctggagatgtgtttgctatcactagtgagcttgagctttcatgggttggttctattagccagtactctcttcatctcaaaatataaggaattttaaacgaatggaaatgtaacacttcctagtactataaatttggatatggagcctgtttagactcgtagtactagaaaatatcccatccattcaaaatcacttatattttaggatggaggtagtattattaagggcacacgtcatgtgagagatgttatatggtttggacagtggatgagtactgattgcacgctcgtttcagtcacccccatgaaggcagacaatcctggttccaacgggagacatataagagatgagggaggctcgagagtgtgggagcatctcactggagttataggaggacgattgacttcaaacataaaacaatttggcagttggagaagtggtagggaggagatggctagtagggttcaccaggaacagtggtgacgctatggatgcaggggtgacagaatgaagagggtgggatagcggcgatgcacaactagtgagaacaatactactactaggactctaggagacaaggaggacgagtgtgattgagggataaggtgtcttgcacaaatcttaaagagatttcatccattgaaaatcggttgattttccccatgaaacaattcaatgataggtagacggtctctataatttagtgcttttcacaaacaaacttgtagctcagtgctatgtcgaagttaatcattttccgcatcaactcgaaatttggcactgtggaagcgatactacactagacattgaaatggcaagaagttggtgccaatctctttggtgcacacctccaaacaaagtcacatttcccctctatccctcttcatatatgggcttgttcattttgctacaactttcaactctaccaattttatttggcaataaactggacaagtcgcatctttatttggcacaccttcattgaaaaattgacaaaccaggatatgatgttagattttccaagtttttttcaatcttataattaatttatgatattgggatttaagtgtggtagagaggggacaaactctcttttctgctccatcccgctcttcaaacaatggtgtggtgagttggtattagactttcaagggaattgataaagcagggtacactgattcacttctcataatatatttttacttttataatgccaatttggttgacggtcagtttgccgcatttaatattaagcaagaccaatttatacaactatttggttgaagccacagttgtgataatattctcttccaacaaattaggtctgatgcatcaataacttagaaaaatgtgccaaaattcttttagacttattaaggtttggtaaagattttgagcatctaaccttagagaagtttgacaactactattgacaaacgatggcgacttgtaaggctctgactagcaactaaacaaacactaattcttgagattgagatgagggtgcgggaggtcaacgctaacgagggtggtgccaaccttcgacaacccaagagaatgggcagcaaccccattcatgacactagttgtaatggactctataccataagtaccacggagttatatggctgtgctgtaaattgtagctggacaacccataatcgttaacactaagatgtttatcctccatgtctagaactctatagttaaattctaggtttaattttcgaaaaatggctaggaagtaaaaggcccaaatttgtaagatttaacaaaaattaaccaatctcgaaagaaattagatgctcgtacaaaccaaagctgatcaagggagctccaaaatctgaggatattcgacgaaattcgagcggaaaggtgaactcgtacttgttcactgtccatgtaacattgcgtgaaggaagacagctggagtattattgtactaccatccaaccagcagccggaagaccgatcatttttaacggaccaattgcgagaatacgccacaagttagcgtggtcaaatctcaggaaaagcactgcaagtgcgagacagagcagagaacagttcagcattttcaggctgctagctagcaggtgcagtcttccaaatggagcaaaaaaaaaaaagagaaaaaaatgccagttgcgcccagctgtccggagcacgtctccacgtgagaatcgccgaacgacccgccaccgacactgacatgcgggcccaatcccccgtacgcactcgctgtcctgtcacccaaacctcttcttcccgaagcctctctgaccgcgttgcattcttgcggctcacgagtcacgaccacccaacccaacccacccacgaagacgtcaacacgaacgcgaacgcgcgcgcgacggcgcgagccgtatgtaaggttcgctgcggcttcttcttccgctcgcccgcgcgctcatggccgcactccgccacgcgacgcggcgcgcgtaggaggcaggcggctcgtgcgtataagaggcgacgagacgagacgacgacaagaagacgccggaagcagaggcaggtagcgtagcggcggcagtgaagcgagggacgactagcgacgatgagttctcgctcggcggcgcgaggaggggtgccgcggccgaggaggccgagcagcggcggcggcggcggcggcagtaacacgccgaggccgggcggtgggggtggcgtgttccccgggcgagcggaggggttcaactggtggggcgcgggcgggcgagcggcggcggcggcatcgacggcgccgttggcgaggcggcaggcgtgcggcagggcaggcagggcgtcggcgatggctcgggtgccgacggggaaccgggaggtggtgcggcgggcgctgtcgccgcccgccacgcgcagccgcggcgccggcgcgctgaggaggtggagcttccggccggcgccgagccggctccgcaacgcgtcgtcgtcgccgtcctcccctgcctcgccacggtcgccgtgatttttctcctctgccgccatggcggcggttctgaccggattttggcattcttccgttggtgacttggggtaggcaccggagattactgtcctttgtaattaggagtagtagtttgtaacgtttaatttttagatgatgatcctctgtaattagtagttccagattaattcttttgacatgatacacgtacactgggaaaatgaattttgagaattacacagtacaatgcatatactcacaacgcacgcgcactcacccctatgagcatttttgaagaggcgcctcgctgtcgacgggtacatcgcatgccactgaagaacccagtacctcagatgctactgaggctcttgtaaccattaggctacaggtcctttcacactgagaaaatgaattttgatcaggttaagttacacttgcgctgtgtgtagttccaaaataattcttcaaacttctaactttttcatcacatcaaaattttcctacacacaaacttctaactttttcgtcacattgttccaattttagagtgaactaaacacataaacaaagccttgatgaaaaatgcactgttgtataggcgagaaatttcagtatatgccattcaagcggccgaagcatctccccgtaagctcaagctccgccgttgccaccttcactgtggattcgccgttggagtataaaaagatcggtagatcaccgagaaacaccatagccgccggactcgatcgatggcgtcgctgactccaccactgtgctactcgattcataacacttttcagaacttgttgccgagggcacgaagtgttgcattccgtgccatccgatccatccagtacaaaaacggttttccaaacagccaataatcattttcccggacgaggggaaggcctgcctacacgcataagcctgtgaaaatgaggcgccatagctacccacctgcgaaaatattttgggcgaaaaaaaaaatcaccacaccccccctacccaatccagccacgccgccgccgcaatcctcgcaccttcggccagatctagggttaaggttttggggggagagggagagggagagggagaggaggtgaggggaggttgttgcaggggcgacgccgccacccttccctccccccttcagccagatctgggagggagggagggtaaccgtcgccaccgcctggagccgcgtcgacgctgccaggagggagggaggggagggaaggaaagccgccaccgccgccctgtcccctccggccagatttaggagagaagccgccgccacccccctcccccttccctccggccagagctgggaggaaggaggggagtcaccggccaacacgccctcccccatgcccccttcagccggatctgggaagggaggggaggggaggggatccgggctgagggtggtgcgacgccgcctccgcttagagccgttggcgccgtcgccatcgcctatcccctccctctggccgaatctgggaggagggacggaagccgccgtcgccgccctctctcctccccccttcggctggatctgggagggagggaaggggagccgccaccgccaccgccgctagccactgctgtcgccgaggagagagggaagaagaggtgggagggaaggggaggggagcaccggggagagaggcaaggagaggtgggaggggagggagagggacttaggatttttgactgcatgtgacagtttttatgatgcttaaggtattttcgtaggcagatctattaagagatcccaggtagacgacgaactcacccacggttgtcatttttttaggtggtcatttaactccgagaggcctactcgtctggaaaaacatgccatcgtctagaaaaatggttttcctggtagtgatcgggaagtcacgtcgtacgattattagcattgcctgtcgtagtcgttgtagccacggaggtcgggcacgatggcatggaatccctggcccttctcatcaccatcggttagcttctcctcgtgttgctactctactctcccactccaacacactttttgaatagaaaacagcactatagtgccttttcattgaatagagcagcagaaaatacaacccctagagacaaaatgaaacaagtagaaacactatagctatacattatacagagtgcgggattaactcacgcaaccgtttagcccctactaaagcgcaaaggctagcctcttttttaatttttgatagaaaaaaactcgttgtcacctctttgtggttaaagatccgccgattcctctcctttcagcacactgggaggaccttaattagtggcaagcggcacataaggaatagctcgtcgacggaggcccgatgcgtgtgccggtaagaccttggtggctaacggcgtgagcgaggagctcgccaatggtgcccggatgcgcgcgccgggatgaccttgctggctggctggcagcgtgtgccgaaaggaccttggcggttgacggcgtgcacgaggacgagctcgtcgtgcttggacctcagcggctggcgacgcttgacagtggccagatgcacgcgaggaggacatcgacagccgacggcatgtgcgaggaggagctcgccgacggcgatcagatccattactaaattttggtaagttgtggtaagttttgaaagtgccgttaattgagtggcattactaaattttttccgttatatgcatattatacctacttgtacacctgggctgtgtttagttcacacttggttgaaattgaaagtttggttgaaattggaacgatgtgacggaaaagttagaagtttacgtgagtagaaaagtttgatgtgatggaaaaggttggaagtttgaagaaaaaattgggatctatacacggtgcaatttcagtactacctccgtcaaaaaagagtatagttttgcattgtttatgtccaacgttcgactgttcatactatttttttaaaaaaatatgattagtattattattattattagatcataaaacatgaatagtactttatgtgtgactatttttttatattttctcataaattttgaaacaagacgtacgatcaaacgttgaacacggaaacccacaactacatttaaattgggacggaggtagtatcaaacatcaaaattgagttgaaaaggcaaccttctctctctcactggtcgtggcagggcgacctcagactatagatggccaaaaggcccgcccggcacggcccggcccaggcacggcccaccagccatcgggccggcacggcccgatcggcacttcgtgccgggccgtgccggcccatgggctgcgcctcccgcccagacacggcccaccagctgtcgggccatgccgggccggcccgaagacgcgggtggcccaccgtgccttttttaaataagtctagttttcgtccctcgtctttgggctgtgacataatatagcgaaaataagtctattttccatccctctactttgggctatgacatatatatatatagtgaaaataagtctatttttcgtccctcctctttgggctgacatatatataggtaaaataagtctattttacgtccctattctttcgaccgtggcatataatatgtctatttttactccctattgtttatgtgtcgggcttagcatgcggcccatcgtgccgtgccggcggagaggcccaggcacggcccggtggtcgggccgggccggcacgggcccgacccttgacgggccgggccgtgcttgggctgggccaaaacgccgtgccgtgggccgggccgtcgggcctcgagccttttggccatctatacctcagacgcccctccagatcccctccttggctagggctgtggtctttgctccatgttcccaacccctctccctcgtattccgcgcgcactctttttaaattgataaacggtgtgttttttgcaaaaattttctatacaaaaattgcttaaaaaaattaaattaatccattttttttaaaaaattgttaatacttaattagtcacgcgctaatgggctgctccgtttttcgtgcggggagatgggttccaaaccatgtgttaacagtgaaatttggtaatcggcaaagacgtcatcagcttagaatcattattggctgcagcatctcggaatcagccgatgggagttatcaagtcgccaatagtcggattcctgctatattcagttaaggaaatcaatctactaaaggaagcttatccctaagtgaccgagtttaaagaggatgcggcatggcagtttatctattaattaggaatagtttgttagtttccttttatctttaggaaagtgtgtttagtgtccaataaggactttatattttccttttatctttaggttagtttctttcttgtccgacaaggaattgtatcaacccatgggtataaatatgtacacccggggtctatgtaatctatcctcacgatcaatacaattcggcgcatcgccaccttttaccttttctatttaattttatcgttcggcgggacttggcacccgacgcggggctgcatcggtgttcgatctccggcgaaggggtaagtccaatgttctgccggcccgggcaattgtctcatctacatcggcgtcgttcaaggctgcatcaagacattcgacctcttggattactctggtttggatgatatatttgcctacctatttatcatatgtctctgttaatctagtcttagcatatcaatttagctctattggctgcttctcgttttagggtttctgccggtatcggctaaatcgtgttgctagattagattagcttagacatctaccaccctgaaaactcaatcaacgacttgattgtctagatattatgtttcttttcatacttagtgccgcatcagttaagtttgatctaataagtcatgcttagaaccataatctctagcctgcttcttgattgccaataagggtttcatcggggtttcaaccggtgagttatctggacgttgcatcggctcataaggattgcatatacatataagtttgatttagccgatgacaacaaaggtttcactgtttaatctaatctgtggatttattgacatcggtcttccagccgatgtgtgcttgaaccttcggatcaatgtttattctatcatattattgttagccgattgatttatactggattatattgctatattatattatcatcagccgattgccttcatatcattatctacattggacatatagccgattgcttacaccctatcgctatcggctggtatcagcatcggctattatcggctatcggctggaactactccatcggcttgttagccgatcggctgttttgatctactatttgcatatcttgtcagttgcaggatcaaactaactggcacgcccgcatctcatcaatctttggacctgcactggagctaagcagatctcccaggccggtgtgttcgatttttttcgtcaacaccatgacatgcgaacacaccctaggtttaagaaaaccggtcggttatcatgaaactgtcgatggtcgttttctggtattggatcaattttcgtgcaacgttggttgaaagtcattgattttacaggttatcgatcggttttcgataaaccggtgagaagcggttttaaattccaaaataaaaggttaaaccatttccacgctgtcgacgggggatacccgtagaccggatatagagggtattggggtacgctggtatgaggatctacataatacgacatcaagtaggcagaaaacaaagaatatactggttcaggccccttgataggtaatagccctaatccagttaatatgggattatatgatggaaaccacatgttacaaagggaatagcggaactcgatgagatcgtagtcgagttgattcgactagatcacccggcgacttggctcctgtaggctccggcttcgtaggctgtggtggatgtgttggcggtaagattcgatgccttaggtcctcccgggggggtcccttttataccgtaggtcaactggtctccaagtaggacccggagacatcggacccggtacgatacaatgacgacccagttctatccgagtaggactctttccgtctgtgaactccataatgaatttccttaacgtatgctgaaaacgtccgtatgcacgcaagtataccatatcgatatgtaacgtatatcgaagggtagagggtataccttacccgtaaccctgacagtagcccccgatttctgtttaaatgaactcgtgaaaccgatcgcgacttccgatgtcgaggttgtcgtcgttctcagtgtgaggactgacagacaaggagtgatcgacaacaccaggtgaagctcaacggtcatgagtgaatttaaattgatgtccgaaaaactgccgcgcataacggacccagaaattttcggcggccatctctctcctttccttggaattctcaacatcggaagtgcgtctatttaagagagttttggggatccaatttgaagtccgcctattgtgaaaaaactctccagcctccaagcgtccctcgtcttctccgctcccgcaaaaaccctagctagctcatctcggtcctttctctggcgatctccggcggcaatggatctcgacaagtctacctgcaccagcgcgtcgctgaagaagctgcaggaggatggcgcccttcctagtcacgggaccatggagagagaagcaggaggtactgaaccccaacctgtcctgggtcgcatggttgcgatcgaggattatattctctgtggctttcttcctccgccttctgaatttcttctcttggtcttgaatttctacggcctttccttgctctatttgagccccaattccatcgccttcctgagtatcttttcgcatctttgtgaggcctacattggggtagagccgtttcttgacctcttctgcttttactatgagttgtgctggatggaacccaaaaaggtgtccggatgtgtcggtttttgacttcgggatggcctgaagtcacgatacatccccttccagtgcccctcatcttgcaacaaatggtgggggaggtggttctatcttcatatatcatcttggaccgccagacccgccttgaccccatccttccaatctttcatcgatatcattgatgacctccgagtacgggggttgtcggggtatgaaatcgctgccgacttcattggtaggcggatccagccactccaggcttgagcccacccagcctttgattattctaggccggaggacgcgacccaggtttctcctcggggtatttttctttttagttaaattgactcccttatgtgcgtgttcttcccgacttattgaattctggtcttgatctataggcttggacagcgcaaccgtggagcgccgcgtcggccaactgatgatcagtggcccgacaacggcgagcaacgtccccgtccccctttgcgagaaaggggcagccgagcgcgaagctgccatcaatgtaagtgtactcagcggtccttttgcattattcttccgggatcgcattatgatttcatgaagcgtaagctctccctctgactgatatcatcgggccactcgtggaccatcaggtggcggcgtcgctgaaggagaaagtcgccaaggaggcgtctgacgctgctgccgctgctaccacaacgagtggcgacaacgttccgaaaaaggagaggaaattctcctctgtgatcggacatcgttggaagacgcccaccccctcggtaagctctcctggtccttcatcacgtagtcaagaaacttccacctcacctcatatacgttatactccaggcctcggatgcgtctcccccgcttccgcgacggtagcggcttgtgacgctcggcgagaagtaagtgaatgaatttgaggtttcgtgacttcgtcaaactcttgcagtctgtctcaattgcagcctttcgcagggcggcgcgggcgaaggcggcgcaggacgggtctggggggacctccagcgcgtctcctgttgtggcctcgacggatgtcgtggtcgtgcccaagagccgcgaggcgacacctagcggcccagccagcgatctcgtggctggtcgtggtccgccggctgtcgtcctcacctgggagcagctccaggttgagatggggtgccttctcaaggctggtactcgcggcattagccgcgagatcacggaggcgagggcggtggcggcgtcgtcggcgaatgagcgtgccgaccggctggcgcgcgatatggaggttcgcgaggacctccagaagatgagggaactggtggccggcaacgagcgacaacggtagggactagagcaccgcatgtcggagctcgagaacaacttgtcggaaatctgtggctcgttgcgggtcacctatattggtctgcaccagctcgccggggagtgcggtatcaagtctaccatcccggcgaatcccgatgaattctcgctgacgtcttttcttgcggagctggcgacggcgatggaggagatcccctccaagcacgcggccaggatcggagaggagacgtccaacgggatctataccggggcgtgccatgtccttgcgtgtgtgaggctggcgcaccctgaactcgatctgcggaagatcttggatcagggggtggctagcgacgcgcacaaggatgtgatggaagaagtcggcgatctgggggagtctgttttcccactttttgtagagtaggattttgactctcttgtactctttagtcatgctttgtaaaactttcattggttccaaccgcctttgtgtgtgtagtcatcgccttagctttctttagcattttgatcttgagtactttgttgtcattcgtagagatgttgatgtcgaggatgtccagcagcgcgggcagcctgagttgccagtggtcgttccgttgcttgcgttcgagccacatgttccggagggcgatgtagctcaaaattcgcatgtggaaacgggcatggcgacgactcccttaggttggttatctctgttttcatctcctttactcttccgtctggatcgatttgatttgttgtattctcgggagagaagagcagtttgacttagtcgtttccatgctgagcagacctcgagagtgcgcttgctgaccaggatcgtcgcatccagtattggaggacgaagtttgaggtcgcggaactcgagaggactatgctagaagtgaagaacgaccaagccgtggagacactccggggtcgcgaggtgtggttcaactcgtatctgaagagttgctgcacctccatgtcaagggtctgtagagagctccgagtaccccgtggggataccgaggaatcggcggctggatacatctcgtggctaaatggggactgcgcccagctcgagggcatcggccagcgtatcgacgaagccccgaagcaggagtgtcgtcgatcgagccgatatgctgggggggcatgtattggcttgtatacgagatcatcgtccgcaactgcacctcgagttcctccacgaagggttttctcgttctcggagaactcctacggagatagatggcctggcgaagtcgatggcgccgctggcggaaaaggtcttccagtctatggactggcgttggccttcctggtagtctccgtgtcctgtgacaaatgtcttaggggaaaagtgtaatataattttggatttttatagaattgtaagaagtacttgtgaaatagaaaagaaatctatctaactaagctttcttactctggatgtagcgtgtatgagtgtcttctcacttcgcgacttcgatcagtcgtttgagttatacactctccctagcccccagccttgtcatcggagaattcttctcgggagataaggctcttgtacctttgacctgcctcgattgaacaagcactaatcctagcccccagctgtgaagttggaaagtttatttttgattacacggcttggttaatacgcacggcgagaactcttacacgaccagatcttacatggtctttcgtctctacaggatccgacaaggccttatcggctctgggcatccccagccgaagttcccttaggttcctcggaggccttgtcaagacggcgtaaagggacatgaggataggtttcaacgctaggtgtcatctgggtaagggatcatcgggaaggaacactttgattgtagtctgtacctaaaaataggctttattgaagctgtaagatgtcttacaagcatggatactattaacttatacatagaatttacgtaattgatcaatgttccaggaatttgacaactcgcgaccatcgccgtctgcaattttgaatgcgcctggccgcagaacttgtgtgatcgtgtacggtccttcccatttgggtgagagcttgtttcgccctgcttgactttgaacccgtcggaggacgtagtcgccgatcgaaagtgtgcatgctcggatgcacttctcatggtaacggcgatgggcctgttggtagctggctgctcgaacggcaactcgttcgcgatgttcctctagtagattcacatcatcgtttcgttgctcctcctgatcctcatcggaatacttctgtactcgtgtactttaatgccgtagcttggtggggagcatggcctctgagccgtacacgaggaagaagggtgtctccttattggacgttgtcggtgtggtacgcacggcccatagtactgatggaagttcttcgacccacttcttgtcatgtgacatgaacctgtcgtagacgcgggtcttgattccttatagtactatgccgtttgccctctcgacttgtccattgctctgagggtgagaaaccgaggcgaagcagatcttgactcccagcctgatgcagtaatcctggaaatcagcactaatgaactgggagctgttgtccgttatgatacggtggggcaatccgaacctacagaatatccctttgatgaatttgatggcgttgtcggccttgatttccctcatgggtgtcgcttcaatccacttcgtgaatttgtcgatcgccacgaataggaacctgtagccgccctgtcctcgtgggaatggcccgagtatatctagcccccaacacgagaacggccaagtgagagggatagtctggagtgcttgcgctggtagccttgtgtgtttactgtggaattgacaggcttcacactgctgaaccatgtcataggcgtctttgagggcggttggccagaagaacccttgtcgaaaagcttttccgactaatgtccgaccggcggcatgtgacccacagatcccttcatgtatgttgaggaggaggtgtctgccgtttggtgccttcttgtatagatcgttgccgatcatacagtagacttttgctttacggaatattttctcggcttctgcgtcgtcctcgggcaactcttcactgcctatgaatttaatgagtggggtgcgccagtcgtctgtggtcccgatatcggcaacggcgcgctctgcctctgtagcccccgagctgatgttgagggcgaccgggctaccttcgccgcttgcctctttcactgatggcctggtcaggacgtccagaaaggtgccaggttcaagtggctctcgtctggatgcacgccgtgctagatcatccggttcgatgttgtctttgcggtatacatgttggacctcgatcccatcgaaccttttttccagcttcctgacttctgcgagatacttggataactcggggctagagcacttgtaatctttatgcacctggttcgcgactagttcggaatcccctttcacgatcagtagcctgactccgagtgcagctgcagcacttatcccggcgattagtccttcgtactctgctgtgttattagtcgccctgaagttgaggtgaattgcatgcttgaattgatctcccagaggtgatgtcaagatgaatcttgcccctgctccttggctgttgagtgcgccgtcgaacgctattgtccacgttttgttgtcgatttggttgtctgacctgttatcaggcatagtccaatcggctacgaagtcggcaagtacctgggacttgatggttgttcgtggcacaaatcggacatcaaactggcttagctcgactacccatttcgcaatgcggccgacaacgtctatgtttctcactacttcaccgagagggaaggaggatacaactgtgaccctgtgggcttgaaagtagtggcgtagctttcttgatgtcatgattaccgcgtaaagcagtttttggatctgtggatatcttgtctttgcgtcgtggagagcttcgctgacatagtagactggtcgttgcaccttctctctctcgacaacaatgacagtgctaacggaatatggcgtggcggcaatatagagaaataattcttcattaggttgggggcaacaagtacaggtggatttgataggtagcgcttgagtgcaatgaatgcctcttcggcttcctgtgtccatacaaatttgtcttgctttttcagtagaacgaagaaaggttgtcctcgctctcccatcctagcgacgaacctgcttagtgccgccatgcatccggttagcttctgtacttccttgagtcttgtaggcgacttcatgttctcgattgccttgatcttctcgggatttgcttctattcctctgccagagacggggaagccgagtagcttgcccgatggtactccgaacgtgcacttcattggattgagcatgaggcgatatcatcggaggttgtcaaacgtttcccgcagatcgtcaattaatgagtcgcttgtcttggtcttgacaacaatgttgtcgacgtaggcctcgacattgtttccgagttggtcgctaagtgcgccctggaccgtgcgctggaaagtgtttcctgcggttattagtccgaacggcatcttaacgtagcagaataccccgaacggcgtgatgaatgttgtcttctcctcgtcctcttttgccatgctgatttggtggtagccggagtaagcgttgaggaagctcaacaactcacaaccggctgttgagtccaccagttggtctatccgaggaagagggaagtgattcttgggacacgccttgttgaggtcggtgaaatcgacacacattctccatttcccgttggccttccgcaccatgactgggttggctagccactctggatggagtacctctttgatgaaaccagctttgagaagcttgtcgagctcttctcgtatggcttgttttcgatctggtgcaaatctccgcagtttttgctttactggcttggcgtcgggtcgcaccatgagtttgtgctcaatcacctccctgggtacccccggcatgtcggacggctgccaagcgaacacgtcagcattgtcgcggaggaaggtgatgagcgcgagttcctatttctcgcctagtgatgccccaatcttgacggtcttgtcagggttggcactggagagtggaacgatcttgattgcgccgtccggtttcggcgtcttgtttgttttgctcagtttcttgggtggctcggctgtgtcgggtgggctgggcgtgtgctcgaccatgtcgacgctccgcttgtcgcattgcactaccagcttagcattcccttgaatagtgattgttcccttcggtcccagcatcttgagcacttgatacgcgtagtgagatgcggccattaacttcgcgagtgcagttctcccaatgatggcattgtatgctgtatcgaattcagcgacatcaaaggtgatctgttccgttcggaagttatttgcttggccaaaagtcacaggcaacgtaattttgcccaatggtttagacgatgactgaggagtgattccatagaagggttgatcggtgggtatcaactcgctttgtgggatccccatcgcgtccaaggtgctagcgaagagaaggttgattgagctaccgccgtcgatcagaactcgtgcgaccttgatattccgaaaagtgggttcgaccacgatcggatatcgccctgggatgacagcagtcttggggtggtcctcttctgagaattctatcttctgctcagaccacttcatcttgggcgcagccccctgccacgtcgaacagacttcacgttccaccttcttgtattctcgctttgagtatgccgcggaacctccgaagatgtgcgagacatggagatctgagtttgggtatgctgagtccgattcctgagtagccgcctcagcgtccttctcgaccacacgtactcgcttgcctttttccaatgccatgtgttttgcgagcgactttttgaagacgaggcaatcttctagagagtgtatgtctgacttgtgtatagggcaccatgttttcttcatgtcgctgccttgtgggtctgggcgcttgggagagtccgcgtattctgttgcgagaacatccgcttgagctttccttttcccactcttgcgatttttcttcttgctcgactcaggtgcgtctttgactggtttcttctctcctccggtcttcgaattgtcgttcttgtgtctcagtgcgtcgtccacgtgagcgcatcgatcgacaatttcgaataatctccgagtagtcgtgatgcgcctcgttgccaatgcctgggtagtatagcgatctctgacaccggacttgaaggcgcggattacataagcgtcggtgatctcggggattgtattcctgcactcattaaagcgccgaacataatccctcaaggattcatccgggttctgtgtcaacgcatgtaggtcgtcttcgatcgcgtggcgcttgtaagttccttggaagttggcgacgaactgctgtcacaggtttgcccacgaagaaatcgagtaggggggagatgcatcagccatgaacgcgcagagcctttcaatgcggttggcaaataattcgccaacacgttgtcgtccgctccggcagcgtagagtaccgtggagtaaacctgaaggaattcttctgggtcagtactcccattgtatttctctattgctcctggtcggaatctttcaggccatcggacatctcgaagtgaacgaccgaaagctctacacctagcgttgggggcggtgggttgtcggcgatcgtacgtccttcgtggatgtctatctgatgatgaggatgaggaagatgacgacgatgacgatgggtcgcttggttccggcatacgattacgaggacgtcggccgggttctcgagaatcctgtcgtcgtctcccgttgttatctcggcgtcgatctccatcatcatcgtcattatggcgacgtcctagaccagtatcgcccggcacccgccgttcgcgatcgtcgtgatcgtggcggttgtggcggttatcacggtctcggtcttcgctcgaacggcctcctcgttcttcgttatcgtgacgccgtgaagagacgcgatgtcgggaacggttctcattgtctcgtgtgtgtcgcgcctctcggcggccattcgggtgatcgcggagatcgccggtgccacgaggtggaggggtggctcgatgaggcgattcccgctgttcagggttttcaccatttgcatcgccagttggtggctgttccgggtgcgctgcagcagcggcctcttcgaacgcgttgctgaggttggtcactgattcctgtaaccgttctgtccatcgtgcgagatcgtcgttcagaacgggatcgtagggggtttccctcagtattgcgttgacggccctgatgtgctgggtcggtgtagtcacttgattctccgcttccgcattggcgcacgctgacgtgccggtctcgtcgatagccagtacctcgcacggcgtactcgttgacgatgagccatagtcttcgagcaggtgcaagactgatggttcgtgaggatcgatgtcgattaccccaacaaatcgatctgaaatcggcgtcgctccttgttccttgtcctcatccctgagggggatgtgtgactgctggaccttaggaggtgacgttttcatggcgctgagaaaggccttgcagcttgagaggtcgtgattctttgtcttgtgaataggacaatagacatcacgagttggagaagtacgctgaattccacgctctttgcagtcacgaatttcagcgtggatgttgagaaaaacccagcaggcttgcaaggtatgttttttagttttgtggataggacaccaggaccttgtcacctcggaagtcatcctcgtcggctcgtgattcttgtcgaaaagacaaggtttggccgcactaggatccttctcgggctcggatgtcgtcgacgttccgatctccgcttcggcgggaggatccttcgacatggagtcgtcctgggttgcagccactgcgttctcgtttccagccattgatagaccagccgagattggcaccgtggtataaaccgggaagactatttcgccgacttgtgtccacaccagcattgttgaagtaggaactccttggttaaggttggtgttggcgctgttgtcgacgaagttggatgacatagtagtagaaccttgagcaccaagtccccctacctggcgcgccactgtcgacaggggatacccgtagaccggatatagagggtattggggtacgctggtacgaggatctacgtaatacgacatcgagttggtagaaaacaaagattatactggttcaggccccttgataggtaatagccctaatccagttgatatgggattatatgatggaaaccacatgttacaaagggaatagcggaactcgacgataccgacgagatcgtagtcgagttgattcgactagatcacccggcgacttggctcctgtaggctccggcttcgtaggttgtggtggatgtgttggcggtaagattcgatgccttaggtcctcccggggggtcccttttataccgcaggtcaactggtctccaagtaggacccggagacatcggacccagtacgatacaatgacgacccaattctatccgagtaggactccttccgtctgtgaactccataatgaatttccttaacgtatgccgaaaacgtccgtatacacgcaagtataccatatcgatatgtaacgtatatcgaagggtggagggtataccttacccgtaaccctgacacacgcccttgccacttgaataaagatttttcgatttatttgttgaattatttttttccttctagctttcgagaggggattgtctacagttttttcctacctctttgaaaaaaaattgggtttacttttttttatatatttcatgaaaaagttgactctaaaaaaatctaatccagtttgaatttttttaaatgattttaaaaccgagcggcttgtgtcctccagccagtccgaaagaccgagaattttttttttcgattttgtaaaccctggtcatagctacttcaaggacgtgtctacaacgagaccgttctttgtatggtcataaccagctatctcaatctcatatctaattgctactagtatactcaaaagtgcatgtatttttttcttcttatggaattttctcttagattacccatccgatttacgatccgattacactattgtgttcataacaattaaatctttataacaagatctcacatcactatatttttatgaaaaaatagaaatcaattttataatatatctaaattacttttagattccattaaattacttcttagtcataaaagtaatttaataaagcttgatagtaatttacctatattatagaagtaacttaaaacaaaagtgaagtaacttgttacggcattaaaagaaatcttacattcatgttgtgagttgtttattttataatcatgtttagtcaatgatgtaatttgtgctgattaaatttaatttttatatagactcatgtttttacctccataacggatttacttttaatgtcgtgataaggttactttctttttgttctaagttacttctataatatatgtaaattacttttaggctttattgaatttacttttatgggtctaagaagtaatttagtgaaatctaaaagtaatttagatatattataaaagtaatttctaatttttcatcaaaatataatcatgtgagatcttgttataaagattcaattcttacgaacacaccggtgtaatcggatcgtagatcggatgattagtttaagataaaatcatttttcaagccggcgtagcgtagagcatcacatggcttccaatttggattcctctggatgatgccacgtccgtgaatcaccaggccatgtacagacgcaccagcgcttgtgggatcagacagccgatgagcgtgtcgcgtgataaggcaaaacagagagcgtgcgcgaattagatttcgccctacttcaatcatgtgatctttgatgaagttatagggattcttgtttgccgggttgtcaatgattcaattgatagcacctacttacagcgcggatcgtcaattttattattgtgccggcttgtatatttgtcaaaaggagcaaagatggtatccgatgctcgttcaaatagttttgtgcgtgtggggagctcagtattgtggttgtgctcgcctgctcacaaaaataaagtatctttgttcttggttgacatgtttaacgttctttctgcaacaataagattgtatgggtctcttaactctccgttggttatacccaacaacggtatttgtagagtattattatcgttagtaccagggtatatgtgatgagataaaagagccagtggacaaagatttatcttttatacagcttcgagtctcctatttacgaataatagctccactcctatactgaaaccggtgttgccattatatactaccaccgtttcatattataaatttttttgacttttttattgattaaactttttaggtttgactaagtttataaaaaatattataaaactatattaaatattagttttaatgaaactaattcagtgttgtagatattgctaatttttttctacaaatttgataaaacttacagaagtttgacttaaaaaatcaaaactacttataatataaaacggagggagtatcaacatcacactagtacaatatacaggatgggctaatctagtctctatcagcctagagacgcaaagctctcatatttggttgacagctagaggttaaggtagtcaactttcttgaataagaactcagtgatattggaagtagctctagattccttttatcggtttttatgactccgtattgaggttatatagttttgtgttgatctgtattgggttgccttggattgtcccctctttttctttgtgtcttgtatttttatcttcggatgttcccttgtccaaatataactagggaaccatgtatggatacgattcgagtaaccttgtagtgtctaagttagactctgtttctctttacttatccggaacgattttattccatataagatttggtatatggtgagttccaccaatgttaatacataaatatttccaatatcctatatccatgacactagcatgcgtttggtttaagggttgggatgggttgggttgggttgaacgtatttttcggtgtgtttggtttgagcacaggcgagatagatggtccctaacagagaatattcccataggatctatattgggatagtccataaaaaaactggctgaccaatccaacccacttttttctatcgctgtctcgctgatctgtgagttattcctttaaaagtaggatcatctgatcccttatgctaaatagatagatcggatcatcccatcctaaaaacacggatgagtccaaaccatatcaccttgtttccaaaccaaacacatgctaacagtaaacagtctcttatatagttatatttaatattatcatccatgtttctaaaaaaataatgccaagcaatacataggccggaaatatactcgatctgcaatcaaggaacaaaattggctctaatctctctcgccattttactacgagaaatggttgctacatgtaacatgtaccgggtaaaacggcggggacaaattaaacatctcccgttacagagtcctgtgtgggactagttccaaaggacgactacaacgaggacaaatcacaaaaccaacgaaatccaacaagtagtctacaaggattggtccctagctcgcactaaattccgcaccgccgggaaggtaacccacagtcatacaccgccgtgagactgtgccgtactggtccagaagatcacaaaacttcacatgcacttcgatctatctgctacagggaattgcagcttgtagcattgcgattttcaagctgatcttgtactgatgtactgaactctagctctgaatttttctagtctttcctccagttctccacccgattcggggaggcatatggcacgggccagcgagcagcgcaattacggtacagaaacccacctccattgatcatgacatggccgcgtttcttgttgcacatctcgttttctagttacgtcctcgtcaaaatgatggaaatgagcaactggtcgtggctgtctctccgttacggtgtacttaaatatataattaccgttcaatcaatcacttgtaattatagctgcaccatatcgtcctgtgcattgcgtgtttgtgttcacagcgtggccatcatcaatcatcataattaattcatgagtaagagaatgatggtgccagcgaaaatagttttctttaaacaaccctcataaaaattatactataactgtaagcttatagctaaaaaaacaaaaagacaaccacacgacacatctatgattagaaccctctactgaaaacagagggacacgacatctcaaagagaatggatctctacataacgtcttcaagaagaatatgacacttgagattatcgttgctgctcaccccgagacctaggacatggttttcactctaagaaatccatcagggagggtaggaaaaatcaaacaacaacaccccaagagaaaacgatgcccacaagcgtggccgttgcccacacaaagaagtcgggttttcgcctgttatttttctgccaacccttaccgaggtctcctcctggaaaaagaagccatcaccaactgtaaacctttcaacaagtagccccgcgctagcgcctccccaccagtcgcccatcaagtaggagttctaacatctgacgcgctccaaaaccatccatgtagttgagctaaacgagagggtgagagataagaacggatcccctctacccaacactagcccgccaacgtgtccatcttgtggcggcaaggcgccaccgcaagacgactagtgtgtagatcggagcccatggcaggactacacgcccacatcagggcaccatcgttgccgccacctcggctggactgcccactctcaatccacccgtctgcattgctatcgccttatcaagttgctccttgtcgccgccaacactgcctgccacgagccgtgacctctttttcccccggtcgcgccttgccgctccgatcccaccactatcaccatgttggagtcacatcacatctgcttgcgccgtgccagcctcctgccatcatcggctgtgccagccctcccgcgccacgctgtcgtttgccccgtagtgttaattgcagcccccgctaaattcgacgtctgtgagaggggggaatccagttgcgggggactagatccggtggagttagcgtcgaatccgttgccgcgctcaccgaggtgtgtagccgctgccggtttcgctcttttcccccacgccggagaccgagcctagctgggttttggccccaccatcgccttctcagcatgtcactcggcttttctagtagtgtgctccgacggcgacgtggcggagagggaaggagcgggcggcagctaggatttcgcccagtgttgcctgcacgtggacgatgcgggaagtgctcacaccaacgaaaataattgagtagatttcacaaaactatagatgttttgatccaactactataaaattacatatttaaaatattgtattgtaaaactacatgtttgatagtagatttgatgcatgctaattttttatacatcgatttagatttttaattttgtagcaaattactcaaagtatatatagttttaaaacttttataatccaacagtgcgcttaattagcatcgaatcgaacaggccatgattgttctaaaggaaaacccagcagtccattatgcgtgccagatcaagattgaggtagtgcaagtgtagaatatgcatgtgagtatctgtatacatgttaactagtggtctaacaattgaaaaagacgtatgtgtaccaattaaatggggggcaagatcgatcatgcataattaagctctctccggcatggattaatcaatggcacaatcattagtggcatgtcctagtaccaagccaccaaaattagttggaagctgcgtctagactactctagtgtttagcttgtttcatgtccaaccggccaaaagggacaatttggagccaacatatcatagtaccttaataagttttttcttttccgacaaataaattggcccaaattaatttgttgatcaatcaacatctctgttgtgaagaactagcactagtgtctatatcaaattatcaattcatgcggattttgatggaacaattaatagtgcaggctttttgaaaaaaaacaattcttttttatagtagcctaatattcctaggattgttttttaagagccgggttacccatggtgagctgtttcgtagttagtgaccaaaatcagaccaggaacatatatagccgagaaaacaaatgcagacctatcacttatactattattttgccttttccaaacctcaacggttgcaagtagcgatttaagtcatatgaaattgcagcttcttacaaaatcttctgttaccttaaatagtttagatttttcacctaaaattctgagtatacgtaattgtggaatctagaaaataaataagaaatcagaaggtaagaaacccagttttttcaaattatcagtatctactaattataagttgttccttagaatcttaattaagttcccaaaatggccttgattctgttttgcatcatcccgattccgatccattcaacgttcaacgggaaaacatttagtacgtttcgtgtgacagcgtgtcaagtaaacaccagccttgttagagcaagtctaataagtagacgattagccagcagatgatgtctcgagctgacgtggaagagaaaaagcgatgtgagagaaggaagccggcgcttctgcagccgcccgctaggcacgagcgcctagacgtgctgacagtttggacccatatcaagagaaagaaggtatttgacatgtcggtcccaccaaacatataaaaatacttatttatttgtagtagagtatgtgtacagagcatgctattatatgcactggctataacatcttgcataagcccatagcaggctcctctattatccctgctcttatactacagtactaattaatcagctagcagtagatgacagtagctagacaggattcgcaagtaagagatctatctcgagacaatggagcctcgaggaaataattggccgctccatgccatgatcgcggccggccggcgccggcgctataacgcgcatgccagggtagttggaagaaccccctggccggcataactgccagctgaataacttggcagcgcgcgatcgagggcccctcccaaatctcccatggttccatccatccccatcgagtgggtaaccggcctagctatacgtagtaggagtcagtagtaccccgacgacgacaaccacacgcgcgacgcatgcacgcacgctcccccgccttgtcagtgagacgtcgcgcgcggtggtaacaaaccgcgccaagccgaggggtatcgtgttgtcgcgcacggcagctcgcgcaccgtgcgatccaggaattaaacgcgccgccttttccctctcggtttctctccccggccgatcgaatcaccgaactgccccgtcccgtacgtacgtgcatgcgcgttgcgttgacgtggtctatataaggtcgccgcggcgtcaccaacttcccacacacatcagcatccatcgcagcgagcgaccgtcggcatcacaagccatctccctctctcttgtcttgtgatctagctcccgtcgcgatcattgtgatataggcatggccaggtcatcgtcgtcgctgctcgtcctcacggtcctggtggtggccgcggcggcgtgctccactacggcggcggcgcgcagcgtcccggcggaggagaagaagacggctgcgccggtggcggcggcggacgtgaagcagccggagacgttccacgaggggacggtgttgatccctgggctcgggcggttcgagctcggcagcacctacgtgccggacatcaccggagtcgaccacagcgtcccggcagccgagcacgggcagttcctccccggcgccgacgacacatgggtccccaaccccggcttcgaggtgcccaaccccttccagcccggctcgtcttctccctgaatcacccgccggctcgccgtcgtcgccgagctagctagctaggcggcggtttgccggagtaataatgtgtgtgatcccacgtgtccccgtcggtgcacggctgccgtagtggagtcgtttagtttttcaattgtgtgtggatgcgtaggatgcattcagatgtttggcttgatcgatcgcgtgcttttgttagctttgaactcgtaataatgtattaattggtgagtgattatgcaagagctcggtaaagtaattactgttcacgtactaaattaagatgcaattggaagctatacgtctgtgtgtattcatcgtgcaggcaggacggtatatccaaaacactgtgcaagtgtgcattggaggcaggaccatgcaagtacagaatgaaggcagctaggctacgtaccgcatactccatgttgtactcatcggacggtccgtcatcggatcggacgccttttcaccggcttaatttcttcgcaattttgctatatatttgtcgacaaattttcccctaaaaatttgacagatgtaattacagtacaaccgtaatgtaattacactgtaatttgcatgtaattacactgtaactataatataacttgtatgtaactttcaaaaaatctctccataacatattattttggtaaaataaaggttgtgggaacaattttttttcagatatgtgtgtactgtgattttttttcttcctcaccaaaacaaatctttataatagatctaataatttaaaattacgtgaaacttacataaaagttacactgtagttacatgcaagttacagtgtaattacatacaagttacagtgtaattacattacgattatactgtaattacatctgtcaaatttttaggagaaaatttgtcgacaaatgtataggtggtccccttcttcgagttgaaaaggagtaaagagagtagatggcccatgagagctgaggcccatgacagcaggattcgccggtacaaacaaaagggttggtatgtgggccatacggctcaggttttcggtaaacttagcggtccaaagaatgactctggtgaaaagtgatattttgataggatggcaatattaccaaaattttaatatgatttattatgtgtttatcaaagtttagcaaaaaaacctaaatgaaggcacatttttagcaactttgaaaaaaaaatggtatggttgaaaatatcatcaatctgaacagcccctaaattttggttccaaatttgttttgaaaaaaagttaaattggctccaattcaaaccaagacccctatattggaagtttataagcagctcatcttagagcctccagctctcctcatacagcctacattcttattcagattttaaggattgtattatatatttatatatatttatatatatatattctcccaacttctattctctcgtttttcatgcacatattatttataatgtgtattttacaaataattttataggaaaattgctttaaaaatcatattaatgtatttttcaatttttttactataaattcttactaacactaattcgtcgtgctatgagtatctagattttttttataactttcatctatctaaatcaaacagttgagaagatttgtcagtaaaagtttagtttgaaaattttagtccgtgtaacagtgctctcttttcagaaagcccaacattgtcgataatttcgctatcgcattaacgggcctgttagaccggaggcacgagcagttccacccaaccccaaaaccgaaacgccgaacgaaacgaatcgtaaactcccctgctgctacgcaacgactccccaactctccggccaccaccaccaccacctgttccccatccgcacgccacgcaccggcccaaccgattccccaccatgccggacggcgagcggcatgaggaggccccggatgtgaacttctggggcgagcagccggcgacggaggctgagtactacgcggcgcacggcgcggatggcgagtcgtcctacttcaccccgccgggcgggcgccgcctcttcacgcgggcgtggcggccccgtggcgacggcgcgccgcgggcgctcgtgttcatggtgcacggctacggcaacgacatcagctggacgttccagtccacggccgtcttcctcgcccgctccggcttcgcctgcttcgccgccgacctccccggccatggccgctcccacggcctccgcgcgttcgtccccgacctcgattccgccatcgccgacctgctcgccttcttccgctccgtccggcggcgggaggagcacgccgggctgccgtgcttcctgttcggggagtccatgggcggggccatctgcctcctcatccacctccgcacgccgccggaggagtgggccggcgccgtgctggtggcgcccatgtgcaagatctccgaccggatccgcccgccatggccgctgccgcagatcctcaccttcgtcgcccgcttcgcgcccacgctcgccatcgtccccaccgccgacctcatcgagaagtccgtcaaggtgccggccaagcgcctcatcgccgcgcgcaaccccatgcgctatagcggccggccgaggctcggcaccgtcgtcgagctgctgcgcgccaccgacgagctcggcgcccgcctcggcgaagtcaccgtcccgttcctcgtcgtgcacggcagcgccgacgaggtgaccgacccggacatcagccgcgcgctgtacgacgccgccgccagcaaggacaagaccatcaagatatacgacgggatgatgcactccatgctcttcggggagcctgacgagaacatcgagcgcgtccgcgctgacattctcgcgtggctcaacgagagatgcacgccgagggaggagggcagcttcctgacaatacaagattagtatccaggattcactccactctattcagattattgtgaagtagcaaatgcacaaaaagaatgattaaatgtgcaaatttgcagtgattctatatataaatttgatgaacatttgcagtgattctatatataaatttgatgaactgctcagtcaggtttacatgatttatggtataaaatatgctaagtctcctgaccaatgaaagaatgtttccagtttgcgaagcttgccgttgtatcagctctctgccggcgcttctggaggcagtacaaggcgctctctaccttgtacaagcttggcagaacgaattatatctccagttttaatctgcgacagaacttctcttccatctgtggtatacctgcagatgtttgatcgacacagttctctgttgttaatccacaaaataaaccaagtttgctgtctagtggtcacagttctgtaatggcaatcactacttacccgaatactgagaattgcccttcatcaaaagatattcctcctaaaccagactgcacaagataaaggaaaataatcacaaattaaaatatttacgcaattagttcttatacatagggcacgctatgggtctagaaaagcagaagcattcagaaatatggttcacaacacaagaggtagacgggtgcactgttgaggtacatgcacttatgcaatctgaatttaaaatactgtgctagcgaatatgtctagttctaaagatatatccatttactcacatttctcttgtcatacagatagaagaagaattggcttggtgacgagtattcatcagaatccacactatgggccatagcaacggcaccatatacagacatcggaaggactggcaattctccatcctgtattggatcaagtaacaaaggaactgggttatgacttacgaaagacggtaactctcagatttcactggcatttacagggtagtccagatgagtgggctttctttaatatcctttttacatacacttccagtttgaactaaatcgtaaggattttgattgatgatttagatccaaataccccttcagaacagacctaacagtgtggaatactgacctgaatacttagcggagttctgtataacggttcaaactgcccagcaggcatgacctctaatggaacagtgtaacctttctttccattctcgttgtctgcaataattgcctgacttgcacatttcagttttatcccatcatatgccccatccaacacctgaagaaaagttcatttcattggatcagatgatgtaacctaactactgaaaagaaaatcaagagctagtaaaggaaatttttttagcacatcgcagaaacatgaaatcttaaattgatgttctcgaagatgttatgtcgatgaacacaatcatttcgatgatctttatcatatatgtcagaaggcagagctattggcaggaaataatcaatagtgagatgaggttggagttaagctaccttaccaatttcgcaaagtttccagcagtcagtggggcagaatatccatcaatcactacctggaaattagtaaagaaatcaatagctgacacgtggaattttataactgcaactgtatacagaaccatactcttgcacaccatggtatgacaaaagataacaaccaaggataaggttcttatttctcaatgtcaaaagactgcagtttatgataccagacaattacacagccattcaaagccacctgaattgtagcaacactttttggttcaccaccagcagttggaaagaatgttgaaccatcacctttctccactgagaattcaacaactcctcttcctgctagcctattaaaagcgagctgtttaaattaaatgtacaaatgaacatttcgttacagactggaggaatgattgcatgcttaatataagtgccacagggatggaatgttcaaagcaccattacacttagggcctgtttgggatgggagggacttattttagtccccctcccatccaaacaccaccttacataatctgctaatcagctacacatactgagtgtattgcttgtcagcgatccccctgggattgaaggaacactcacaagaacaaagaacagagacgcgaatgaatttggcgctgcgcaatctcactgtagcttttctcagttttctccactgttgtttatacggattacaggaggcccaaagtagtttccattgaggccttcatgcacatgacacgttccaccgtgtcgtgtgccatcccacatgatcagaatgtgccgggcgcgacaaggacacgactcgctctggcgcaaaagtgcgcacctaaaatggacaacttggacaacaacctgggcccatacttcaccgaccccaaagacccaaaacagaagaaaaacaggggacctaaaggacgactaagtaaactaaaaacatgcgctcaaatttaccgacattgctgctgaagcgatcagccaatcagaacccaagaaaaattcaccattcctcaagagttcgaaaagaaaaatgcttgtgaggttttcttgccaccctgtaccaatctggccttaatgattttataatactatgtgatgatatatgttataaataaaaataagttcccacttggaattaactagaaagtactttttattcgacagtttctactccatgaaatatatgaagggtgacaccagcaataaatagtgagtttgcaaatatgataaaatggcaagtttgtcaaaaccaattaatttgcaacaatggaaaaactggtaagttttctattgaattcattttgaaaacctactaatagcggcagctttgattattaccatcaagaacttgggggcagagacctggttatcttaaaacttatactgacatagagcttatacttgtttgcaggacatagaaccatgcatgtcagtaactcagtataatcaaatgtcaccttcaatcttcggacctatctctgcccttccctcacaataattctagagacaaagaaacatttagattttaagctttggagagatcaacaaaagttaccttggatattccaaatattgttgtggtaagaggaaggataaacctggagcctgttgaaagaaatttccccctttaagtaatccgatcatcgccggagtataatcatcctcctttaaacataatgaaacttctattcagtttagtacagttacctgtaacagctccaattcagcaacagtatcaagagaagaagcaagtgcaaccgaaagtctgtcaggatcattttcctttatatatttcaagagagtttgcaaaccaccctgcagttgattccaaagtagctcaggtataatttataaataagtacaagtgaaaaccagaatttgatctgtttcataaactgcaattcaccatgagcacatcctagaacctactgaccttctcttcaagcaaggaggtatataacttcgagcccttttccttgagttctacaggtatacttgccaagatcgcatccttgttgtccattgctatctgcatccagagcgcatttgttctatatatcagcattcaggacaacagctcagcaagttcaataagaagttcacaatgcatagaagaagcaaaacattgttgctagaaaaatgcttatgaagaagacacagagtcaacttattaccttcatggccttttttacgtctccttccatggagccatacggcttcctctgcggtatcctcagcaaatacgaaatgtcctccagcgattcctggcaaatgggctcgcacaatctaagaacaacgcccagccaaccgtactaagcgatatgcatcgccgccgattctgatgcagtttacctgtatggtcttcatgtttgggttcgcggggatggccctcctcagcgccagctcccccgtcctcggcacgttcgtgtccggcgagtagaggatcgcgtccgccgggagcgacacggaaatctgggcgatgacggcgagcgccgcgaccgcgcccttgagcagctccaccactcctccctcctgcaccaaaccagacaaccacacgattaaactgaagcgaacgctacagctttggaagccatttggatgaggagagaccagcaaccagcgcgtgctcacctcagccgcgcaggagggatggtccgagcgacggtgggaggagcaggagaccctcccgcgaatgccgccgtcgcagcacctggcgccggctgcgaccaggggacggccgggaaacacaggaagggcaccggcgagcaccatcgcggccgccgctcgcgacgccatggcgtgcggtggattggtgcgggagcgcgggtgcttttgaatggatttccggtgggttgagacgcggggaggggaggaaccggagatgggggtggtggtggggatgccgttgctgccgtcgccgtcgtcgtcgtcatcgtcatcgtcgtggtcgccgtctcgtctatccccagccagtgagctgtgatccggttccgaaccgcctagttttgggccagcggtgaacggcccagggacgatacaagagcccaaagcccaatactgtcccgtaaagagacaaggctgaaatgccttttgcggccctgttacgtcaacgaggcctgagatggtaataggactgcattaatcacaggttttcagactctatcccaaaagaaagcacacacacatatactgccatacccagattcagtgtactttccactaaaaaatcgaagtgtattttttctcttaaaaaagactcacggtgtaaatgcttaatgatcggcaggtgatgtagtcacaatcatccctctcttaaataatattactgctaggtgctgtagctaaattaaagactgaaataactcagaccacggaagtagctggagagatctattgacatgcacgcatgtcatgatcaccgcacgagcgtacagccgcaacccgcagacatgccatcatcccgcaatcctattccaaccagcatccgagcagcccacccggcaccgcacgctcacgtacgcgacacggtcacgttcgcgccacgctggacgccgccgccggcccgccgccacatccccgagccccagaccaagtgccaacacctcacaccgctccgctcccgcaccgcacggccccaaagaaaccgtttccatcaaaccgccttgcggttgcagctgccacctcgccttgccggcttgcccccacccgcccctctgtccaccgcgccgtctcgccgaggttgctcacgtagcgcgcgctttgctagtactagtatcgaccataacttgcgtaaaatccaggacggtttcatcagtcacactaccacccacggaccacagtagtattcggcgcacgctagctatgacctcgcgcgcattgacagcgtcgtcgttggggtatgctgcgtgtgttaggtgctctcgacagcgcgggattcatggagcggtggcgctgatcggggcacgaggggtgctccccgtcctgcatgccgcctcccttaaactactagtactactactgctcgatcggcacgagcggtttttttcattcggatgatgacgacgacttcagtttcttctcgttgataggttaagttagatcaacgcgacctgattattgttttggccgcgcagcgctataagaatggtggtggcaccgtaccactcgagggaagttagcttgcacgcaaagatacgtttaagatggcacgaagctagcgtactagtagtgactgtagtagtacttactgtttcaataattgttttggataagtactaatgtagtggtagctcgtatgtgaatagtttagtagcaagattagtacgctgtgattgcgttcggtgaacgaggacggccaatgcaaagggcactaacatttgtcttgacaacgaataggtggcccatcattgattgctttgttgacctcgatcatccggaaccgtgctatgtcgtgacggtaacaagcagaaacggacaaaagctcttagctgatatgctacctagcttcctcgagccctgcctccgtccgagctccagctgttacgacttgcgagtactccgaacaaggcatgtgtttgttgggactatggggttgattggttggcatactcacattactaaaacttgctatacttcatttagctaatatgtctaacatgtggccaataaaattaaagccacacttcagtcataggagaataaacttgccacacttttatatgccaatgatatgtgggacccacatcatggtgaatgaatcttgctaaacgtatggcaccaaccaaatgaatgactaattcaaacatggctaacttgagttgtggcatgatgaggcaaattgtggtagtgaaccaaacaaccccatatatattctagtctcttttaaactacagtattcaggagcaacgaggaagagtacttctcggtaggaacggccgtatctatactttctgtttactactctctccatttctagatgtaggtaaccattttcggtgtaaatgagcacaagatcgaggaaatagcccatatctgttagaacgtactcgtactgtacaataatagaaataagcaatgctgtagtactgtgtaaggggg

SEQ ID NO: 70866 - DNA, 827 bp, Oryza sativa
aataatatagccaactactatctccaattcatctatagtcaatataatagctcattcatacaatagttacatactacactattaatacttggtctcacctgtcatactcacactgtgtcttggagtccgtgctgcagctggctacaaatctgtagcctgctacccttctctctctacatttatctacttaaaatatgtttgcagctggcttagggcacccacaatagttatctataagctctctacaaaagatccatgtcagcatatttttctacttggaagagattaaatgaagcgagagagcaaagctatctactaacatggagatagtctatagagaaaaacgaggcaatggattagagagctatagatacccatgtagatatactattgaaatggtttactattaatctagtctattgctgagatgtacatattttatagatagcaccttactttactattgcgggtgctcttatagcctgctattgtacctgctctaagagatagaaatgatgttgactaaatggtcaaatgtaatgcgaatccgtgacacgagtttgaccatttggtttcctgggcaggaatgaaatggaaatactgggtgctaatcagttggcataataatccagagagttgcacgatggagcattcgttagtgttaggtacactaaaatttcagatatagctaccaaatttcctgtgttgaccattgacaattttccagacctatttgaccattgactagtaataacatgtactagtagtaagtactttcagcccagtgggttgggccggaaggtaccgagctcgaattcgccctatag

SEQ ID NO: 70867 - DNA, 1262 bp, Oryza sativa
ttttaaattcaccactcaaatttaccttgggtttttaagcaaaaaaaaaaactttactgccactaccgtgatacttcctgcatcccaaaatatacatatttctagcacagtacattatttcaaaatgaaactatttcttcacatacgttctcctctcaaccaatcatcactattctcctttacctacttttacttatcaaccaatcacacatttcctccgattattctcacctattttttattaataaccgtaccaacctaaaaaaaatgtctacattttgggataagggaaacaatttggcaaaaagatctatgagcactcatctgtaaaaataaataattcattagggtgtaatttgtaaattgtcttgagtctttacgaacaaatccctatcctgcataccgccatcgtctctttctcgtcgtcgccggcgacgcctcccgccgccgccgaggatgccagtgagggtggtcgacaccgcaaccccatcctcccagcccacctcaggttcgtccacctccttccccactaccttctctatgctatgcacccacccctaattttgctgtgtaatccaagctttagatctgatcatctgatagagtctaatcaggtatcaggtagcttgtggggtttgatatagtgcgattttaaggtttaatctagattggtctgagttgtactgagggtatctgtgttgatccttttggaatatactcaattttttataattttggccactcacgctatgcgttatttggggagagctcggatggttttgtagctaagctgacaactaattgtaatgtattgtatatttttgaggcgttgctatgcttgtggctttgtgtcaagtgttcttctgtttcaggaggccttctatataaaccaattgttgattttgttcacctgcaattgaaatttcattagttattttgtatgtatttctggaaatagatagcccgccgtgccaatgtgccatactgattaaaatgctgcaggtcaagatgcaaatgctgggcatccgtctcctcctagctgttccctcttaagtgctggaagagtaagtctttttgtgctgttatttggaacttgaccaaggatcgaatcttcttatcggtgttgtttatggaactgaccagaccatatgcttgtaccattctttcagtgttatgctggaacccagaatgtctctactatacaaaaagaagaagcttggaaagttaatgtgcggggtaccgagctcgaattcgccctatag

SEQ ID NO: 70868 - DNA, 638 bp, Oryza sativa
ccgacctactcagtctacgtgctacatatgttacttgttaatataaacttatttatatatgtatatggaaatactttgtatattgactgtgtgtgtattggtggtaaacacgtactgcagctgcaaggccatgcacgcggcggtcaaggagcgcgacgtcgggaaacgtgtgcgctggagaggctagataacatgaagtgggtggagaacgagcgctacctcgtcgccgcggacaacccggacacttgcttcatcatcggtgtcacgctcgtcttcgcacagcaggacatggcccagggccttttcctccttgacaaggctgccaccgcgggccacaagacagcggcctacgtgctcggcctcctcctctacaagtttacttattcacttaagtcttagactgcgttccttctactagttcccaacctctctttctcgttttccgcgcgcatgttttttaaacttctaaacaatacgtttttttaaaaaagtttatatatgaaagttgcttaaaattaatattgattcatttttgaaaaaaaaaacttaattaatcacgcgttaatagaacgctccgtttttcatgtataggagatttgttcccaacctcccacaatgaacacagccttagtctatat

SEQ ID NO: 70869 - DNA, 910 bp, Oryza sativa
attttggtaagattctttagtgaattcagttaaggaaaaagcacaaccagtcgacggaaacttatccaaaagagacatagtttaagaaggaaccttgaaaactttggcatgacggtttaaattctatctattaattagacaagatttagtaatttccttttatctttaggaaatgtttatttagtgtccgatcatgacttgtatctttccttttatctttaggaaatatgtgtcatgtccgatatggactagtatctacccatggtataaatatgtacaccgatggtctttgtaatctatctcttgatcaatacaactactctcgacgtatcgccaccctcttttccgaggtttttacttatcaaccggcagaacttggcacgtgacgcgtgttgcatcggctttcgatctctggcgagggggtaagtcctacgttccgccggccctggcaattgtatcggctacattggtgttgttcaaggctgtattgtttcgacctcttagattgctctagtttggttgatatatttgcctaccggtttatcatatatcttagttaatctaatttgattattcaatttacttgtatcgatctgatcttttctagggttttactggtatcggctaaattgtttgtcggtctagattagctaaggtatccactaccctgaaaatcagtcaatggcttgattgtttagattttatgattctttttatattttgcgttgcatcagccctagtcatgcttagaatcataaaaactaatatgcatgcctttcattgctaataagagtttcatcgaggttttagccgatgggttatctggacgtttcatcggcttataaggattatatacaagttagttttagctgattgcagtaaatgtttcattgattatctaattgtttga

SEQ ID NO: 70870 - DNA, 25212 bp, Oryza sativa
tcctcgccggcgccgttgacgccctctgtccagccggcaaggcgggcggcggcgcagaggggcggtggctgccagctggacagcggcgcagaggggcggtggcagcgggagttcatgcgagggacgagaggagtggtggcggcgtgatctggatagggaggagaagaggagttagggttaaagggtctgctcgaatcttaaagcatatctaatagtccaaaatttgaaagataggaggtggaattttctatcaacagatatgtagatagtcccatattttttgctgtcctgttttgtttccatatggtgctatattttttactaaaaaatagtcggcattcatatactccctccatctacaaaagttacacctatttcacatttgagtttttccaaataagttgttcctatttataatctttaattctttatgcattcaagacttaaatgaagagataaattaaatgttttattcgaactcaaggagtcatctaaatattcattggttgtatgcttgcattcactccttaattttgtaacatccaagatgatttaatttctccttggtcttggtatcaaaagtaatatgtgtaacttttgtggatagagggagtatattgtaaatttctaaattacatatgtaattttagtgtatttacaatgtaagtctcaaaattacatatataagttccaaaattagatatgtaagtttaaaattacatatgtaattagtatgtaattataatatactccctccatcccagaatataataagttttatggttggacacggttattaagaaagtaggtagtagaagtgagtggtagaggattgtgattggatgaatagtggaggtaggtgggaaaagtgaatggtggagggttctgattggttgggaagagaatgttgatggagaaattgttatatttcgagacaaattttaagtgctaaaagttattatattttgagacagaggaagtaagtacgatgtgattagtacgagtaatttatccgttaataatatcagcatgtacgctagaaacaaaacagaacagcagaaaatatagtttaatcttcgagtgaaagcaaatactagccccacatcttggagataattggaccgagcaaaaatcgactgcaaccggttgaaaaaaatggcgacacaattttagcaatgccaattcgaaaaataccccacctatgaatgccaagtcgttagcgccgacacatgcaaaagatgtgtcatcaaatagttccgttagaatgacaaagttctttcgagcttagcgaccaacacatagcacatgaatgttatggagtggaacaggacattttctggggaataagatcgaggaatttccaacgacaaaagtatttctagagccaaatgttcgctctctttcagtgaactctaacatacacacccaaagtgtcacctcggcatgaatccagtctaaactgtacagtgttgtttttttttttttttttgggatatgacacaaggcactaggatggtgaaactgatacagcaggatacatcacgtaatgatctctgacagtggaggtgatcagcggactggcaatggccatctttagaggcagctaaccatgttgatgttgagcaattcattggtcccctgccacatactctaaggagaaacaccagccattcgcagagaaattgggccatcagatacacaaagaattatgatctcactggtctttgagcaaaatcttccattaatacatcttacattacagtgaaggctgcagtgtcatttcttgcccattctggtgattttctgatggtcccccaggtgcgtctgtaggaatcttcgaatctgcacagtgttgtaaatcccaagcatcatgttagttcattgtgtatacatacctaacgatggcatattcagactagttaaccaacaaatatattataaacacacacacaccaggttcagttggcaatggagttgaggatttgatctcttcttttgcaggtgttgaaacctttgaacaaggcttatgaaacagtaaatgtgccacaatgcggtcgattggatttgtgtttgtttctgcttcacttgctggagatctgggattgtatcaatcaagaatttgtcactgaaaaaaaatatacctattgtactcatatatacgcaacggcagctagctacttgcaagcagcaaaaagatggtataaataagatgaattggtacgaggtagaaattgcagatcttcaactacttgctggatgatgaaggaatttcagagcttcttggctagggttgtgtttatttttttggagagattttcagaatcttttcgtacaaggctgcacattccagctacaaccaaaatgtcaggggaaccttcagctgttccctccaaccagtacaacaaaaaaactagcattggatccatagtatccttttactaaggatgaactaacaaataaaatcttaaaagaaatgagaaaccccaacaaaacaaagatgttgaaacttttgattacttaatttcaatattttatcctattcaatttcaaatatcattgggtaaatatgatatgataggacaattcacaatattagaactgttatcctagtttaattagatagaagtacacaaacatgatgccattcagatcattatcccctgttgtgcccgatgtactgttgatgactggaacataattttattcctaaatgtacaatcgttcaacttaggagtatcttgatctaaaatagcaatattacttatatactccctccatccaaaagtcttaagcatattttttttttggttttaccaaatgagatgatcatatttgcagtttcaatgtgctaaattaaattgttgatcagagcccaagaaaccatcttaatactcattggttgcatgcatgcatatagttccttgattttgttacatgggggatgagttatattcttcttggttttggtgaaaaaagaaatatgcttagacttttaatggagggagtattgcaatattgcattatgtacagtaaagcaacgcattactactagcagtgtccaaatgcgaggatggtaatacttaatggaaccattatggcatgaagcaaagcataccttcttttagatgtgtcttctgaaacttcatcatcatctttattactcttgttagcactacttctgtcactagtaatttgtctctctgagacactatgggccaaacggagtaaactgtctcgaatacaacgccgagttctggtatccaactgtgtaaagaagaaaatatggtcaattaatttatcttgaaataagccctgcaacagatatggtcttacatggcataaaaaaatcaatgtaaaaatctgaagaaatactaaataagctaccttcgcaagagcatcttgaagctgataatatattttttcttctataaaggggtcatcaggaatcccagaactcttctgaatctcttcatggccagttggaatcagctctagtgagaaaactttatttgcattatcatctatgacaacagaactccctaaggaatctggatttttgctctttggtgagtacgcttgaggtaccatggtatcgctgccagaaccatcttgaccaaactgctgctgctgctgctgaatagctatcagtgcttgcatttgctgtcgacgcctaagcttttcaatcttttcttggggtgtcatcatcaatggtcttgatggtatatcttgtgacttttctgcggaacttgactgttttggggaatctattgaagttcggtaatttgtagtagctggctttgtttgatggctttcagcctgaacatttgacatcagaggaatgccaggaaattgatatgaaggatatccatagtcagggaaaataaactgattagcctgctgaagttgtcccatgttcttgttatcatgtaatagcaagtattgaggagtctgaaggggttgcgcaggggctttggccaatgaatgcgaactggctggtcgatgctgtccttggttctgggagaagccacttgtactattggacattttacttttgcctctttcttctgttcttctccgtgacctcactgacttcttctgcacatctccctacatggagaagcatatttgtgttcagaaacatatttacatttagttaggaagagagcaaacttgttccctacaagtcagataaactaatcaatattcaactgcatctcaaatcttaatttgaaaaattgacatttataatgaaaaaggtagataaacatgacaacctccaatagaaacaaaaaaaaaggagtatcataaatcacaagagtatcatataatgaatgtatgttggtcattatgatgcctcacagtgcttaatttactggaaccttaaaagacatcacaaagttatagctgaaactgtcagaaaggactttgatttataattaaatcagtttagatggcttcctggatttaaaatacatgctaatgaagaattcggtaaaacaaaaaactaattcgaaatgaacagctgtccttcaaacttattaccctaaatgtaaacactcttatatgagggatcagaacaatgaaaacaacctcaggacatattttagtgtatcactataacaaaatgtgggagatggatttcattcataaaagttgataggatgcatcacatggctgactacctcctttggaaactgatttggttttccagaatattcattattcagatgatttttatgctcagcttgctctccagatttagcattagcgtctactacctgccaaaaatgaataacaggagtagccaagaagtaactgctaattatgacacataaatgcatgcatttagacatttaccttgctttcttgttcggtagttccaccagatgtttcattaatcagaagcgaagatccatgatcagaagatagttgtttattcagtggtatatgctgtggaaccatcaagtaaatagtatagataaaaaatagttcaaaattatggaaagagatgaaaattcacagtggaagattattaatgtatcgacatactggaaaggggattgattgtacagtagtatccaccagatctgaagatgctgagagaaaattactgccatcagcaaccatctcattaccaaatatggagtcaccattgctgtagacaataacatcatgtgatgagtttattcaattgtaacatgtgatgattttattaattcataagatttcagggaaaacctcttccagtgtctgatattacctaaataagcggtcaaaatcatcaaaatctccgatattaccccagtcacaatcaaggaagctgttactcttttcttcatgatcattaccaaacacttcagtttcaccatccagctgcactgtacatgggttaacaaaagctatataatttgctcacaaattatgtcacctcttcttttacataaatggtatccttttttccatgcatcaacatgcttatagattagctgttatgaaaatgaagcaggaataaaatccacacgcagcagtaataggatgaaacaaacctgttgtgtttcctgtgaccttctctaaactaggtgcagaactgaaatccaaatatgtagatgctatattatcatcgctgtagtttctatcaagtgtggcattcaaagaaggcaagtcaggccaggattcaacgtcaagttgtgtagctgaataatgttcactagcctgagaggcaggctgcttttccaaaactggaaactcagtttgaccacttgaacttcgttcagtaaggccaggaatattatcagtttcttcatcattcttcttctggtctccaacacttactaatgcactatcctctgtatccttagggtaaggcacaatatggtcttcattctcattgaactcagcccatattgcatctcccacctgcaattcaaacgataatctgaaaatactctgaggaaatttaagcagagtctcattgtcaaattattttgaaacaatttacggagccatcgtttcgcttattcgcggaataagcgaaacgcgcgaataagtgaaacggcgtatttgcaaatgaaaagtaatttgtgaataaaactgttatatacgtgttcttagcgatctaaaagaaaaggctgaaaaataaattttgatgaaaaaacctcaaaatcagctccaaatttaaggttgaaaattcaaattttagctgataagcataagcataagcgaaaagatgaggtcctaaaggagaacacacatgaatataccctacaatataaattcaattgtatagtagaataaataatgtgtaaaattagagtgcaagattcctatcatggttctctattcataatcgagagtgatatgagattatacaatttaggtcactaaaccgaaactattaagccacaacgttttaattcatatgggtaggcctgctgtctgaatcatgaatttttgataaaaagaagaccatttttcataatcaatccaatccattttacattacccaaagagtgacctactataagagaactttaatacaccaaatgacataagtatcagagtatgatcctacttctaataattcacaacagaaacactgtaacttgaagttatcagcgtccagcagccgtcacgtgaattcaaaaatatataaccttggttcacaatactgctatgtagagaagactaacgatagaagtcagattggcagcactcccgtggagtcgcaaaagattattgggacatccaccacccgtcgacgcaatagacaattctacaagttacataacttccaatttagtgtaaccttaccttatgagacctagcacaacccaaccgcacgcggtagcatctaaatgcccacaagactctctctgctaggtgagcctccttggaaataatcctatcatcctcgctcgctcgctcacaatcatcagctgcttcttcgagcactaaaatcccctagaaatgagaaggcggaaaagcaatatccccttaccagaccaccacatataaactagcttcgcgcggtacacgtgctcgcacagcaaagcagatccagccgccacagcatccgcggcacgaaactacagctaagaaaagcaaagggaaggacggatttcctctgcggcgcacctgctgctggtcgtcgttccactcgaacatcctcctcaggtggcggccgccgctggcgccgcacccgaacgagagcccgatacgcgctgccccccgggtcccgacggttgcatctccagccacggcaaaagggaagggcagaaaatcctccaattcggtgacgcggcggagaatcgcgttgcgcttgctcgcttctcctcctcctccactcgcgacctgtgttgtcgtcgtctgcgcttccctctcccccctctccctctctcctctcccttcccacccaccgagaggagtccagggaggggcggacgcgtggtgcaagatgattgggcgggcggtcggggttgaggtgcgggagggccacgtgtggagggggcgcatctcgggtagtggcggagatggctcgatcaaatgccgctcgttgattggctactgcgggacttagcgggttaacgggcggggcttagcgggctgggccgcgtcgactcgtgggggtcgcttttcatggcttgttgggcgggccgccacgggcaaaacgtaggaccagagatcactaagctttggtcatattagcgactccatatcaccgcaagtcgtttaggtattcaatcatgtttgtctactggttaaaaaaaacttatcaataaccattagtaaagtacaagtctagttgtgggttttgtatccaacgattgaccatctgtattattagaaaatttttatgattattagtatttttattgttattctttgtgtgatttattttttaaaatttttttatagatttttcaaataagacgaacgattaaatattggatatagaaactcaccactgtacttagggtgcgctcgtctgtgtttattgtagtatcgaattaaatctgagtgtaatcagtactgtaggctgttagtagtaaatatggtgggtggctgaatagtaggtagcaaggctggatggagtttgatgccggttggagtagctccttgagattgccgacggagcagtgatgcaagcgacgtgacgggacgggcagggctgtcagtagcaggcagcactaaaggcgctgcagccgctgctgttggtgtcggcttgacttgggagagggtggggcttttcctccttgctcagataggcctgcgcgcatggagccgacagtgataggcgcacaaaaaaagaagtaatgtgatcagcaggatgattagttgtagattaatgtacacaattaattgctcgataaaattctaatgaatgtgaaatgcgtgattaacaataccaaagttcacatagatagcaatataatagcgttatacaaattcgagtagaacaacaggacagttgtttctcgtaccgagaacacacataaaataggctaacttgagaaagacatgagcaaggaatacaaatttattaaggatagaaagtgatgcaggactaattgttgtaaactttcaatcacgtcacgaacagctctcatccccgcggcactattccgtgcgtcataccaattgcgcagcagtggtgcctgtgggatgggcgggtacctgttgtacaaccggttctgtgtcatgaaatgggggtctgcactgtcgagcctgaagttgtggagagcaaaaacgcagtgtatgatcttcgtttgggtgtggcctagggaaaagaggtatctccctaagaatcctacactgactcttcataactccaaaagctctctcaactgaagtacgcagggaggagtgcatatagttgaatgtttcttccctcccttgcgattgaccagcaaattcattcaaatggtagcgtacatgcgggtacggtggcaagaaaccgcactggcaagcgtacccagaatccactagtagatatttacctagacagtgaacatgagaaatttcagatgaaaattgcatgagggagtaatatgatggtgttgtgtactaactggattaaaaaaaccgtcaacattggtacttaccccatggcagccttggaaaactatggggatagttccggatagcttctgtgagcacccgctggtcgtgcacagctccaagccatccggcatctgcaaatataacacgatcgtcccatccaattacaactaatacattccttgatgtgatatggtgacgattgcggtgcaaattagcttcttcaactgcaacatgaactgggatgtgggtcccgtctgcagctcctgcatccccagcaaaaggcaagaaattttcatcttgcgcaacacggttatgcactcttcgaaaactaggatccacaggcttgttgatatcagctgccatggagtaaactgcatggtcaacagacactctcctaccaaggtcaacagacatcatcagcgaagatcaaacatacgacaacgaaatcggttaagaatttcacttacctgctggcaggcagcttcaacgtcctcctctttggaggaggagccagactacctgtatcccgcgtaagatagcaaatcatgaccccattccggtatctttgaaaaggagtcaaagagcgaggacggtgcgctttacctcggagccggcagacttctgccgagaaccggcgggagcgctcgatctcgcccacggcttccgcttggtcccgctgccccctgcgatggcatgagcggatgagatcttggcgacctcatcagcgaccttgccctttagcgaggcggaggcctagtggtcaacaaggggaccgatgacatccgtcaatggcaagacctgcaagagttgaagtcactttggccctttaaaagaataaagatacgcggcgtcccggttctcgcttacattaatggcagcagctttctcggctgccgacttatcgcagagcggggctggcggctcttcagccgaagaggtgccactgatcaagacctccttgaccctctgcaccagcgtgtcgtcaagaagatctaaaataaatgaagatacaaggaaacaagattagatctcgtctacaagtttaacatcgaaagtgatgagatgaaccctgaggtcctctcggcactcaaggctacagtttggcccgatctttcggtgagttcagataactacgatttgggagaaacgttgatgatccgactacaaccgtacaagacgttgcgttgcgccttagcgatcgatacacctcttcgtgggttgttgatcttgccggtgcagatcaaccctattcctgcaagcaaatcgaagaaacaagcaagaacaagataaaagcaatctaatattgcaaataggaattgaatataaatgataagttggggtttcggggtttcgaatacaagcagacggacggtctagccgacacgtgcgcttcaaggaagtagcaatggctaaactttcatctaaacaaaacccaactaactctgaaggggttactagctatttaagggatggaggaggtcagaagggcgttctccctttgtttggggcgcagccccccttgggccccacttgggccggggtcacaggcccataggcccattacagacaatgctgccccttatttcttcaattgccgatgactcagatggaatttaacaatgagattggatccgttggaaagaggattccgagagctttccatcaagtaatcgtgggcccaaaacggaggccatatggagatttagcaactgtttgaattcagcactatctcaggtggccgaattggattccagaacgcggcggacttcatctccatctctgcatgcaccatggccatcgtgtttatcttccatatgcaggccaaaataagtgaattggtcctgaacatataaacacatacattatgaggcagtgtcatattcttgattagattaaattgacacttgttatgaaacgataccacctatgggtatatgacatgatcaatggttgtatccgtcgtaggcatggtcacatcatcctccccttcttcacgggaaaatgtcctcggttttaacatgggtaattcacatagcatatcctcacgcaacgcttcatatggcgcattctttactgtatatggcagcaacattgagcgatctcgtcgctccccttcttcagaaccaacctgcgtctttggacaaaagcaaaacaaacttgaagtaacattagtggtcctaacactactctccagtttgcattttcttggcacaacaacagagggttgcatatctgaacaaatgtaaactttgtgcaccaaataaatttctctatcactatatttgccaaagatgtgaaaaataacattacgaggacatggcaaatcagaatgagcaaatattttgtccttcaaacaattgagctcacaagaatcatcaaacagaatatagcccaatgtatttaaagaagattgcaattgaagttcatcattctcactggacgtgtgaataacatgcttaaattcagtacatggagaatcaagattaaaagtagcatgttcattcactagttgtggaatggatataagtgaagtgctatcgcacaactcttctttatcacaaggaacataatgtaaatcaacttgtgacaaaggcaattcagaagtaggttccactaaagtttgctctaggttagcatggaaagtggaaaagtgtaattcatcagaaacatactcaccttgagtaatttctgcaccatttaatttaccttttatcccctctttagataatgtaggtgcatcagccttctcctcattcgcgagtgatggaagtgacatctcaaacatatcgttcttctcattttggggactgttctgaacttcctgcaaaacatcagtgataggaggcacaagcatagcttgttgctctgttgggttctccaaaattttgcgctcaacattgcaagcaagcatgaacaattggcctatatgattatatgtcacattaacatgcccatcaaattttaaaatcatgaaagtactccctaacagttttgtcaccttgttttagatgttgaaatttctcaaggagagcacgtctatagtatgaaaacacaaatctttttctcaatagtattttgcattcatcccaagtttcaagcttatttcccacagtatgccatcaaaaagatgcagaaccggtacacttattactagcagccttaatcatttgagcattagaaaaatcatactcatcaaattgtttttctactgctagctcccaattaacgtatgcagcagaatcatactttccatcaaaagatggcaaaaacagactcactcttgcaagattatgatcatgtaccttatttgcgtcatgttggtcacttgccatgtgttgtcgaaggtgaaaatgtccacattgagcacgaacagctccaaactctttgtgtaaccctgccatagttagtagcaaacaagaaacatatacaagaatatatacgttcctatcaactactaggtagtggaagctcacaaatcacacacactcaagctttttatcgagctcttacaagttcttaccaatgcaaactagaatatggtgtccacaccgactcaaccaaacactcgatggagttggatgtatcgacactttggcacacatgttcacaatctgtatagctgcagtcaaatctgtggagctctgggtaggcttaaatatgtagcaagtatggcaaatggttaaatcagagaatgcaaagttgaataatcgttcaaagtcaagtatcgtgctggtcctaggctagaacgaactagagacgcgagcctagaaacaaacaataccacaagataacactagaataagctcaagcatcactttttttttgagaactactcaagcatcactttgatataagagaacaaaatcaaagataagagctctttttttccttttttttcttcttccttcctctctctttttttcctttcgttttcttttctttttttttgttgcgcctttttttttcttttttttcacctttctgcctttttttcccttttttattttttttcaaaaaccaactcaaggacccggatgcaagattacagggactcaaatgtaaatataaaaattacagggacttaaatgtaaaagtgcaaacccaaaattaaaaatacacaaaaatagaatgctctcgtcccataggttccgtttttgcaaacagaattctaatctgatactccaaaaaaaattttaccaagttgtatgggagatcacggtatagatgaacccagagaggagatactcggactcggcctggttgcggacccgcggtggtggtgggtgaggaaaggaaggatgcggccggatttgttggggaaaaatgggaaacttatttttagccgaaccaacctactatttctttcccaatcaaacgcatacttccaaaaactgattcgtcctctcgctcaggtcacaagcgcggccgaatcaactcgcttcacatacaaaccacaaactcgagcaaaaccttgatgcgactccaaaactaaccgacaaaaacttctaaaaactacaaaaatagaaccgtggcagcgaactgattccgacaaggggggaggggggcgacgactgtggtacaaaacgtgaccagaactcgaaactttaaacgaactagacgctaagaccagcaacatgacatgacgatgcaacacaaaattcaacaaagcaaaaactgaaaagaacagtgcaatggcacaatatggctaggtaaatgacacaattttttttttgtctggctattttctggttatggatagataaaaaaaactcaacgagctttcggttatggatagataaaaaaaactcaacgagcaagaaagctctgataccacctgatgagatgaaccctgaggtcctcttagcactcaaggctacagtttggcccgatctttcggtgagttcagataactacgatttgggagaaacgttgacgatctgactacaaccgtaaaagatgttgcgttgcgccttagcgatcgatacacctctccgtgggttgttgatcttgccagtgcagatcaaccctattcctgcaagcaaatcgaagaaacaagcaagaacaagataaaagcaatctgatattgccaagaggaattgaatacaaatgataagttggggtttcggggtttcgaatacaagcagacggacggtctagccgacacgcgcgctgcaaggaagtagcaatggctaaactttcatctaaacaaaacccaactaaccctgaaggggttactagctatttaagggatggaggaggtcagaagggcgtcctccctctgtttggggcgcagcccccccttgggccccacttgggccgaggtcccagacgaagttacaggtccataggcccattacagacaatgcagccccttgtttctgcaattgccgatgactcagatggaatttgacaatgaggttgatccgatggaaagaggattctgagagctttacatcaagtactcgtgtgaagcatctaggcccacgttgttaattttggtaattaatgacaagcgctaattgtggactaaccattgctattgagatgatattttaagttaggtccacgtcatgtgtgcgcatggatgactatcgatcgattaaaattgacggcgcaaaggaaagagaaagaagacggtaaaactagtgctttaatttagaattgatcgaggtgtagggcgatcaaatttgctagtttattttctagtttcgctgtactattaagaggggtaatgacctagcaaagagatgattaaattgccacattaggtcattgcattttcacttgtgctcacattttcatcacacacacaaatactcacctttgctttcactgagctcggcctgaccaggggcggtcaaaccggccacatagtggcggtctgaccggtgtgccctggccagtctgaccggcctcacaacggtggtctgatcggcccataaggacggtctgaccggcggcacatgcccggtcagaccggcccgctggaggtcgggatggtgctactcggggtggccgatacagagccgacggagccttattcggtcagaccgagtcgatggcggtctgaccgagccgaggccggtctgaccgcctgctcaacgccagtctgaccggccaggccgatggggccctctaacagcactacaatggctagttttctagccgtcgcagagtagcacggtctgaccagccacatacctccggttagaccggcagagcacaaagttgggggatttcacccccaacggctagttttggttggtgggagtataaatactccccctcaagcagcaaggggactctcttggcacccaattcaattgcatacaccccttgcacctctctcacacccacttgagctttgtgttcatccatctagtgtgttagagggttaattagccaagagtcaagtgcattgcttccatttgtagagctagtatggcacttgattgatcatctccacgccgggtcattgcttgttactcttggaggttgccgcctcctagacggcttgtggaggagttgcccggtgacctctccgagaagattgtggaggaggcccggcgccggtttatgagtggtttggagttcaccaccttcggagtgaaggaagaactaccttagtgatcgaggcttgggtagtcctctccgtgggccggctcccgccttgcccaccccttgacgaagggggcgtgcggtggcttcgtggttgagcggtggagttgggctcgcctcaacggggagtaggaaaccgacgagtttctgaacctcggtgaaaaatctcttgtctccttgtctcatttgattgtcgcatttacatttgtgcaatttacatttctagagacaaacttgagatcatatcaccctaggattgctaaacattgacataggagtgtgatttactttcctagagatataattgagccactatcaccctaggtttgcaaaacataacctagttgcttagttagagttgaccctcaccaagcctagcaacttaggttagttttgattatgtgtcatttagttttaaatcgcctattcaaccccctctagtcgacatctcgatcctacaagtggtatcagagcttggtctctcttgattgggttttaccgcctagagagaagatgtcgaacgaggtgaaccatgtagggaaggctcccatgttcaatggcacaaactactccacttggaaaattaaaatgtctactcacctcaaagctatgagcttccatatttgaagtattgtggatgtaggctttgctatcaccggcacgcccttgactgagattgatcaccgcaacctccaactcaatgcccaagccatgaatgctttgttcaactctttgagccaaaaggagttcgatagagtgagcaaccttgagaaccgcatatgagatttggaacaagttggcggagatccatgaggtcacaagcgagtacaaggatgccaagcttcatttcctcaagatccaatatgagacattccccatgttgcctcataagagtgtgaatgacatgtatgggaggctcaatgtcattgtgaatgatctcaaggggcttggggcaaactacatgtcacaccctaaaaatcgttaatatataaattgttgtttaattggaattattagaaataattttaaaagccttgaaaagaagatctaattttaaataataaatcccaatataaaatggggccagataaaatttcattaaatactttgcttgattctatagttcctagagttttctgggatttatttgagccaaggaggtatttttaataaatggaattgcatttcatgaattatttaaattggaaaaggttttaaaagtctcttttggctttgggccgaaagtcggaccaaaaccctctctctctcctccttggcccaagtcggcccaagtcaagccgagccgcccgcgcgcgcgctcgctgccgctaacaggtggggcccacctgtcaggcctgtcgtctacctccggccggccgccgcccgaaccctagccgagctgcgccgccgtctccttccaaatccagccgcccctttccgtttctggtgaaattaatagaggggacatgatccctgggatcccctctatcttttctcttatggaatcgtcggctaatttcgtttggaaattcgtggattcgagttcgattcggatcgatctctctcctccgaaccctaatctttccttctcgtcgccggtcgccgtgggcctttgccgccaccttccaacccctataaaaggacccccaagcccgccgctacccgtcgccacccctgccttcgtctctcgtcgtccgtagcgccctagccccgtgagacctcacgccgccgtcgtcgccaccgctccagccgtgcgtcgccgtcgctccagtcgtcgctgtcgctcgggaaggccgccgtcgtggtcgccgtcgcgtcgccgtcctcgtccgcccctccatcgttgctgtagaccgccagagcaccgccgtcgtcgtcaagccgaaggtcgccgccgcttcttcctcgacgccgtcgccttccgttgatcttccgccgccgttttggtcaccggtgagttcgccgcgtcgctctctatgcgctggtgccctccgttcgtgccatcgcgccgtcgttcgccggcgagcttgcgcgcccgagccgccgccggtgatgacgtcatcgccgacgtcatcgttgccatccgtcgtagaccagtcgtagaccgttagatcttagccgtccgttgtggttaggatcgatctcggccgtccgttcccgtgaaccgtcgccgtgcacccggtccaccgcaaaccctagtcgctgacgcaataattcccttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacattactattcatgcttgtttatgtgctgttttggtgtttttgctcttttctgtttagattccgacgtttccggagagttcattttcgcaggagaagaatttgaagagttccaaggccagcaaggcaagtcacacagatcccaaacaaccctttgagcatgttgatcccgtttaaagctatcatttttattcaactattgcatttattttcgaatgtcattgggtggaattaacctatggtttgttatagcccttttgttcttgattattttattccttgataccttgggttattataacttgactagttgggctttatatattggttcagctagatattagatacgattgcttagccatgcttagaaacatgagcacactattgggataacttataattcactattatttaatgatggcttgatgatagctcacgatggtcaatcgtgattggttaattaattaaattgccaactaaaacttgctaatggtgggttgtgagcacatggttttgatggtcgtgctcatgacaattaaggaccggttcacgaatttcggttgtgaaacattaaccgtgccaaccacaagccagcgtgggcaacggctttaccttttgtatagcatggttcattgcggggcaccagactgagaagtggcggagataagctcacgggggtcgctggggagtccatgccttgtttataagggggtgattatgatccaggaacggtgcgctgtggtggattgtgttgtgtgaggggtactatcacagctcctttctgaggtaccgtggtggtattgaggcgcatggtgacatgtcgtggggctgtgtcttatgggtacagtggtacatctctggccagagtaaaactattcgaatagccgtgcccgcggttatgggcgggtctaacaatgtctttcgtgattagtttcacatttcccatcataaaaaaagatgctataactggtaataatttgattagctcctggtttggaatggtacattcctggtttggagatagaactgtgcagccgggatggttgttcagaatggttgggcctatgcaacagggtatgttgtatagcgttggattaatattgtttaattattacttaactgctttattaaattctgaaatgtttaataaatgttgtttaagcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggatgattaggcgtagccctggtcaagctgcctgtggagaggagtcgcctgcgctgtttcttatttttccgctgcttagatctttattgattgagaggaactatctacctctgtaatgacattttattcgcttattaattagagtaataattgtactctattatcaatatgttattgtgtgcctcggctgattcctggacgagggttcacacacatgtaagcgtttggaattttggatagaaattccgggcgtgacactacaccgatcttgaggttgcccaaaagatgcttagggctctaccggagaagtatgagacccttgtcaccatgctcatcaactccgacatgtcaaggatgacacccgcaagcctcttggggaaaatcaacaccaatgacatgtacaagttgaagaagaaggagatggaggaagcctcaccttccaagccgaagttgaagataagggcaagggcaaagtgaatgaagtcaatgaggacttggaggaagagattgctcttcttgctagaaggttcaataatctcttgggaaggagaaaggagagaggaaggggctccaactcaaataggagaagaaacagaagacccaacaagatagaggagaactagtgatgcttgcaatacatatatctattagaataataatattccactagtattaggtatactaatcttttgcagagaatgacaataaagtggaggagaatcaacatcaactccgacgataaatcaatcggatggtgtcgagaactagacttatgtatgaatgggccaagaactcagaaataacacgacacattgggccaaaattcacaagtctacgaagaaggacaacaaaggaggccgccagccgaagatgggctgggttgggccagcccatggttcggccgaaccatagggttcagccgaaccacccgtggcgccgatggatgcagggtttggacggacagctgggattgatccccaatggcggttggagggtattaccgaccattccaatcgtcccaaccgtcattacctacctataaaaagagcttctcttctcacttcactcacacacctcaagcaattgctctctcatttctctccagtttagtttagtagtatctagctggtggaatagaaatagagtaggaatcaggagtccggaagccttcggaagagttcgggtatggctctagcagctttcctttcttcttttgtaaattttgtacttttattagcatactcttctaaatacatttatggtattgaaatactttccgagtatgtgagtacctattttacattatgttcatgttatactgaatatacggctagcatatctaggagatgctttggtgcgggtataatgtttgcttatgcaattactctatgtcatgacgatgatattagagtaatatctggtagtttagacgtagtgtctagattacgggatatcattatttggggttatatgttgcggatgagaggtgggccgctgatggtgacagctcagtacgggtattcctccgcaccggtatataatcctaagttaatttcctggggagggtattcctccgtatttagccccggttgtatggtcatgacagactatcgtaaggaactcggcagtcaggggtggcttctcgaaatactaggagggcatcggatagagggtattagctagtatatcagttaactagaatgtatgtatactatgtatattagaagtataggaatatattttctttctcttttctttccacttagctcagataatatattatgagaatgagtagtaatgcttgtgtgtcactctacccttggattatcttaacccctgcttagaatatgattatcataagtaatatataaattattagtcaatctatctctacatgatcttcccacgggataaaataaatacgatacccttagaatactctcgggtgaaatgctacaatggtatatctgtgcgcttgcggatgatctctgtaaccataatataccagaagtatttctgcgccattgctgggaattatatttctagtaatgtcgttaagaaataccagcaagcatttttggcaccgttgccggggaagattcataatagagattgcttgaactaatactttatatttacctctgtataatcatttcctttgcaggctaaccttggttgttttcactttttgttgtgaaaacagggtagtgcatgactggtttcaacctgccggaaaacttcaaagaatatccagaagctttcttccggggcgtcagaccgcgagccgttgctccgcagaaaactctaccaacagagaaaccagccataccagcgccaccgatcttcaatactatggccagcaagactcttcgcgagttcgctgctccctctactgacaatgtggccattgggccgcaaatcaacataggagacatggatttcgacttgaagtccagccttatcacaatggcgcaggctagcccgttctgtggcaagcctaatgtggatgccaatgctcatctgcaacagttcctggagatctgtagcacgtacaccatcaagggcgtcagtcccgacgccatcaggctgcggctgtttccgttctcccttctcgggagagcgaagcagtggttttatgccaaccgtgctgctgttaacacctgggacaaatgctcaccgggattcctctcgaaattcttcccgatgggtaaaaccaatgcccttcgtggaaggatttccaatttccagcagacaagggacgagtctattcccgaagcattagaacgactgcaggagtatgtggccgcttgtcctcatcatgggatggacgactggctgattgtcacgtcctgataaattcatcccgaaataaaattcattctctaaatggaataatagaattaattaaaattcgaaaagaaattggttaacactaaaatacgtacaagaaaaattcgaatgtggcccggagaatttttgttaaattctccttggtctaaaatgagccctcaaattttacttgaattttcagagcaccggaaatatttattaagcaacaaaaacaattatcaaagtttattaaaaagaaaaacctaaaaataatcctccttcctcatttgggccaagtctggcccaaagtcctctctctctctctctctcggcccgcagccaaagtcctctcttcctccctctctttctctccctctccttctctccctccttctcttgggcctccccttccccctcggcctaggtcccttttcctcccctcccgcctaggccgcgtcccggcccaagccgccccacccagccgccccagcctcccgaggcgcccccctgacgcgcgccacatgcgcgccgcatgcgcccgcgtggggcccacgcgccggtcatcttcctcctcccggacggcctcctctctctcccgtgcaaccctagttcgttcctccccaaaatccacgccattcaaaccgggaattccaaaattgattagggggaattaattcccattccttcctcttcaattccccctaatttcccccttgattcgtgcccccaatcgtcgggaacgcccgcgccaaccccggccaccttccatggccgccgggcgcctattccgccgccggtccccgcctctcccgtggccagctccctctcctcccctataaaatggaaccccctccgtgcgttctctcgttttagccccttcccgagattctccgtggctgcaccacctctccccacctcctccttctctttcctcggcgccggccaccctccagccgcctgtgccgcctcgcccgtgcggtggctgacgtcgccaccaccttcctcggcctcgcaggtgtcctctctccaccggcgtcgcctccgtttcgcgcggagaccaccggaggcgtgttcccaccggtgtccagtggcatcgccaccactgcaccgcctccagtcggccgttcaccgtgcctaaagcgttggccgacgctgctgccccctccctcggcacggtgacatcgccatcaacctcggccactccccggtttcgccgaaatttccccggtcggcccttcctccacccatgcgccgtcggccgcgccaccaccgcctccggcatcgcagcggcaaggtcgccctcggcctcgcctcccctccacccgaaccccgtcggtgttcgtcgtcgtcgtctccgtccgacgtcgccatcccctcctccggtcggccgttcctcctcgccggctcatcatctcgcggtgccgcctccgtcgtcggattcgcagcggcgtgtaccgcgccgtcctcgcctccgtgcagctgctgccggctgcctcgtcgcctcatcgccggccccggtcgtcgtcgtcgtcgtcctctcgtcgttcccggtcgtcgtggcgtccgtccctccgtcaagccgcgttcgttcgtcgtccgcgttccgtcaagtgagctgcggcagccccgtcgtcgtcttcgtcctcagctccgcgtcgtcaagcgttgcgccggccgcgtctcgccttcgtccaaggatcgtcgccgaagtcgttccctcgccgttcgtctccgtcgtccccgagccgtctccgctgcacccgtttgccgttgtcgttcccacgcctcgtcgtgtggtggtaaggatccgtcctctcgctgcccccgtcctcgtcctttcggtgtcgcccgtgcccgttgtgcggttgtcgaccccggtacctgtgtactggtgtcagtagtcgttcgcttgtgcgtgtggtgaccgtgttagtgtgcccgcttggtagccgcgtggtttccacgtgtgcagcccgcgtggtgtctagtggagtccgtttgtcggccactcgcctcggttgacacacggggtccgcttccgtcgacccgtggaccgtctctgtgtactcggtctaccgcggtcctttaggttgacatgtggggtccgcatgtaaacggcgcagccttcctgtcttttctaggctagcgcttacacatgttttatagttgcaaaacctaattataataatccgcaaatctccatgtaacagcattaaacttcggatgatcatatcttggtcatacgaaccccgaatcaacccgttcaagtctcctaatgtttgttataacataaagaaccgtgtgctttctttttaagtattgttattgcttatttataggcttgtagctttgcttgtgtgcttcgcgtagcttctgtcgttccgaaggttctcgaagcgtggttcgcggtcgtcgccgaaggttcggaaggccgttctctctgagcaaggcaagtcgcatcacccttgagcatattgaatcccagtttataaaattattttgatttaaattattgcattaccgctttatttaaattcctgcgttatcactgttttatttagcacttcctattaatcctttgttatgaccttattattattgctattgtttattatcaccttgttcaccctaggaaaacaaaaccccaacaagtgggtactctattcatggttccactagtatgaatttaggtagatgcttcgctgattaattaggcaacattaggtggttttataactttagactttgggaattctcaaatcacttggatactatgaaatggttggcttatggtggaattggacatacccctctcttcctctttcaaaacccctaaaacatgttttctggtggggtattgtatgcatgccagttatgggaagtagcaccccggccaatataaggattaagctcgggcctctgttgcaaagcactaccgtactaaccacatgtctaatgggtaaggcttaactcggtgctcagtctagtcctgaacaataattgacaaaagttcgccg

SEQ ID NO: 70871 - DNA, 25387 bp, Oryza sativa
ggcacttgtcaaatgatgaaacttaaacaaaccaaaatggggttctgaatacaagtatccgggtggtctagccgacacacgcgagtacaaggaagtagctgcagctaaacttccatcaaaaacaaaaccccaaagtgcaaaatggtggctgctaggagtttatataggtggaggaatgaccagcagaggaggtgggagcaaaccctaggttttgtggacccctaatgggctataatgatacaaggcccaagcccaagtttctgatgtaaagaactattttcgtcattctgagcagcctgggtcaaagttgatggtgaggccacacatagctgacagtagacgacgagatctttccaacaagtactcatttgccccgtttgccctccggagtgaagagcattgacttcatcaaatcagcgctgctagtgttgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgtaataggcgtggttgtatcgttggaagggatgtcctcatcatccaccatgtgcgccaggtgcatgatggtagcgtcatcctccgagctagcatcccggaaggtggcgtagtcgcgggctcctccgcgacgagggtggtagcggtagggcaagtgctgcaactcgtccgggtagcgctggtgaagagtgccgatggcaaggagtgcggcgttctggcaagcagcggagaaggaatctccacccgcggtgaccgccaacgaagtcctctcgggtgagccagtgaggatcactgcagtaacctcccaagcagcgtggggctctgcatcgtcaccctcctgctccgggagctgcttgccctggtagtccactccatgcggataccccagaacaacgcacatgccccgcagttccaaaacgaatccagtcaggtccagaccacgacggttgatgctgccggccatctacaaacaaaaacaaaagagaaaagcaacattttaaaggtcagattttgacggtaaatgaagcagcaggacagagagagactagaggattttcacaaataagaaaggatttttattttgaaaatattgctaaggcttgggatctacggctcgtcctagggtcaagggggctctgataccaacttgtcacgaccggaattgacccaacgggcgttccttacgtgcgtgtattattccttatcccaggaggcaaggtacaccaaaagttgatacatttcagagtttatcaagcggaagcgtaaatagttaatttattacatgggcggcgaaggcccagcacacacaaagacaaacaagaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttgtaatataaagggttaggttttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccgcataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatcttggctaccaggccgtagctcgtgtagccttcatttgtcctagagatgtccatcgacccccgacttcgtccatctccatccgtgtacttttgtttataaccagactgagccacaaactaagccttacccactagacatgtggaagtacggtagcgctttgcaacagaggcccgaagaccggtccttatatggccgaggtgctactatcaaaaccatgcaccccgagcccagcctaaaaccattttgagggttttgaatagagggggaggtgtgaatccaattccacaatgatccaacaattccatagtgtccaggtgatgagaatattcccaaagtgtagagttgtaaaaccacctaatgttgcctaattaaccagcgaagcatctacctaaattcatactagtggtaccatgagtagagtgtccactagttggggttttgtttattctagggtgaacaaggaaataataacaataacaataataaggtcataacaaaggtaaataggcatggctagataaaacagtgataacgctggaatttaaataaagcgataatgcaataatttaaatcaaaataattttataaactgggattcaatatgttcaaggatgatgtgacttgccttgctcgctttcccaaccgtcggcttcaacttccacgaagagcggatcttccgaagctgcagcgtctacacgatcaatggaaaagaaaaggcttttactctaataaactccatataacaagcaggaacaaagcacaaaaatgggttcttgacttcttaaggaaaaattagagacttgaacggtccaattccgagttcaaacggccaagttatgaccatttgaagtttatatgctctttaaatgaatatttgcgaatttcttcatttaaattttaattttaaaagggtttattgcatcagccgaggggagggggcgagcggaccgggtccacgggagtgggacccacgcggcagcctcacgatccacggtggaccgggtgcacccgggctcacaccggccggcgccgtgggccccacgcgtcagccacacccgagggcgcgagcggctgacggccaggccccacgcggaagccgctcggtgcgcccgaaggcggccacggcggcgcggccggcgggaggcggcgcgcccgcgcccctatggtcgccggcggcggccataggcatggcggagcggcggccgagagaagggagggaaagggggaaatgaggcggcggtccacggctcaccctaggtcgacggcgacgacgaaaaggcggccggagcggaggaaggcggcggcgcggttcgggtcgacggggacggcggcgctccggcggtcgacgagcgaaacggaggggtggacgaggtcggcgaggatgcggcgaagccgaaggaggcggtgccgaggtgggaggtggtccggggcgacaacgacggtggaccggagctcggcggcgacggcggagagagagagcgacggcgcgagctcgattccggcgaggaggaagggcggcgagaggcggaaacggacggaggaggtgcagggagggtttatatagggttggaagggggagagagcggccggcggggaaggaataggtgcgggaggtccggccgccatcaatggcgccggcgagatttgcgggggcaaatccgcccgtttgaatgcgagggagagagggaaaaatggggggaaagggagagggaatcacggggaataattcccccctattgattgcacgcggggaggacggggacggcgggattcgcggcggccgcggcgctagggcgcgggcgaggcggcgggaggaaggggatgatgggtgggccccacccgtcagcgagggtggcgggcgggcccgcccgtcagcggcgcgcgcgcggggagaggccggatgggccgcggggagaggagagggagggggaaggagatgggccgagccggcccaagagggagagggagggaaaggggactttttagagtttttctttttataaaatcattttaactttgtttatttcttaataattattatttgtgttctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaaacctacccctcttaaacggaatctcgaccccgagattcggaagaactgccgaagagattgggatgggctgccttcagctcgtcttcacgctcccatgtagcttcttcctcggcgtggttgctccattggaccttgcaaaaacggattacccagttcctggtcctgcgctccatggtgtccaggattttcacgggcctctccacgtaggtcaagtcttcgcgaacttcaatttgctctgaatcggcctgctcggatggcactcgaagacatttcttgagttgcgacacatggaacacatcatgcacgttgcccaaggaggcgggcagctccaactggtaagcgacttccccgcgtcgagcaatgatacggaaaggacccacaaaccgaggtgcgagcttccctttcgtctgaaacatgtgtacacctcgcaatggcgtgacccgaaggtacacaaaatcgtccactgcgaattccaggttacggcgtcggttatctgcataactcttctgccgggactgtgccacctttagattatcccgaatggttctgactttagcttcagcctctctcaggatatcagtcccgaacacttggctttccccaacttggtcccacaatagcggtgtccggcatttgcgtccatacaacgcttcatagggtgccatttataagctggcttggtagctgttattgtaggagaactcggcataggggagactcttatcccaggtcttcccgaaatctaggacacatgagcgaagcatatcttctaggatctgatttagacgctcggtctgtccatctgtctgcgggtgatacgcggtgctgaaatttaatctggtacccagctcttcttggagcttcttccaaaagtgagaggtgaattggcttcccctatcagatacaattttcttaggaacgccatggagactcacgattctagcgaagtagagctcggctagtttgttccctccataggtggtcttcacaggaataaaccgagctaccttggttagtcggtccacaactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttccctttcaagtctaagtacatcttcgtactgccagggtgaatggaataaggactttcgtgagcttcctgaagtatcagctgtttaagttccctgtcgtctggaacgcatatccgatttccgttccatagggttccgtgttcatcctctgtgaaaccagcggctttaccctgtttcatattcttgaggagtccatgcatatccggatcattcttctgagcctcgcggatttgatcgagcaaggtgggcttggcttccagcgtagccaagaatccacgaccaactatgcttaggttcaaggcttccatctgttgattaagttcgggtggaatgccacggacgtcaagagtgttgcaatggctttttcgacttagagcgtcggcgaccacgttggccttaccaggatgatagtgaattcccacatcataatccttgatgagttctaaccatctcctctaccgaagattcagatccgactgggtgaagatgtatttcaaactcttatgatcagtatatatttcacagcgattcccaatgagatagtgccgccagatttttagagcatgaactaccgcggctaactccaaatcatgggtagggtagttgccttcatgaggccgtagctgccttgaggcataggccaccacatgaccttcctgcatgagcacgcaccccaatccttggcgcgaagcgtcacagtacaccatgaagtccttgcgagtatccggtcagactaaaactggcgaggaaaccaacctttccttgagagtttggaatgccttctcgcattgcgggctccacacaaatttctcttctttcttcaacaactgtgtcatgggtcgagcgattttggagaagttctcgatgaacctccggtagtatcctgccaaacccaagaagctgcgaatttgagtgactgtcttgggttgcttccaatcaatgacggcggtcactgtttcggggtccacagcgactcctttagcagatatcacgtgccctaagaatttgacttcggacaaccaaaactcacacttgctaagtttggcatacaattgatgttcccgcaactttcccaacaccagacggagatggtgctgatggtcttcctctgattgtgagtacaccagaatgtcgttaatgaaaaccacaacaaacttatccaggtattccatgaacactttgttcactaagttcatgaagaaggcaggagcattggttaaaccgaacgacatcaccgtgaattcatacagtccgtatcgcgtggtgaatgcggtcttcgggatatcttcttcacgaatacgtaattggtgatatccggaacgaagatcaatcttggagaatacagtggcacctttaagctgatcgaacagatcatcgatccggggaagagggtacttgtttttgatagtaacttcattgagagctctgtagtcaacgcacatcctctttgtcttgtctttcttctccacaaaaatcacaggagcaccccagggggaagtactcggccgtatataccccttttctttcaactcttccaactgtttcttgacttcggccagttcatttgctgccatacggtagggtcgcttgtacaggggagtggttcctggagcaagatctatccggaactcaatctctcgcttcggcagcataccgggtagtttttctggaaacacgtctccgaactctctgacgatggggatttctgacagtcctatctgatgaagttctgaactaccgacagaagttgggggtgcaaagaaaacaaccggttgttccggccctcggtacagagtgacagtgcgtcttgcgcaatccactactccttggaattgagccaaccaattcatcccaaggatcacatccaagttcttggtgtctagaagaatcagatccgagggaaaaggaattccctggatttctataggaatggcagggctataatactttgctgtcataacccctccaggggtggtgatgagcagagggttcctaagcctttctatccccaaccgatttctccccacgaatggcacagatataaacgagtgggaagctccagagtcgaacaaaatggtagcagggatggaatgaatgaggaacgtaccaacgatgatgtctggagttgtcagcacgtcctcggccgtcacgtggttcacacgtccccgaatgacatccttaccaccgttgttggagcggggaggcgcttggccttgctggcgcctcggctttgggcatttatccgcaaagtgcccatgctcgaagcagttgaagcacagacgctgctgaccttgaacgtccctgcggccttgaccaggctgcacggctggcgtagggggacggggcgcacgagtcccttgctgactctgctgttgctgcggctgtgggatgcgcaccacgaattgaggtcggggcgcggagcgaggttgctgctgctgttgctgctgcgaggatgatccccctggatagggattggtgtagcggaccctttggttagccccctgttgattgcggaaattcgccaagcgacgcttgtgcgactccagttccttgtgcttggcttccaagcggatgctcttgtccaccagacgttggaaatccgagtagtccccggagaccagacgcacggacagctcaggatccattcctgccaagaacttctcttacttctcctcatcttcacgaacatcctccggggcgtaccaggccaggttgttaaactcatgcaaatactccatcacggagcggttgccttgcttcaactctcggaattcccttttcttaagggccatgactccggcgggcacatgggttctctggaaagcggcggtgaagcgggcccaagtaataggttgcccctctagctgcgtagcctggaaatggttccaccatagagatgcgggcccctgcagttggtgggcggcgaagatgactttctcctcatcactgcactgcacggtgtctaactttttctccacggcatgcaaccaatccaatgcatccacggggttattagagctagagaaggtaggcggacagatgcggaggaactcggcgagtttagagtgttgtgggggtggtggtggagcattatgttgtggcggattttggatgtggtggaggaaagcagccatcatgttggcctactgggcgacgatttgggtgaggatggcgttggtgtctggtggtggtggtggaggcggagaaggaggtggaggtgggctgacatggttgttgtggttgctgccttcggggtgactgccttcaccggtagcagcacttctcctggttgtcaccatctgaaaatcccacacagaaccagcaaacagagagagctgacaattaaaactaaccacccacgactaccataattcttgaatttattactgctattaaattggttcattaaagttcaagttgcttaagcaaataaaataaagacaggctccgacacagttataccacacaccggcataaccatgccccatacgactctagcagaaaaacaaaaaacgagaagaacacacgcgcaagcctactaactgctcgtctactgctgcgacgggccagggcggaaggtgagcaacagcgcatcctccgtactgccaacgccggaggctccatcctcctgaggaaccacgggcgcgggctcggcacgaggggtctcgacgaagcaggtccacgccagggactgacgaacaagctcgggcctggaggtactcttgcgggcggtgatcttcaggctgcggcagacgcggcgacgcttggggcgacagacctctccctgggcgatcttgagctgacgcagctgcgcctccactgcgtctaagtccttcttcaactgcagattctcctgacgcagctccaggatcttcatgttgttcttgaccaacccgcgacgcaccatctgatggaagtcgatacgggccgcgtcgtatgcctccactgatgcagcaacgggggttcccgatctttcgatgagaggaggataaacttcgatttggggaaggatacgacgttggcggtccgactacaactaccacaggggtgctacgccttagcaaccggtacaccgactccacgttattgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaaacaaaacccaaagtgcaaaatggtggctgctaggagtttatataggtggaggaatgaccaggagaggaggtgggagcaaaccctaggttttgtggacccctaatgggctataatgatacaaggcccaagcccaagtttctgatgtaaagaactattttcgtcattctgagcagcctgggtcaaagttgatggtgaggccacacatagctgacagtagacgacgagatctttccaacaagtactcatttgccccgtttgccctccggagtgaagagcattgacttcatcaaatcagcgctgctagtgttgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgtaataggcgtggttgtatcgttggaagggatgtcctcatcatccaccatgtgcgccaggtgcatgatggtagcgtcatcctccgagctagcatcccggaaggtggcgtagtcgcgggctcctccgcgacgagggtggtagcggtagggcaagtgctgcaactcgtccgggtagcgctggtgaagagtgccgatggcgaggagtgcggcgttctggcaagcagcggagaaggaatctccacccgcggtgaccgccaacgaagtcctctcgggtgagccagtgaggatcactgcagtaacctcccaagcagcgtggggctctgcatcgtcaccctcctgctccgggagctgcttgccctggtagtccactccatgcggataccccagaacaacgcacatgccccgcagttccaaaacgaatccagtcaggtccagaccacgacggttgatgctgccggccatctacaaacaaaaacaaaagagaaaagcaacattttaaaggtcagattttgacggtaaatgaagcagcaggacagagagagactagaggattttcacaaataagaaaggatttttattttgaaaatattgctaaggcttgggatctacggctcgtcctagggtcaagggggctctgataccaacttgtcacgaccggaattgacccaacgggcgttccttacgtgcgtgtattattccttatcccaggaggcaaggtacaccaaaagttgatacatttcagagtttatcaagcggaagcgtaaatagttaatttattacatgggcggcgaaggcccagcacacacaaagacaaacaagaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttgtaatataaagggttaggttttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccgcataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatcttggctaccaggccgtagctcgtgtagccttcatttgtcctagagatgtccatcgacccccgacttcgtccatctccatccgtgtacttttgtttataaccagactgagccacaaactaagccttacccactagacatgtggaagtacggtagcgctttgcaacagaggcccgaagaccggtccttatatggccgaggtgctactatcaaaaccatgcaccccgagcccagcctaaaaccattttgagggttttgaatagagggggaggtgtgaatccaattccacaatgatccaacaattccatagtgtccaggtgatgagaatattcccaaagtctagagttgtaaaaccacctaatgttgcctaattaaccagcgaagcatctacctaaattcatactagtggtaccatgagtagagtgtccactagttggggttttgtttattctagagtgaacaaggaaataataacaataacaataataaggtcataacaaaggtaaataggcatgtctagataaaacagtgataacgcgggaatttaaataaagcgataatgcaataatttaaatcaaaataattttataaactgggattcaatatgttcaaggatgatgtgacttgccttgctcgctttcccaaccgtcggcttcaacttccacgaagagcggatctttcgaagctgcagcgtctacacgatcaacagaaaagaaaaggcttttaatctaataaactccatataacaagtaggaacaaagcacaaaaatgggttcttgacttcttaaggaaaaattagagacttgaacggtccaattccgagttcaaatggccaagttatgaccatttgaagtttatatgctctttaaatgaatatttgtgaatttcttcatttaaattttaattttaaaagggtttattgcgtcagccgaggggagggggcacgcggaccgggtccacgggagtggggcccacgcggcagcctcacggtccacggtggaccgggtgcacccgggctcacaccggccggcgccgtgggccccacgcgtcagccacacccgagggcgcgagcggctgacggccgggccccacgcggaagccgctcggtgcgcccgaaggcggccacggcggcgcggccggcgggaggcggcgcgcccgcgcccctatggtcgccggcggcggccataggcacggcggagcggcggccgagagaagggagggaaagggggaaatgaggcggcggtccacggctcaccctaggtcgacggcgacgacgaaaaggcggccggagcggaggaaggcggcggcgcggttcgggtcgacggggacggcggcgctccggcggtcgacgagcgaaacggaggggtggacgaggtcggcgaggatgcggcgaagccgaaggaggcggtgccgaggtgggaggtggtccggggcgacaacgacggtggaccggagctcggcggcgacggcggagagagagagcgacggcgcgagctcgattccggcgaggaggaagggcggcgagaggcggaaacggacggaggaggtgcagggagggtttatatagggttggaagggggagagagcggccggcggggaaggaataggtgcgggaggtccggccgccatcaatggcgccggcgagatttgcgggggcaaatccgcccgtttgaatgcgagggagagagggaaaaatggggggaaagggagagggaatcacggggaataattcccccctattgattgcacgcggggaggacggggacggcgggattcgcggcggccgcggcgctagggcgcgggcgaggcggcgggaggaaggggatgatgggtgggccccacccgtcagcgagggtggcgggcgggcccgcccgtcagcggcgcgcgcgcggggagaggccggatgggccgtggggagaggagagggagggggaaggagatgggccgagccggcccaagagggagagggagggaaaggggactttttagagtttttctttttataaaatcattttaactttgtttatttcttaataattattatttgtgttctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaccgtcctcctcctcccgtcaacggcaccgcgctcctttccctagtcggcgccctcacctggtcggcggcgcgtcctcccctcgtcggcactgtccaccccccttaagaggcgccgtcctccaccccttctcgccgcccacctccgcgcgctcgttgcccgccggccacgagcacggcccccatctggctcagccatccccggcgctcctctctcccttcctctctctccacgattgcgggtattttggtcttaaaactcctcaaagtggcaaagtatactgatgataatctatttagtggcattttatcctttgtattctaatggatggcatttttgcactcttgtggagtggcatattgtccgttttctccaatttgcccctgttctgttagatcggtttgacggtgttaattctgggataaaaagacatatataccctttgcatattgttgcagtttgtctgtacttctgtaaaaaaaaaagtcgtgcttttgcgatgtgtactcctactgtcctacatgcggcgatggctagaaacgtatcgagcatgtttgatgctccgttggtgttggtgccctgacacaagcgatcctccaaacagatcaatttaattcccggctttcatgaacaaaaacgttgcatacatcaggaagggaaaaggaaccgagaacacaagcaaaaattattccccaaatccatgaatctatcacaacctaaaaatgaattttcccagctgcttgcaaattgattcgatcaatagaacgaactgtgaaaacctactgctttgcacgatgtcaggatgtggcgtggctgcatcgccagcttcatgcggatggtggatacagcgaagtgaagcaacagataaaggccgggaatcggaggggagcttcccggcgccgacgttggtggacgacgcggactgcagcgtgtcgaggccactgggagtcagcgccgtcgccgtgctacacctccccctgctacacgtttgccgtgccgcgtcccgtacggccgtacctcacctcttccagctgaaactcaaccctgccgcccctccacatgcgcgcctagccgtggagctacgtcgactcacccctcccatggcttaccgtgtcgcctccctgatcgcgcaccgcttgcctgagcagcagtgctgcctccgccgtctgctcctccctagccagggcgttgggtttaaggggataagggatttttggtcgggagtagaacgattattttgcattttgtaaatcatttttcttttctttctacttttaattgattgaatcggagcacacctaacagccattcaaaataggggcaaaatgcaggttcagtctaaaaaagtaagggcacaaaccctaaaaataagaggtaaaattataattgcatagctaacagagaaaatgtgaaaatcgaaccaattgcattttaggatcgaataccatcctcaatctaatggcaaaaccaagaaggttaacctatgcttggagctctatttgcgttgctttgttcatgctatgccaactaagtggaattcatggttgtagcataattctgattcaatatctcatatcactcagttttgcttaagtctcctttcgaagatctttatgggtatccatctagtcagggtgtgtttaatttcacgccaaaattgaaagtttgactaaaattgaaagtttgaagaaaaaagttgaaagtttacgtgtgtagaaaagttttgatgtgatggaaaagttagaagtttgaagaaaaagttggaaactaaaccatgcctcagtttggaattggagatgatgcctgcagtgttccaaatttggataactggctaaaggaaaggaaactgctgactcaattgctcaaacaacacctcaatcgagcaaaacagtagatgaaaacttatgccggtaagaaaagaagttcaagagaatttgttgttggggaccttagtcttttgttgctaagagggcaaatcacaagctatcatttcgttattttggtcctttccgggtgattgccaagatgggtaaggtagcttatcgcttacatattcctgaggacagcaccatccatccggttttccatgtatcccaactcaagtcaactaccgtttgctggtgctgaatttcgttgttactactgcttagcatcacgcgtggggagacgtgggtagatggagatcggcgtcaggaaggggagcgtgcaatcgcgatcaccttgggaggacttgaaagaccgatttctgttgttagttttacaaagaacccatttttttaattttaggaagtctattttagacgttctcttggagagatacatctcaaattctgtttagaaaaccaaaaaaatatttttacatctcaaattctatgtagaaaaccaaaaacaaaattttggaaattgatttttgggtatcacttggtgatgctctaagagagtcatcgtgtccaattttacagttaaggattacgaataagatctaatatatatttaagagtcaaattggaccttttcctttgaagaaccgtactactgcagaccatagttcgtttattcaggtactacatttcggaactagtataaataaaacctggcctactgctgattactgattttttatagtatatgttcaaaacagaaattgttatagttacttcttttcttttttaaaaaaaaagctgtgattcatacatgttcttcaatacatatgtgggtaaggatggtttgtctagattaatagtaaaaaagaaaaggctgtcacattagttgtaatggaatgcactcaaatccaatccagtgagttgctgatatgcctcagaatagcaaggctcatcattggtttgataacatttgcatagtcacacaagctgtactacgagaatatagtcgtgtgtatgccaacctgcgacattatagaaaaagcctgtcaacctgtttagtcagtatcagaagaaaaattaaccctacggaataaaatctttaagcatcctctctgctcaacattgagcctgatatctgaacatatgacatctgagtgtagccattgaaaactgaggcatccaatctcgctagaccaattcgttgaaacatgccaaaacgaccatcttcgatgataggatcagatgcacgggctgggtcatatcttgtttggtgggttaaggatggaccagcaactggaggtagctcccaatacaaatccaacacggattcaacaagtctgctgttctggaaatgctctttgtatgagatggctttgttgctatggttgaaattgtcacgcatataacctctaactccccaccatgcatcatcctttccacaaagctcatctgtttccacagctttctcccaaaaactctttcgtctcgaccttaatcttgcttcgtcactatcccaaaagcagctatgtccaccacctgggtagaaaaaatacatgaaaattagtttttcagtgtggagggctgcctttttcagttttattgaggaatttcaaaaaggaagattataatccagctgaagaatatggtgttgcaatgtagtgttaatagaggaaaatggaacaagatagcattataggaaaaatgaaggagacccactgattagcatatctttaaaaaaaaactgcaatctggaatatcaccgactaaacttctggtatacattgatattaaatgggttcagaaaatgaaacatgatgcctgatgaacaaattaatgaagttgtggtaatcggtatcattaccaagacatcacaagttaagagcttcaagttcctcatatcagtttattgaattgtagtcataaatgtttctttcctaaaacccaacataagtaaacaaatatatgtcaagctgccagcagattatagttgcatacaaacaattataggatatataacatatcatttctagttggtctagtatgctccatcggagtaaaatattaagctgagaaaaaacataaatttcgacaataattgtatttggaagaaaatctgcacatgtttggacatgtcgagttaaaaaagaacagaaaagttcttagtaacatattggaaaccttggtagacatagtgtttagatcatgataataacaaaaaatgtaaggttatcttatatcttagaaatacaacaaaaaaaagcacaaacaaaaacatgataataacacccagaattcataatcgcatgattagaaagaaataaaataatctcaatatgcccaaaatttactttttaaggaagtcagtacaagagattgcagaagaaatataaagaaaataaggagaacattgaaaaaggaaaactgtgtcacattaagaacgttaaccattcaagaatgtcttatggtaacagaagacatcacctcatattataatgccttctacttcagaagataaacaaacctaactgcacttatactaggaagacaagctaatggaactactccaaagtaatgtgacacagctggctcaacatctatatgcaacatctgatgtatcttgattattgaaaacttagaatccaaggacaaggtgacacacctctgatgtgttcctgatcgcagatctgtcttaaggagtaatgatcgcctgtaccagtgtcataattgtcctcaaatatgatatgtcggaatccaactattgaagcctgttttaacctacataaaacaagacacatcaaaataaatttaagtttcgaaaacttagagataagagtgcactatttattagagtgaatgcttagcatgtgtcatgctgacagttaagaatttgatcataagaacagttcaatacaaaaacactacaaatatggcaatacccaacagaaaatagtttgtccacagttcaagagaaaggttgaacaatgatgatctacagaaagactttacctcttcaactcactttggtgatcatcaaagaaaacaagcactctgctgagatcagaaatgccatgattcctcaatagcttcccccaatcaacacttccgaagtcaataaaatccttcccagcaagataagtgcagttcccatcaacatatgcaggccccttcttcagatatttctcagggtgtctgggtgagagtgatataatcttagtatttggcatggcctgacgcaaaacccatgtagagtgccccttgaatgcaccactctcaatcatcagatctggcttaagccagcgagccacaaaccaaaggccaaaactgtggtcaaagcccattccatacatgttgttcttgataggtcgtgtttcatatattggtacaaattcttccagtccacgaagtagatcctttgaagtccactccactatctttccagtttttgatctgcctttagtgaagaaaaaggacaatgatattccatacagtcaaaagtgatatttcaaacaaattaccccagtatagaggttcttgtgaaataataacaaaatataccccaagaaaaactcagcactacgtagagaaacataatcatgtctaccaacagctacaaacataaatataagtacactggtggcaactaagatggtcaattgttacaggacttcaagaaacagaataatagattgccaccgcaatgttcgcactcctatctagcagcagtcattgttcaagaaacagaataatagattgccatggccatgttctcattcgtatctagcagcagtggaacaatgaccgaggaacaaatctgaacaagtataaaccaacagagatcagttaggagcaaataactataataaatttgcacatataatgtggtcatcactcatcgaacaagctatcaagctattctgtcaaatacaattcaagatttcaggtgaatatgcattgcgctcacataaagctagcctacaacctatggtgttaggtgtctaagacactaacgatgaggaatatctgcatgagcagaatcattttcaaacagggaggagattagttgcgaaagggtgattacttcgcagaaaagaaccggatgtccggatctatctcacaagaatcaacagcggcgtgagggcttacaccagggtaccccgagggcgccgaagtcggaggccgcggccgcgtccgggagagcgagaaagcgcgcgtcgagccgcggcggcgggcagtcggcgcgggggcgggcgcggccgatgaggaaggcggtggcggcgacggcgaggaggaggaggaaggaggcagcggctcggtgggaagagtggaggcgggcgtaggcggcggccacgaacgcggggttcgcctttcggatcttggactcgtcgtcgtcgtcgccgacggaggtggcggaggatgcgccagcgtagggagaggaggaggaggaggcgccggcggcgcgggctgagagaccggtgtcgtgcatggaggcgggacgggagcagagagagatcggagtagtagaaagtggcggcggtggtagaccggtggtatttggagagagatcgagggaccgaccgttccacacgaagggagggggtggggggcgtgttagggaagatgtcaacatggggaggatcttgcttgcacgggccacgcaaatgttccagtagcttttttaacgcgtgaatgataaacatgatctctactattatagtattataaaaattgaagatgtttttgccgatagttttgatacgtcatccgtgtttgaatcgttttttaagttcattcgtttttgaaagtacagatccgtttttgagtcggtttttaatttggttcgttttcagaaatacagaatgagtcgtataaaaagaattttatcttagctaacttgcatgctaacttgagatgatcggaaccctaattacagctcatgattttataaaaggaatattcaagcgaattcctacagtaaatttcaccttagttaacccgcacaacaataatcttcacccgttgcaacgcaagggcatttttctagtaataagaaaaggagaaaatccaaaaagaaaaaaacaatggacaagcatcccaatgttaaaaaaaccattgatgaacccaacttcctataaatgctactatataatcatcttatttccaaaattttatcgttgttatgtttccattaattagtagccctccattaagtactatcaaaagaccattttaccctacgaattgttaaaagctcattaaattttttcttttttagtcaacttataaataataatttagtataaagaacaacctacaaattagtgtaagcttatggaaagagcaaaaattttaattgccttttagcaattcctatgggtaaaataattttttatagcacttaacggagggctgctaacgaaaatctaaatgaaatggtgcgtttgtatgatgacatttcttggattcgtatgtttatcgatggtgtttcatggatttctctaagaaaaaacatagagtagggatatgataagaataaacatgtaaaacattaggaagcctataaaggttcgcacgctggggcgtgccacgttggattttacttttgcagaaaagcccttcggtttgtgtgtaattcaatcgagtacccagtgaaaagttcctctgaggtgtcaattcacgaataggcccttacataagttagatattgcatgcgaaggagagaaaattcacgaattaggaccgcgctctaaaacgtggaagccgagggggtttctagcaaacgacgccctaacccacccaccataatcctagccgccgccgccgctcacactctctcctccctctcgtcttctcctctccctctccagctcccgccgccgccgcctcatgccgcctccgcctccccctccccctcgtgctagagggatgaagaacgtgttttattatcaattctgacgagttaaagtaattatttccatgcttttaacatatcaatgctcgtacttagtgtgatgtgtggtgcactaaggatgtcaataatctaagttggaaatttcaaaccagttgttttatttaccaataggccacactttacacactacttgctcattgagcagtagcttatatgttggtatgttagctgaggatctcatcgttaggctggtaaatatattctctagatttgcgtcgcttgaaatgtttttgtggacaaatgctggtatttttcttctgtgcaaaccttggggccaaaacgtatactccctggttctcattatatttattgatccctttccttgcatgtttgcaaaattagcggtctattaccttccgtgctgctgaaataatgttctcatggtttgttaaaaatggtgatagtgatagggaccatgatcgtgacagggagcaccgtgatagaagcaaaagaagataacaccgtgattatgaatattctcttgatcatgatctccccttggaccaagattctgaaaggtattgcttctaaatttctaacctaagcaattacttgcaactgcacaaaatatgggtgtttttttcctttattaaatctacttatttgattgactaatgttttcctgatgcatttatttatttttatcaattagtgaattttcccctatgcgtgggaattcatggtgatgcctaataattatgaaaattaggttgtatcctttctgataataagatttaaagttaatgatatgttcgatctatctgctgcatactacactctgttgtgttcctctcttatatcgagcatcttattattagttttagaacatcttaatataactgacaattaattgctatagcaatcatgctgacaaaatcaggttagtccataattatctctgagaatctgattaaagctgccagatgtttagcatatgaagaaattcaaattctaatgtccctggcattcattctcttttgatctttatattgttcatttttttaccttctgttttacaactggatagtgcagtgggtactatattggcattgctctcggtgtactggagcattgcaactagctgctaattatctgattgactcattaatgtgtgctcaatttttcagccactgtttcttagtagaagaattggaatgtatatgtttctgaaatgaactctcccaattaacaaatttagaggtgcatccccttttaagttggttcttttgtttccctatctattaggagggggagaaacctgaattaagagatgttagcgtgtaatttccccctgaaacgtatgttaatctaatttttgtctaaatttactaaatgaattaaacgcctggcctccattacctatcacttatttggaaaattctgcagtaccctagagtgaaatgcaagcattgtgttcatatggggtttgttggcatatttcaactaaatccaatttttaaatgctacagtgctacaagaggctagaaaacaacagttgcgctattgttggtgactgacatgaatccatcgccgctcaattttaacaaagttgcaaagaagtttctaagacaataggggcttttttttggcgctgcaggctcttgcatcacccattcatctgtcattacggtttttgatgcacactgcctaattagttgtttttattatacttggattatttttctgacagaacaaatcacttcagttcccctcctgccaatgaggagtgtatgcttatacagtgaaagtattatgaggtttcatcaaggtattgtaatttgtaaaaccaatacaaatgctatgctcaataattgttttgaaattgcaatttttgatgaatcttatgctcaaaagatgattaaaattatctccataatgctcaagagaatacagatggttgtttttgtacagaacttagattttattataagctgttgtctatcgacaatatccatcattttatcagtctatcgacaatagtaggacgagctcttcagtctaaataacagttatatgtttgctgatgcgcctcttataacttttgctgccatgacactagccccatgtctcttgctcttgatcttcctttatgagtcactccatctaatttgtgtttgcttcctgatatttttgtagatgcaacaacatgaagattgaaaaggctgctgcctgcaaggtgtttgaaatcactgcctctggaatttaaatgtgtgaaagtgattgaatagttctgaaaatttatccttgctttgctagaagattgaatgggcggctattggaggaagaagaagcatgctacaggggtaatgacaaaggtagcagggtccctcttttgtgctcatggcatgtcaatttatcctttctgttgatttcgtgtctagaccagaaattttttaattcctacttgaaatcatgctaaaatggtttggtatcatatccaagaccaagcttaaatcatcttgtatatggtttcatcctacatttgttgctatgaagagtcaacacaaatgttgatattttccaaaaatcaactgaagcgtcgactctaaaatcaagttctagaaaagagtaagaaggatgtgctccgtcaaataatagaactgtaaactatagaaactagaagtcttaaggacactacactaaccctaaagtcactcgtcatcataagcaaagtgcaaatattgtctgtctggagtctggactcatcatttaggtgctctttggcagggcagcagctgtatgtttcagcttttgagttgtccttagaatccatctcattgagtaagcgcacttcaattgaaatctataactttctcgcattctgggaagttcattttcttattgcctgcaatttttgtagcaactacagatacaaccattgctcacatcatgaaagaacaagatgatatcaagatcaaatcctccaagtgctggaatcagattcggccacctgctacactgctgacttcaaacggccgccgaatctgcatacgacctccgttttcggcccatgagtacttgatggaaagccctcggagtcctctttccaacggatccagcctcatcgccaaacttcgtctgggaccccggcccaagtggggcccatgtggggtgcgccccaaccaggtggatcatgaccctagggtccctttggtcatcctcccacctccttaaatagctagctaccccttcagggtttctcgggttttgttagattaaagtttagccattactacttgcttgcagcacgcgtgtcggctagaccgtccgtctgcttgttcttcggaaccccaacttatcatttgtattaaattcctatttgcaatatcagattgtttttatcttggtcttgcttggttcttcgatttgcttgcaggaatagtgttg

SEQ ID NO: 70872 - DNA, 28766 bp, Oryza sativa
ggctgctatggtggcggttcgggtggtgtggtggagtgacggttccagcggcggaatggaggagcggaggggatgccggggtacgacatgacacagcgaagccgtcggtggcggttgcgcggagcggtggtggcgggagcaacggtggcgaccggctagagggcgtcgacgggcggcggagctcgggcgcgcgttgcggcagtgtttcggaggcggagacgggaaaaggagtaggggccagggtgtggcatggcacggcgatgcaaatggtggtggcggcgtggcgcgacggcgtctggagcggcagtggcgtgcggctggaagcacggcggcgagcggcggagctcgggctcgcgcggggagagcgggagaaggcccgatgggctcaggaaagttggggaaacgagcgaggggagtgtggggaggagttttatgggcgcgggagggcgacagtgggctggggcgatgcggattcggggcggcaaccaccggcggtgtggggtggcgacgtgggcgcgtggcggggcaaaccggtgccgttttcttggtggaaaattggtgaaatggtggaagaagtggtgggggtgcagttccaccacttgggcgtgagcgggaagggctgggtggtgcggattttgcgacggagtgggcgacaatggcggccacgggcggttgctggcgaggtggctggaggaacggggaggagatgacaggtggggcctagggtccacctgtcggcgagggaaggagagaggaggccggggggcttatgtgtacttagcgaaggaaaggaaatggcgagtgaagcaaatcgggccgagcggcccaaagaggagaggggagggaggctgccgggctggagggcaaagaaggagggagagggattgggccgagggcggcccaaaaggaaggagagggaattttcttttttttctttttatttaattgtttaaatgaactttgtgactttaaaattatttcttgagctccgaaaattcgtggaaaaatccggagagtactttagggcacagagaatattgcaaaatatttctggccaatgatttttatgggaaaattttaagtctaccattatttcacttgattaaattgctttaacttttatttaatttatagaaaatgatttattaattgatttttaatcccgaacgaaatcgaggtgttacaaatctaccccccttacaggaatcaagtcctaagattcgggtatggttagaaagaaagctgggtgtaggcggtctgatcgatctggccgatctgcacactgcattgatcccttttgttttaaactgactgatggactgaccaaccagcataacttaactgaactgactggcatcgaccattctattcttttgctcaaaacaaccgaactgactgggattcgaccctggagttctattgcttcgcaaaacttaattgattagctctactcgatctgaccctgacctgaatcacgagggctcatggaacttcctgtccctgtactgaactgctagcattatcaccttttggtaacctgagagctcaccaagcagactagaaattggcagatctttcatgaaatcttgtatgtgacctgcatgaatgacagattctaactttactttgacctgctcctgactaccagaactattctaagaggctgcttgaccggtctttcgtctgaactgcaactgtacctgatgttacttctctgatgtgaattgttgtcctggcctcacgggtgtatcttagaattcaatcggatgacttgagatcggcatgactctattgacaccttgtagctggcttcttcgagtactacctaaattgttgtactgggttgaatctttaagggaaatggcgacgaggtgaaccaaaattcatctctgcgacctaccccccttacagagagtagtcatactttcgggtgaccgggaataattgaactattgtccttcaagaacaatcgacacttctcggatttacgaatggccctgacattgaaaacagaaaacttcatcgatcaatcaaaataaagcaatgacgatgcactttcatccaggtcaaggcttggaacttaaccctcagttgctgataggaaattccacataaagaaattctcatttagctcttgatcttactaactcttgactacttcccaatcagttctactgctggcatatttagcatgcttctggcctgacttcggtgtcatatgcttgaacagattgcatagtcgacattctttgaaacacatactgaccacttaacagatcaaactcaagagtccttctcatgacataacatcacacgtcgattattcttttgctgactcttcctgtattgatgaactgtaaaccctgcaactgctttcccaaaaatattgtaatctgcacggctgccagaaactgactttgatgctgtcgagagtttctgttctttgatcataacaacttcgctttcatatcttcggtaaagctgatctgtcgaaaagaggttctctgccacacaccctgctgactacacatttctgaacctgattcttggatatttcttgcccatgtatggaacaatttctgccaacttccgagaaacatcatgaggatttctagaattcgtagtggttccttcgaacatatggagaaccatccatgattcataatcgtaccactagggtgtaattgttgcttaccattctctaacagtttccaagggtagagagttcccaagattccttgtatgatgttacttctgaatttttttttcattactccctacacttgaatacccttgatactacctttagagagatttcatagtgtcgagcgctatggatccaaccattgtcacttccttggttaatcctttctttactcgctcgcaaacaggttttggagcacaacaaaagtgcgatgagttagaagggaaactcttggtttcttgtaacttgcagatacacatgttaacttgcttttgcatactcaaaggtgaaaagaagagaaacgcttgactcctactctattcaatattcccttttcaactatatcactggattggaacttctatgcacaaggaaggtatttgaacaccaaaggcctgtgcacaattgttgactcttgctgacagaactgctgatcagtagcacatttacccattgtgattctgacatggttgacttgtccttttgttggttactagctgaagctcccacaagaacaaaactttgactgatgacgttcctaagacaaacatcaatcctcttggtagctaaaaggaacgagaccttctcactatcggtgcaactcttctgttaatttcttgcgagacctctgaattggagcagtatgagatgcatggctgatgttgacaaccacattgaagtctgatgcttgagacattgattgcagtcgctgctgaagaattgagccgtctctccgtagctaaagtagatcactgatttcctggcttcgtctgctctgctggtgctgattctgtaatcttgaagtgattgctagagaaacaatagagaccttgtcagtgcacttaatgacaattcatcatgatggaaactttacacccaagtgacggttggtagtacttctctttctagggtctttggactggatctgaccacttcatacaggaactgatgtaacttgaggagacaaaggagttttaaccatgttgctgacttgatgagactgacgctttggcgctgaacaaccttttgagagatgataggtcttccaacaattggaaacaatggtggactatctttcttggtctcgagagtagaccattactgaggtggtgtcccggctcaaaacgattgagacacttctcacttgatggatctttgatgtgcactcttcccgctgtgcatgctcccaactgaaaccagagtagagaactcataaccttggtgacaatgttattactatcactgtgggttgccactgcagatggagctaggggaagaacggaactattgctactgctgttactgagtgccataagttgacgaacaggttgcaaagttgtcttttggtctctcattgccttagctagtaccaaactcaattgattatccttgagcacatggtgcattccctcacacaagaatcgtgcatcctttctctgccaaagactggactgcagtgtaccatagtttttgtaagcaagctaacctggacatttcttctctcctgggcacagtgccctattgtcggtcgttttgacaaataagtccaatgggtgattgaacactttgtaagaaactgcccttgtacaccataaccaccgtgggtagcacttgctgcttcagggatcgatggtggcttagctgtgctggtttcctcaggacacgactgtacaccggcaggggttgtaggtgcttccattggacaacaatggcgttgactctgactccgactccgggcttgcacctgagcttgtatctattgttggggacactgtcgttgcatctactgcattggactctgcggtggctgcatcaatctatgacacattgttggtaattcttacggtcacagataaaatccgcaagcgcacggatataccgatgtagcacttcgcctacggagtattccaatggtatcgaatccaaggaaacgtgtgtgatcagatcttcctccggttaatccaaggacaccaagcaaatgataggccaggatatacaggattttctagtgagaaacagtgtctagggaaagcttaactttaatcctaatgcaatacttcaggcactggcaatccgctgttcccagatgtcgctctactatgcacccggacaggaaggacttaagtgatcttgagggttgtcaccacctctacacctacctcaaacagagtgtgggatacgcagccattactatattgaatattatattgaattcagagtaataaacagaggagaagattaccgacaactccggaattcttccgacttcttctactctactctcttcctattctagtatacaatatagtacaatagagcctcttataattcagctcaagcttggaagtgtgtgtgtgtgaagtgagggagtgatgtccttttatagggcagttatgacggttgtgagaaggggaaatgtccgaattgtcccgcaaccattattgggagagcatctggagcgtccacgccaaaccctaggatcaacggtgatcggggcggtttggccgaacctgggctgggccctcctagcctagccttcggtcggtggactccctagactctcctctgtctatttctcggagttttgggttgatttactgatgttttgatgaagttcacaacccttccttgtatggatacataattctcactttagtctagatttcctcccaacatcagggtttatcatctgcatacaaatatacaccaacacttgtggaatatgtgagattaagcacctatcactatgttggatgttttattatctaaactttatgcagatgggatttttataaattttcgcaaacaagctcttttcctcatgttgacttcctctcttgtctctcaaggatgtatattttctttttggatcctcaatcaaggcaaagtgtgccaaaatctaccctattctaaggctgatatgtggagcttggtagggataaattgtgacatacttgcatcatatatatattgtaaagctaaaaatacggactcaagaagatcatcaatcatacttctagatcaagagtctttatttgtggtgaaaaaaaaatggaaaagtaaaatcttttgtggaataatggaaatgattctcccctttttcctatacttcctcctcccttttgttttcttggcatgaatatggaaggggcatggctatattttctttccaactttgctcaatgatttgggagcaagcatttattttcttcttcttttttttatttttttttcatagtcatgcctttcctccccttttttttcatttttctttttgccgagaacttttttaggagaagaaagcatagtctaatgtagaagtttattcgaatggaatttttgtggaaaaccaacttccagtttagaagcttagcttaattatatatgtggagaaatggaaatggaaatgaccccttgatcatgggagtacgaaagatatctcacacgagtcacctaaatttaacaaagctcaatataatgtcaagcagtcatatgcatgataaggttcatcaaagatatacttgcatatggccttggtaggtataaaatgaagtcaattaggaggattgtgctttttaaaatgattttattttgtgaaaaataatttcccaagagtcataacaagagttacaagagttcccttcatcttgaatcatctcgcataaagcaattacttagatgcataaggttccctaaacatggatggttgttcataagcacaagttcggctgagaataatgaatatacaagatcaatcacatgaagaatttcattagttggaaattttatctttcgcttatgcttgaaccaattgttttctgaattttcagctcaaatactataccatggtggagatatacagataaaagacgtgctctcctgcttacctgtgaaaactgggaggtattggggccaacactggttcggccgaactactctggtgcccaatacctctgcaattttttgcagagttcagtgccttccaggtgtttagacattcagtaattttcagattatgtgcacgtcagaagctgtgatatctcccccatacttattaaacatgaaacaaaacaaattttgacaaacattggggttaacaccaatgagctacattattcatagcaagtgcttatatgattggaaaaacaaaaaccaagcacctactactattttactcatgggaaaggaagcatctagttagcataatacttattttcctttcccatttctacgattgcgcgcttgattttagcgcacaaaccgtgactaagggtgtcgaaattatttctaatttcagcaagctttatccctagctccgcgttgcgatccctaatctctatgttctctttgtggattttcttcacttgtgcgcgagcatatggatcgagggctccggcgacttcacctcatcttcttgatattggccgggagccctcacaattggagggggcgtcaagtgatgcttaaccttcataggtggaggtctacgggattctgctgccccctccttctcctatgtcgttaaaggccggagtaaacccttgccatacccaccgccgggagttcgcactccctgaatgcagaatcgctcctccttcggagtggatggagtagcggtgggtgtgacatacttatggaacacctcattccctgccttggtgaacagggtgcccacatagcgctcggcgggaggcggcgcggccttcccgtcatcttgaaaaaggcaacgtgcctttaaaagaccgagctctcccgttgtcggccgacgcgcaggcgaatccccccgaaattttgtctttgtgacatggcgaggggagagggatcttgctactgaacggggagccgaacggggctgagaagggttcggccgaaccagggagctcgccgacgggctccagaatcgcaggggagcccgacactgttgcgaggggctgcgcccacagtgcattcaccccttccatggtgtattgctctacagggatcaattgattcgccggtgtcggctctccgtcaaggttgtgtgtggagttggaggaagagccaatgaatgggatcaaagatttgccagccattggtgaattagaggtgatggagaacggaattgagatgagaagaagaggaggtttgcaaaagtgggagagaggaagaagaacagggttctgggtctgatacgactgatctacctccgaatgcgcatcacaacatactatagacaagcgggggagactgaggttcaaaattggggctgatcgggcgcctgtcacaccctgaaaatcgctaagttataaatcgttgtgaaaaaaggaatttttagaaattatttaataattaaagtaattgtgtgaataaaatctatgaaatttttgaaagttaaattgatatagataaaattttattaaatactttgtgtgcccaagtattttcaggatttttcttggatttatttgagcattggaagtatttttaataaatgaaagatcatttcagtaattatttaaattaaaaagttgattaaaatttctcttctgtccactcctctcctgtctctcttccttagcccgcagcagcccactcttcctttttgtcttacttagataaagtccattttgggtccctcttgcaatcaggcctagtaaagaaaaggaagcccgaaaagaagtctatttgacagagccagttcatcccgataccgcgccaatctccaccgaatccgtcgcatcccgtgctctgtttccaaaattggttgcaaaaacggattcccctcgatctcctctaccttgtccctaagaaacccctttgaataccgttgtatatcgcgtgaattcgatgcggttttgagctccgtttttccggcgaaccctaactaatccgtcgccgattcttcccgtaaccgagccgatctctccctcttccggctataaatagcagtcccaagacctcctcttccgtttgctcctttttcccgaatttttccctaaccctagagccgccgccacgctcggctttgctctcctatgctggccgccgctccagccacgtcgcgccgcctcctcggtcgaccccgacctgcgccgtcgcctcccttggcttcgcaagggtgagagctacctcggccactggttgttttgcgccaaatcccaccagaaggttgccgtcgccgtgaaccagtgggttattgccgtggtttggtctccagccgtgtcgttcgtcgtcgtccatcgtcgctttcggacgccgttgcttccactggattcgcagctgtgaggagaagcccgtccacccctccgttgccgccgcttgtcgccggaaagccgtcgccatcgtcaaccaaggtcgccgccctttggagctcatcgccggccatctccctcgccgtctgtcgtcgcgtaagtggtggtaagggccgtgcttagaaatattagctcattaatgggataaattatgcttcactattacttatggttctattaaatggtagctcacgatgggcaatcgtgttatgataattaattgataattaaaatatgattaatggtgggttgtgagcacatggttttgaaggttgtgctcataacaattaaggaccggttcgcgagctactgttgtgaaacattaaccgtgccaaccacaagccagcgtgggcaacggctttaccttttgtatagtatggttcattacggggtgccagactgagaagtggtggagataagcccacgggggtcgctggggagtccatgcctctggtttttgagggggtgactacgatccaggaaagatgcactgctttgagttgagctatgcgagaggtcttgtcacaactacacaaatggtgacatgttcagcatgggcacatgatgatatggtgacatattgtggagttgtgtcttgtgggtacagtggtacacctctggcttgagtaaaactattcgaatagccgtgcccgcggtcatgggcgggtctaacaatgtctttcgtgattagtctcatacttcttaccataataaatgatgctataactggtaataatttgattagctcctggtttggaatggtgcattcctggtttggagatagatctttacagccgggtatggttgttcaggttggttgggcctgtgcagcatgggtgtgctgttcagtgttgattaatattgatgattaattactctattcttttacaattcttaaatgtttgctaaatgctgcttttgcaaatgagccatatattttgccattgtttggtatccttgtgcacctgcatatttgctgtgtggcttgtcgagtattccatgtactcaccttgcaataatcaatcaaacctcggttgaagacaagttgcgaaggagaagacgtttggcttataccctagttgagctgcctgtgggagtagagtcggagcttcgctagaccgtaattccgctgttgttttctcttttcttttgtaagtatgtaacgttattattatgatgaatctgtatattaaattatcggtttgtgtacctcggctgattcctggacgaggatttcatgcacaaattagttcagaaattactagtgaatttatgggcgtgacaagttggtatcagagccatctcgactgtaggataagtcaaatggtcaaactttaaggaggaattttccgaaaacatgatttgtgaaaattttcctttcttccttctccagaattctctgtaaatcattttatcatcctctcccctcccgctttcaacttgagtagttctgaaactagttgtttaaacttgaagacatcgatgtggtcttcttatggagattgagtcaagtggatcgaggaaaatgaagttgatggtcaatctgaagtgcccaaatgtcaagatgggatcgtgcattagaacctaaaccaccaaagtgactctaaagaatagttagtagggtagaacgtttgttgcttgcttctttgtaggtattgttgcatttcccatcattggtgttgttcagcgatgagcatgtaacgatactaggttgcttgtttaatcaacttaaacaatataatggtctacatacaccagattagtattaacctggttaaggtctgtctttagtgtaacccctctctttctatcttctctaatctgcaacaaatggtgaacattcgcgccagtggaagtgggaacaataacaatgaagggaacccaactcttactcaagttcttgctcaacagactcagttaatgaacatgatgatgcagcagatgcataaccagctcaaccaagggtacaacaatgctccactaccccggagcaagctagctgatttccttcgtgtgaggccacctaccttttctaagaagcaggtgattggctgcacactattgagaagaagttgaaattgctccagtgcactgatcaggagaaagttgtattcgcttcacatcagttgcaaggatctgcttcagaatggtgggatcactttcggatgaacagagcggaaggacaaccaatcacttgggaagagtttaccgaaggattcaagaagacacacatacctgcaggagtggttgctttgaagaagcatgagttcagggcattgaagcaaaaggatcgtaccgtgatagagtatcttcatgagttcaaccgtctagcacgttatgctctagaagatgtgcgtactgacgagaaaaggcaggagatgttcttggaaggcctgaaggatgaactgtcagttacgttgatctctcatgactatgctgattttcagcagctagttgacaaagcaattcgattggaagataagaagactaggatggacaaccgtaagagaagaatgactgttttccaggaggcacagggtagtagccagaggcagcgtatcaagccactccaagttggtgaatcaggtctgacatctcaagaacaatcgcaacagatgaacatcggtggtgagatcaattcagagactaatgcaagcaatgaagttaatatcgagcaagctactcagtcggagccagttcagcaggatcagtctcaagaaggtaatagtagtgcaagggagcagcgggtatgttttaattgttatgagccaggtcacttcgcaagaaagtgtccgaagccaaagcatcagtagccgcaaggtcaagtcaacaacattgtcgtcacaggagccaatgcagtgccagttgcgtcttcaagtgttacagttcagccaccagtctcaaatcagcagtagttttctttaaagccttagaataattatcggagttatggaataggatagactgtagtttagccgttccgaatcacgggacgagattctttgtaaggggggtagatttgttacagcctaaatttccatttcaggatttataaattgttaatagaaattatattaaatgttcattaatttacaagtgaagttaaatgtgggaaataaaatttcctaagtataaagcatggctggatttaatttttattaaattctctatgattaattatactctctggaattttctcgaattttccagtgctcaattcctaaattctaataatacaaaaaatatttcagtaattcgttaatcattaaattaatcaattaatgatctaattataattatgttaaatgattttcttgtttaaaaatccttaaattataaattgttgtttaaaaggaattattagaaatgatcttaaaagcctaaaagagaatttctaattttaattctctaaatatcaaaataaaagtgggctagataaaattttattaaatacttctctcatttctatagttcctagatttttctgggatttatttgagcaaaggaagtatttttaataaacggaatatcatttcatgaataatttaaatagaaaaaggttttaaatctctctattggctttgggccgaaagtcggtccaagtctctctctccccggcctgcgtgtgctcggcccagccggccaagtccgccacgccctcccttctctctctcagccgctgataggtggggcccacctgtcagtcgtcttcaacctccggccgctcctagccgcgttgcaagccgccgcctccttccaaaatccggccgccaccttccttccccggccaaatcaattgaggggaaataatctcctcgatctcctcttccttttctcttttggaaacttcggctaatttcgtttggaaaccgacggatttgagctcgattcggatcgatttttcttcctccaaccatagctttccttctcggcgccgatcgccgtgggcctccatcgacacacctagacccctatagaaggacctccgggacctcctctctgcatcaccatctccaccttcgactgccgccttctctagcgtcgcctccgcgtggttctttgtatcgccgccgccggcgggtctccagtcggtcccgctgtcgcttcggtcatcgccgtcggtcgccgtctccttcatcagcatcgcgatgtcgtcgccgtcctcgtcccgtcctccgtttccgccgcagatcatcggagcgccgccggcaccgtcgactcgaagctctccaccatcatcgtcgatccagccacaccgcgccgccgtctcagccgccgccttcggtcgctgtcgccaccgtcgagatcgcaaggaggagccgcaccttgtccaccccttcgttgccgccgtttcccgccggagcactgccgtcaccactgactcgaagaccgccgccgtctcagccgccgcctttgtttgccgtcgcccaagtgctcggtgagttcactgtgccgatccctacctgttggtgccctccgtttgtgctgacgagcatagtgtgccgagccgctgtcggcgatgacatcatcgctgatgtcagcgctttgtcagccgtagacccgtggtagaccggatcgatctcggccgtccgattcggtcaagtttaggtcaattagatcttggccgttggttccgtggaccgcttctgtgaacccggtttaccgtggaccgtccttgatgacgcaataaatctcttttccttttcaaaaataattctttattgcgccataattcaattaaaatccatataaatgctttaatgcggtttattctttagaaattcataactaatacattgtaactcggtttaatgcggttcaagttgcaaaagttgtataaaataaagatctatatattaaaattatcaataaattgtgttaaatttattcaatcctttttaaataggctttaattatatttaatcttgtaaaattggtaattaattcttatgaagtcagaatgaggccgttcaagtctcataattgatcaaaaattttgatctacatgtttgtttactttatatgtattgtttatttggtttttattagtcttttttctcgttttgcgtgttagcttgtcgtttccgtcgttttgaaggatcgtgagtgcgtcggaagtattcaagaagattaattgaagaccctttattgcaaggcaagtcacacagatcccaaacacaattcctttgagcatgttgatcctatatttaaattctctatttatttcaactgtacatttattttcgaatgtcaccggctggtgtgaaactattcctttgttatggccactttgcattgattactctatcctttgataccttggattacaatttgactagttgtacttatataatggttcaactagatgtattagatgtaattgcttagccatgcttagaaacattagcacacaattgggataactaatgtttcactattacttaatgatggatatttaattgtatctcacgatggttaatagtgattggttaattaattaatttgccaactaaaacttgataatggtgggatgtgagcacatggttttgatagtagtgctcatgacaattaaggaccggttcacgagtttcggttgtaaaacattagccgtgccaaccacaagccagaatgcgcaacggttggacactttgtatagcaaggctcattgtggtgtgccagactgagaagtggcggagataagcccacgggtgtcgctggggagtccatgcctctggtttttgagggggtgactacgatcctggaaaggtgcgctgctttcagttgagctatgcgaggggtcttttcacaactacacaaatggtgacatgttcagcatgggcacatgatgatatggtgacatattgtggagttgtgtcctgtgggtacagtggtacacctctggccagagtaaaactattcgaatagccgtgcccgcggtcatgggcgggtctaataatgtctttcgtgattagtctcatacttctcaccataataaatgatgctataactggtaataatttgattagctcctggtttggaatggtgcattcctggtttggagatagatctgtacagccgggtatggttgttcaggttggttgggcctgtgcagcatgggtgtgctgttcagtgttgattaatattgatgattaattactctattgttttacaattcttaaatgtttgctaaatgctgcttttgcaaatgagccatatattatgccattgtttggtatccttgtacacttgcatatttgttgtgcggcttgcggagtattccatgtactcaccttgcaataatcaatcaaacctcggttgaagacaagttgcgaaggagaagacgtttggcttataccctagttgagctgcctgtgggagtggagccggagcttcgctagaccgtaattccgctgttgttttctcttttcttttgtaagtatgtaacattattattatgatgaatctgtatattaaattgtcagtttgtgtacctcggctgattcctggacgaggatttcatgcacaaattagttcggaaattactagtgaatttctgggcacgaagattctattgtctacaacgaacaagatcgcataagttaaaaatgcatcggcttgtagttgataaaattaacagaaggtgagaattttaccagtgggacatcgtcagggaaaaggtttgtcaaatacatggacggtgattgatggaacaggtgttttttccattctatccaccatcggtcaaaggccatgctcctgaatgtccttagtttgatgttgtcaatattgccaagaggtggtcctggtagattcagcagccaatccatcatatggaatgatgaaatctctcctctactttgaatcctgtcggcaaagaataggctaattggcagttgacccatgccgaattgccttgcagcgcttgttggatgatagaattcgtaggtcatctggatattcttatcttgatagatgccaacagggatgatacaggggctgatagctgttgagaatacttctctggatttatcatatttttcagagttgatttcatcgaatcgaaaatcacatgttagttcaaagctagcagatccttcatatgcaaaccagatcctatcattcttggggaacccatcatagaaattgttgaaccactccttgaaaggttcggtcgatagcttggacacggcgctaaccgatgctgcttctccgaaggacatacatcatcagcatgtggtgcttgtttctccatcgtccctgacgatcggctcaaatcttgggaattctacattggctagtgctggctgattggcaacttttctggtatgaagattcagccaaatttggagtaaccacgatggaccccctgtgccgattgtttttccagaggctatcttgtcaattgcagtattgagggtctgatacaagtagcccagcagatacttgccaaggggaaaatgcttcttttctaccagattttcatctacccgttaccagtttgcggtcggaccataggttggaccacagaataagaacttttccagccacatcataagaaaagctgtgttcatggcaaccggcccagtcacatcactcttggggtaaccggcctagttcccatcttcttggcaacataacctgaccaaccacctatgcttctggttttgaactcatgggtaagttaggtgttcaggctggacaagttagctgatgaagtgatatctagaccagtgatcatgatgatatctaatagtattggggtcatcggtccttgagagaaaaggaacgtgttcatggctgtggaccaaaaataggtggatgctatcatcatgggttcattccttgccatacttgctgcagttaaggccaaagcttgcgatatgtcgatttcgtcccagtgggctaatttgctagccaacatcctcttgtaccaggcaagccagctgacttcggttgatggccaggatttgaaggtgcctttccaagggctaagatctggattggcaaatctaaaggggattcggttggtttctccattgatgaactctatggggtctaagttgccgattgggccaaggaaaaactggaattcatcggctacgctaggaattgcaacctggtgggtgagatgctacagaggaggaaaatcgaggattgagcgaaagaagaaccaaatctatgaggaaaagaagggatttagctgatgggtacttacttcgacgtattcggtggccgatgagctcggtggactagcgaaggttgacattgtcgttggcagagattggaatcgtcggaatcgtctgcggatcgccagaaagcttgaagggtgtcgccggagaactcaaaggagaatattggggaaagtttttggctagagcggttaaaacggaagtgacgccgtgaaacgagaagagcggtggttactatttaaaagggagcgctgtaacggccaaaacggaatcggtttttgaaaccctagatcggctcggaaaagaaatttgagaaaatccgccacattacaaataattacaaatatagcggacttggggggcatgtgttgacgaccaaatttggtaagatatgaaccaggttcgacattggaatcgaggcggattcggtaaagagatagattcgaagaacagagtatgcatcggctgcaaaggcatcggctggagtctgcatcggctaagatggatcggacagaggacatccgatacagctgatagaggtgatgtagccgattctgatgacgatggtttcaaggatttttctagaaacgatcaaagtgcttcacgaggattgccacgatagagataaagctcttggataggaaattgtatctattaattaggatatttcatgtaatttccttagagatatgtttgggcaaaagtctgccgcaaagacttatggtattttagagtttgttagagataagtgtcgtgtccggcagggacatattttgtaatctcgggtataaatagaacccgaacccatgtaatcaattatcagacgatcaatacactttcggtgcatcgccaccctttttacttttgttctatttcgacgagttcttactttcgggttgagcttcatcgattcgatcttcaactagaggtaaacttgtcatgacggcttgcgttatcaggattagtgcttccatctttatgacactctaatcctgttcatgtaattcatcgagttatcataaatataatctttgtgagcgtgcgggccgacgaggcggagccggaggtggctggcgatgggtagaggcggcggcgctcctcgaggaggcgaagcggatggcgctccggcggccttccgcgagcgggaactcgcggacagcggccggaagaacctggagaagaagacagggagtttagggagcaaagaacaggcacggcgccgagggaaatgttagccggaagcggcaaggatcggcgaagctcaccttggacggagggaagcggtctctcacgatgattcgcgaggagggagggctggacgggctacgcacgatgactgcggtgccgaggaaggcgacgacacagcgcgaggtggtcgggaacggcgtcgagaggcgactagaggtggctgctatggtggcggttcgggtggtgtggtggagtgacggttccagcggcggaatggaggagcggaggggatgccggggtacgacatgacacagcgaagccgtcggtggcggttgcgcggagcggtggtggcgggagcaacggtggcgaccggctagagggcgtcgacgggcggcggagctcgggcgcgcgttgcggcagtgtttcggaggcggagacgggaaaaggagtaggggccagggtgtggcatggcacggcgatgcaaatggtggtggcggcgtggcgcgacggcgtctggagcggcagtggcgtgcggctggaagcacggcggcgagcggcggagctcgggctcgcgcggggagagcgggagaaggcccgatgggctcaggaaagttggggaaacgagcgaggggagtgtggggaggagttttatgggcgcgggagggcgacagtgggctggggcgatgcggattcggggcggcaaccaccggcggtgtggggtggcgacgtgggcgcgtggcggggcaaaccggtgccgttttcttggtggaaaattggtgaaatggtggaggaggtggtgggggtgcagttccaccacttgggcgtgagcgggaggggcggggtggtgcggattttgcgacggagtgggcgacaatggcggccacgggcggttgctggcgaggtggctggaggaagggggaggagctgacaggcggggcctcgggtccacctgtaggcgagggaaggagagaggaggtcggggggcttatgtggacttagggagagagggggagcgagcgggccgagcggcccaaagaggagaggggtgggaggcggccgggctggaggggaaagaaggagggagagggattgggccgagggcggcccaaaaggatggagagggaattttatttgttttttctttttatgtaattggttaaatgaactttgtgactttaaaatcatttcatgagctctgaaaattcgcggaaaaatccggagagtactttagggcacagagaatattgcaaaatatttccggccaatgatttttaagggaaaattttaattctcccattattccacttcattaaattgctttaacttttatttaatttatagaaaatgatttattaattgatttttaatcccgaacgaaaatcggggcgttacacctggccattcagaccgggatcagaccgccaggcccgctgccggctgtgcacagcccttgcacaagccggcaacccccacacaataaaatccaacaaaaaaaatttttttggagcaattttgaaatgtatgagttgaaatatttcttatcatccataataattgaaaattatgaagacttgcaactaaactcacttaagtgctaggaggtgacctattatggtctatagggtttttttggctaaactgattttcaaataacttttaaatgatttggtttttgaaatagatttgaataccaaaaacatttgaaaccttctcctctaccaactttgtttaacacttttctcaaattcctcctcaaactcattttgaagataaatcccattttggccaaaaataaaaatctagtttcttcaaaagaggaccaaaagggcattttcattgaaacttcatttttcttgcaatgtgaggcttggaaaacatatggggaaccttttgaaatatttttcaagagatagttttcaaattactttgattttgcaaaagttttgacttatgttgacttctagtttatttgctcacacacaaagagagttagagcacatgtaagagtgcaaaactcccccttaatgtgacatgctccattttcgcaaataagagccaaatgacaataaatccaaagcataagcacaaataagagcaaataggcaaaatgaacaagaagcaaccatcgtgcacaatctcaagccacattagagaaatcaatcacatttaactcattcctcaatttgcaaaagtgggtttcatcaagaggcttggtaaagatgtcagctagttgatcctcggttcttatgtggctaatgactatgtcactcttggcaacatgatctcttaggaagtgatggcgaatgtcaatatgcttggttctagaatattggaccggattgttggctatctttatggcactatcattgtcacataggagtggggttttggtgaaggatataccatagtccaacaaggtttgtttcatccaaagcaattgggcacaacaactacccatcgaaacatattccacatcggcagtagagagggctacggagttttgtttcttggatgaccatgacacaatggatctaccaagtatttggcaactaccggatgtgctctttctatccactttgcaaccggcataatccgaatcggaatagccaactagcttaaacttagtacctttttgctaccacaagccaatagttgaggaatgctttaaatatgttagaatccttttcatggccactaagtgacactcgttaggagcggcttgaaaccgtgcacacatgtaaacactaaacatgatatccggcctagatgcggtaaggtaaagcaagctaccaatcatagaacgataaagctttaaatctaccggtttacccccctcctcctcatcaaggtcgagatgcccgttggttgccataggtgtcttgatgggcttcgcatcctccaagccaaacctcttgagtagatccttgatgtacttggtttggctcatgaacgtcccgtccttgagttgtttgatttgaagttcaagaaagaagctcaactctccaatcatggacatctcaaattccctagacatcatatcaccagactccttgcaaaatacctcattagtagaaccgaatatgatatcatcaacataaatttggcaaccaaagaaatcatcaccaatgatttttgtgaaaagggtggtgtcaacttttccaattttgaaattctttgacaaaagaaaatctctcaatctttcataacaagctctaggagcttgttttaaaccataaagagcttttgagattttataaacatggttaggatttttagggtcttcaaaaccgggtgattgttcaacaaagacaagttcggcaatttcaccatttagaaaagcacttttcacatctatttgaaaaagttttatatcaaaatatgatgcaaatgcaagaaggatacgaatgggttcaagtcttgccatgggggcaaaagtttcaccgaaatccaagccttcaacttgtgtgaagcctggcgccaccaatcttgccttgtttctcaccaccaacccgttctctcttgcttgttcctaaagacccactttgtccctatgacattgtggtctctaggtctttcaaccaaagtccataccttgtttcttgcaaagttgttgagcttttcatgcatagcatttacccaatccggatcaccaagagcttcatctacatgttttggcttaagacaagaaacaaacaagtaatgttcacaaatcgaagcgacacgagatcgagtttggacacccttactaatgtcacccaaaacctcgtaaattgggtgatccttggaaagagcggtgtgtatccttgttagcataggtggatcttgtgccttctcctcctccacttcaacttgagcttttcttggcatagcggaagtagataactcatcttgagtggaggtagatggcttgttttccacttcaataggcttgacatctccaatagacatgttcttcatagctcttatcaagccttcatcacctacatcatccaaattcccgtgcccctcttaggagccaatagtctcatcaaattgaacatcggcggtttcttacacaataactttgttcttgttgtagaccaggtatgccttgctattggaggcatatcctagaagaaacccttttcatcacaccgactttcaaatttggttagtctaacaccctttcggtgtgatgaaaagggtttggccccttgatgctggtgggggagtactcccacccaccaaaactagccgttgggggcgaaatcccccaactctatgtactgccggtctgaccggatgtgtgtggccggtcagaccatgctactctacaacggctagttttctagccgttgtaggctgtcattgggccccatcggcttggccggacagactggagttgggtggccggtcagactggcctcggctcggtcagaccgcccccagctcggtctgactgaatgcggctctagatcgccacgccgagagcaccacagggagaggtccccttggctggtctgaccggcattcacccgtcggtcaaatcggccgacctacgccggtcagaccaccactaggcggccggtcagaccggccttggtcacacagcaagcacaacaggaaaatgagacaaagccaaatctaaatgcataataatctaatgtggcaatttaaatcatctctttgctaggtcattacccctcttaatagtacagtaaagctataaataaactagcacaaattgattgaccaacacctcgatcgatttagaactcaactactagtttaccgtcatctatactttgctttgcgccatcaatttttagtccatcgataattatccatgcgcacacatgatgtgaacctaactcaaaacacataactcgatagaacggttagtccacaattagcgcttgtcattaattaccaaaactaacaacgggggcctagatgcttcaaagatcatgcacgatactaaaaggctagagaacaatggacgtggtgataaagaatctatatagtatactgttggcggatgttaaatgctgattctataccgccaacatctgcataaagtttagataataaaacatccaacatagtgataggtgcttaatctcacatattccacaagtgttggtgtgtacagttgtatgcagaagataaaccctgaagttgggaggcaaatcagactaaagtgaggaaaattatgtatccatacaaggaggggttgttaacttcatccaaacatcagtaaatcaacccaaaaactccgagaaatggatagaggaaggtccatggagtccaccgaccgaaggctaggccaggagggcccagcccaggttcggccgaacccccttgatcctggggtttggcgtggacgctctagatgttctcttgcagttaagggagttcttttgatgtgaactttgtttagcaagcatggtggaataaactcattcatagcacaacaataataatatcataaagaatatcacagagttccacaaatagcacataaatcatgatgcaatcgactgcataagtacgcagcccaaatagagttcatccaaaagctacatcgagctaatcatcaaactactcgtcaatctaggtggggggtgtgtctcgcgctatccaaaaaccatatgaagcgagagcgaagtcgcagtagacctccattctagtcgtccaaccatccgcaggatccttgcgcgggaagagggtatcgcatgctcatgcaaatctgagtccccacggctcagaggtggtggcctccggatctggcttgggcttcttgcccggggtcgtgtactcttgcgggcagtgctgagggtgcgagggcgtccaactcacagttgcggggcagttcggacatttccccttctcacaaccgtcataactgccctataaaaggacctcacttcattcactctcacacacacttccaagattgagctgaattataagaggctctattgtactatattgtatactagaataggaagagagtatagtagaagaagtcggaagaattccggagttatcggtaatcttctcctctgtttattactctgaattcaatataatattatcttgtgagaattatctcttggttagttcctaaatagcatacgggattattgttcactataatcaactaaaatatagtgattgctttggttagttataaacactaaagtagattctaactgcttagacgtggtgtttaggtaattattatccagtaattgctgcgtatcccacagtacgtttgaagtaggtgtagaggtggtgacagccctcgagatcacttaaatcctcccaatccgggtacgtagtagaacgacatctgggaacagcgggttgccagtgcctgaaatattgtgttaggattaaagttaagctttccctagacactgtttctcactagtaaatcctctctatcttggcctatcatttgcttggtgtccttggataaaccggaggaagatctgaccacacacgttccctaggattcgatacccttggaatacttcgtaggggaagtgctacatcggtatatccgtgcgcttgtggattttatctgtaaccgtattaaataccaacatatacaagagggattgtgtacgtatggaaagaggagtcaaatttaggatccgaattcgggaagattaatagagataaggaaaggaataagttggatacttgcaagagagtgtttcctacatggttaggagttctaagttgtgttagattcgtgggctttgcacagcctacctcatgtataaatagagggggagggtgtggcctcctggtatcggttttagagagacttgagttgagagaaaagttagggtttcgagtttagttcgagattttgtgagggctgctgttgatgcactttgtaaatactagttgatgcaacaaagttaaaagtttcaatgtacatctttgagtttattatctaccggtgttttctaggtcccgacggtctagctgcagtgtgcgcgcggtttgacaggtgggagtgtagcagtctgaccgcaggtgtttgggcggtctgaccggcaaggtttcggtggtttgaccggcggcaggtgggtgttttgaccggtggcgacgagcttcgtcatctactccattcgaggtaaatcttttattccgcaaaagattttaggtttttggtttatcctaccattcaacccccccccccaaatctggtaggttttttttggtcttattcgatcctaaacttacgatgtacaatttttttatttattggcttattgctttccttcacgtatacctttcactgtccatttgttatactccttcaattaaaaatataacaacatagcgcattataggtcgtattattaagataggtcattcaatactagattattatattatatcaaacaaataactaaaaattaaggagcaattgcattcttaaccttactttcaattgtaattacaattttacttttttttagggttcatgattttgccttttttttcaaatcgaggctacaatttgccgagaaaacggacgttatgccactccctaaactgggttcggatgaaatgctactcaatacaatgcaccggataaaatgccactcaatatattgcctaccgaatgaaataccactttggagatttttgtacccaaaatgtaactgtggagagagagagagagagggaggagagcatcgggagagccggtcgggcggcggcggaggcggccggcggtgacgacgggaggaggaggacggggcagtgacgacggagggaggaggataggcctcgccgggcggcggaaggcggtgacgggggggaagggagggaagatagggcggcgggcgagtcgcagtgaggacgatggggcggaggaaggaggaggcgacgacgtgtggaaggaggacggggcggtgagaacgcctgggtgccaccgtcgccgctcgctcgctcgctcctcaccgccccgtctgtcacgaccggaattgacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgagaaacagcggaagactagggcgacgaccgcaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttgtaatataaagggttaggttttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccgcataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatcttggctaccaggccgtagctcgtgtagccttcatttgtcctagagatgtccatcgacccccgacttcgtccatctccatccgtgtacttttgtttataaccagactgagccacaaactaaaccttacccactagacatgtggaagtacggtagcgctttgcaacagaggcccgaagaccggtccttatatggccgaggtgctactatcaaaaccatgcaccccgagcccagcctaaaaccattttgagggttttgaatagagggggaggtgtgaatccaattccacaatgatccaacaattccatagtgtccaggtgatgagaatattcccaaagtgtagagttgtaaaaccacctaatgttgcctaattaaccagcgaagcatctacctaaattcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaccgtcggcttcaacttccacgaagagcggatctttcgaagctgcagcgtctacacgatcaatggaaaagaaaaggcttttactctaataaactccatataacaagtaggaacaaagcacaaaaatgggttcttgacttcttaaggaaaaattagagacttgaacggtccaattccgagttcaaatggccaagttatgaccatttgaagtttatatgctctttaaatgaatatttgcgaatttcttcatttaaattttaattttaaaagggtttattgcgtcagccgaggggagggggcacgcggaccgggtccacgggagtggggcccacgcggcagcctcacggtccacggtggaccgggtgcacccgggctcacaccggccggcgccgtgggccccacgcgtcagccgcacccgagggcgcgagcggctgacggccgggccccacgcggcagcagctcggtgcgcccgaaggcggccacggcggcacggccagcgggaggcggcgcgtccgcgcccctatggtcgccggcggcggccataggcatggcggagcggcggccgagagaagggagggaaagggggaaatgaggcggcggtccacggctcaccctaggtcgacggcgacgacgaaaaggcggccggagcggaggaaggcggcggcgcggttcgggtcgacggggacggcggcgctccggcggtcgacgagcgaaacggaggggtggacgaggtcggcgaggatgcggcgaagccgaccgaggcggcgccgaggtgggaggtggtcaagggcgacgacgacggcggcccggagctcggcggcgacggcggagagcgagagcgacggggggatcctctactactagagcgg

SEQ ID NO: 70873 - DNA, 99336 bp, Oryza sativa
cccctatatcgaccagtatgccggtatggtcgtctactcgtctcatgtttcatgctgcgagcctgcaaaaatagtagtggccttttttactagcacgtttctacatcgacgacacaccacgtggccatgcctgcaacagtgcttagatggagattagccatgatcattgttactatggtgttcaagtgaataggggcaggggtgaaaacgagagggggaaacaccggagcaagttaccgaatgttactagttactacttactatttcctccgtttcacaatgtaagtcattctagcatttctcacattcgtattgatgttaatgaatctagacacgaatgtgaaaaatactagaatgacttacattgtgaaacggagggagtactcgtgtattactttcgtccacaaatatttttttagctacatacattcacaaagtaacgagagctacattaggtttcatgtggtgaaacctattcatctaagttaaagttctaaatttaatatagacaagaaaaaactacccatacgttacaataagtgaaggctattttaatatattattgttagaatttttgtctaaaaaatatatgggatttttattttgatagtattgatatctaatttggaacccttattaagatgatggtcatatcatgtacgcctgacgagaattctaaagcaattaagaatcagactcccatcctaggtttgcatgtgagtttttttaaaaaagatttcttatatgactccttatatattttcaaaagcgaacaaacttagaaaccaagtcaaatacgaataacatgctaaagtatcagcgaaaatatttttaatttttataataatggagaagagatagagataccaataccgaaagagaaaatgaggggaaaagagaagagattgaaagaagagggagagaattaggattatcgggaaaaagaaaaagagaaaagagtaaaaaaaaagacagtcaagggaagagcacatgacttcgagtggatgcacgcgggatggtacgggtcgattgggttgtgttgggctaggagagggatgggtgggattaggctggggaggaggtgtacagtactccatccatctacttttgataggtatatttccaaatctgaaaaatttacttttgaaatgcatattttaatccaaccacctatcatcttaatgactttctcggatttaatgcgtgactttccattctttcacataagactggttacatgggcatcaagaaatataaatattaatgaatcgattgtttacgatgaataactagtaacatgtttaaatggatgataagtagaattacttatccttggtcattgtgtgaaatatgactataaaaagtagatggatggagtagttattttaggctcgagctgaactggatgcggacgacgtacaacctagacaccgataacgaaataaaattccgacaaaaacatcttcaaattttataatagtagatatatgatatgctctcatttacacataaacttttaagtaattttaagtttagataacatatctgttaatatctgttaacagtgaggtgtttatggtaatttcgtcaaatttaaaatatatccatttagtttcttacaagtgctaataatgtgtccctgtattcacaggggattagtatgcacacatgtatatgaatttgaatatctattgtattgtgcttgtatgagaaaaagacgcatggtcgtgtcgcttgtatgagtatacgtcttttaccctttccacgcgcggagcttcgctagctgtattccggctgtacaacgttggacgcacggccaggggaagaagagtgtagaacacgcggtgcatgcgatgcgatgcgatgagctcactcgaaccgcgaccgatcgaaacgaccgcgcgcatgacgatgacgtgcacgcacgtagcaatcagtcaaacacagccaccaaaaaaaatcacagcataatccaaaattcgtcttgcttaatttatgcctctactttgcattactttacagcctgtgaaagtgagaacgaatgtttttgtcacctgcatgccgctgatatttgacgcggccaaaacacacccgtctgccaaaataaaaccacacgtttttccctctacgaaatactacaaccgtccaaaaatactcaacttaaaagaggatgtaacctcttctgatacaatgtatttagacaaaaagctatccagattcattatactaagagcaagtttaatagtatagccaactaatagctccaatttatctatagctaatctagtagctcatttatacaatagttacgtactacactattaatacctggtctcacctgtcatacacatattgcgtctcgaagtccgtgctatagctggctacaaatgtatagcccgctgctcttctctctccttatttatcttattaaaatatgtttgcagctggtttataatctgctattgtacctgcttaaaagacgtggttgagtttttttaagaacgaaaagagtactaatcaggaaatttgaatttggttgtgacaagaaaaggatcttgttatcaagggtagacgtcatgagattgagaaggatcacgacatgtaaactccatgtcagtgactcggtcgcaatttcgcagtgcttaggtggtctttgaatttagggatttaactttagttttttatttagacactaatttagagtattaaatatagactatttagagaactaattacataaatgaaagctaatttgggagacaaattttttaagtctaattaattcataattagagaatgttttactgtagcattatattctaatcatggattaattaggcttaatagattcgtctcgcgaattagtccaaaattatggatgggttttattaatagtctatgttaatatttataattagtgtccaaacatttgatgtgataggaacttaaaagtttatagtcccatctaaacagggttagactatagattttgcagggggccagtgctggatacaacggaggaaacaaacaaagggaagagatggcaggaggtagtagtagcaaggatcctctgtaacaaccatatctacaacgatcgttgcagattcgactataatttgactggccccagcaggcaatggatgctccgagtggaggagcagggagttgcaatcatgactaagagaaagctaataggatttgtcaagtttgaagattttcgaaagagatgtcaagtatatatgaaaggcaatactgcaaaaatctaaaaatgtgccaaattaaggtggtacattctctcatacaatttatgcaatatctgatcaaataaagctcgaactctaagtagccgatgtattagaagattggaacccttgatggatttccctttcgatataatttggttaacagaatttaggtcgaatgtccataatctcctaaccttagagcatctgtagtgtgaacaaaaaatcgattttacgacaggagaaccaaatcatgcacattgtagctgtcgaaccgtaggtgtcaaacaacaaatcgaactccacattggagtcgaactgaaagagtaaattaatatactgtgcatgcatgcaggtacggttccagtgattggctcattccctttttacagatcccacaaaacaattttaacattatagctatcaaactgaaattttgtttggctcttctattagattgatcaaaccaaacactacagatgcccccagtgcctttgccaactgttagataagtgtagaattttgctttcacttttgaaatggaagtacactaatatatttgggaaatacaaagcataacttttaaaaaggccaaatgcgttttacactaaacttagctggtgctctgctccgctcacagaaggtgggtacgcagaagatcattgcggcagggaagtagtagtaggtcatggtcaaccttaaccataccctaccatgacagcagcagcccaggcccatcaatcgcccacaggccctgcaggcccgggcccactcgagcagaggggcactgtgaaaaaggcccagtcggccccaccacgtcatggggcgccatgcacgcaccggtcagacgacgcggttgtcggcctggccggggtgcccagccacgtgggcagcccgcgcgctaccgacagcggccgtgacccgcggggcccggtggcgcgcgctctcgcgcgcgcgcgacgtagttgagaccacgacgccgaccgatggcgagcgcgcccgcgcccccgccccgcgcgcgcgccgcgccagccaccatgcgacgacgtcgtacacgcacagcgcgccccgggcgcgagcgcgcgcgctctgcagcgtctccgccgccgaacgccatgccgatcgatgccgccgggcgcgcacgcgcgcgcgcgtcaccattgtgatcatggcgcgcgcgacgtgacggcgacacaagccaatccatcgctagcgactcgcttagtactattaattactccactaactagcggcatgtacaagaagcggtaggagaaatatcgtgtttctgtctaatcttttctgtggttgtacgcttgtttaatcctccttttcgtaggagttaatgacgatagggctcgatcagagaataaaaattgggttggtgcgctgatcactttcgcggcgagtgttgctgacttgcagcaacgcgcgccacttgccgccgttcggttggcctccgcggcgggggatgataataatggataatgctttatgcgagatacggctctgttggttttgcatttctttttcgttagggtggtgagtgcaccggagccaataaacaggtttaggtggaggactcgtgtttttttttaaagctcagccatacgcccatacgataattatttcatttgttcttttagatgtgcctactagttcgtgctagtaatctatagagcacttcaggactagatagcgagaaatctgttttaagagatcaacacgacacccctttgcatgcgaccttgggcgagtggctagctaagcttggactggttcctaagattgccactaaaaacatgtgtcaaatggttgactgaatatatatgtaaggtgtcagacttgtctcaagatataatggtgatgagatccttttgggacgcacctgatcgattctatgaatggactacaactcttttgaagtagcagatcatactagtgagcaaacgcttaataatgtcactcattccctccgtctcagaaaatacaatctaagataggaactgttatatatcctcggacaaccaatcaagacaagcacttaatccagattcgttgttcttgaatgcgtcacattctattctaagttaggttttttttatggagaaagtactttagattataaacaaaacgtatataatgattgagacagctatgtaatatcatttatgtacacagccacatcaactaagaacaaataaaaatggcatgtacaagagacaatatgatatctaatgtcactcctctcaactgtttccttgtaccctatattatctgagatgcctctttgcaaagatacatctcctttctcttctttctttatccatcgacacttcattaattaattgcaatgagtcatatggggtggggggtgggggggggatggaggaactaagaccaattaaggactaaaaatatctagcagtagctggtctagagctgattactggttaccaaacgatgaattcagattttaaaaattcgactattatggataacctattcgatttttatattactgcaatgttttccctccaactcgtaattcataaatagtagggctggccagccagttggcaattgggagtccaactcagaagacaatattgtgcataattcagttggcaattgtccggttaattttattagtaggacaaattcgttatgccagtggcacctagttcggtaacaaattttggtgttattgtagaggttggatatagcgttttcatatcaaacactcaaaagtagtttagaggttttcccctgtgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctataatacacccggcggattcaaatccccaaacaggagtagggtattacctctcattgagagggcccgaacctgtctaaatcctttgtctccacatccatccacttttaggtctcgtgcgctaccccgttttattattgccgaaatcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctacacggctggcctattatgccgccgctgttgggcgtctacgacttcaccgccggcccgcctccgtcgccgccgattggtgcctccgcctacacggctggcctattatgccgccgctgttgggcgtctacgacttcaccgccggcctgcctccgtcgccgccgagtggtgcctccgcctacacgggtggcctattatgccgccgctgttgggcgtctacgacttcaccgccggcctgcctccgtcgccggcgagtggtgtccccgcctatacggtcggttggtcacaccaccgttgatgggcatcgtcatcttcaccgccggcctgcctccgtcgccgccgattggtgcctccgcctacacggctggcctattatgccgccgttgttggatgtctacatcctcaccgttggctcaccttcgttgccgtcgactggtgtttccgcttacacggctgacctattataccgccattagtgggcatcttcgctttcaccgtcgaccgccttcgtcgccgccgactggtgtcttcattattattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctaacacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacaccaccaccggctcgcctcgaccgccgccgactggtgtttccgcctgcacggctggcttattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggtgtctacgtcttcaccgaccggcttgcctttgccgccgccgactggtgtttctgcctgcacggctggcctttatgccgccgttgttgggcgtctacgtcttcaccgaccggctgcctcgaccgccgccgactggtgtttccgcctgcacggctgacttattatgctgccgttgttgggcgtctacgtcttcaccgaccggtcgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcatgttcacttcatcacggcgatgcaactttgtcatcatagtggagcgacttcatctttattatcttcggcactggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgatctttcgttgttgttgggcgcctacatcttcactgctagctgacctgactgttgccgactggtttcttcgcttccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcagctcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattagatacaatatcattgcttttcgccacgtaagtgtgcatttttattgaccaatgttatggcttaggctgattatatattgtggtcattttctaggcggttggtaaatcctttatgagtttatttactcagattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctataatacacccggcggattcaaatccccaaacaggagtagggtattacctctcattgagagggcccgaacctgtctaaatcctttgtctccacatccatccacttttaggtctcgtgcgctaccccgttttattattgccgaaatcatgtttcgacaccctggttcttctaaatgtcctttttccccattaccgctatgatccggtgtaactgcacaacagttttaaaattaaacatttaccaatattgtgtctgaaagaagtgcgcgagacttaacatggatttgaatcagatgtgatagtgtgactgcaatttatgcaatctatgaccgcttattagattgggtccaatggtcaatatgcaccctggtagtgtagatcactgtggcaaaaattgtttacttttgtgttggcactgtagccaataatctggttcattcatcaacaaaatggatatagtcgcaattgcgtgccatagcttaacttgtaggcggctctattaattcaaattgtgccttaacgtagcatagaggtggacaaaaagcgcaaagctcatggcttagatcagcttgtagcgatctcgactcagataggctcgaactcgtaatcttaatgagtcaggccaggttagatttttaactcataaccttaacgagctaactcgcgagctcctcgtttagcttgttagtacaagatatcaccacatctttatatacttagtacttcttaactagtgcttagatttttaattacatcaaaattattcgtatttagtgagttcttcattagtttgtgtttattattatgttaatatatgataaatttgaaattatcgatatgatataaatgagatagagcttgttaacgagcctaatgagcttaacagctcacgacccgaaccgagctagtcttttagctcaatgttaatgagccgagatgactcgtactaagataacgagttttaacgaattgagccttaacgagtctagctggttcgttatccagccctatttagtggtggctaacgagccaactcggctcgacttgtaaaaactcgttaagttagcgagctagctcgggttgacttgttaacataatgagttaaaaatggaaagcgactcgacttgttaaaataacaagttaaaaatgaaagcaactcgacttgttaaaaagcccaagtcgactcattaaactcgttacatcgaaatacatggtttaaaattcatatacatggggcaaagcgaagtttgtccctcgcgtcgacctcgcgcggcggctcgggggcgaaaccctagccgccaccgcccctcctcctccctcctccctgcttcgccgccgccggagctcgtcgccggcaaagccgggcgacgcgctgggatggcggcggcggggtaatctccctcgactccatctcgccccggcgcgggtgtggcgacgatggcggcgggacggcgaggtcgcggcggcgggacggcgaggtcgcggcgatggcgtggtggtggggctccccgcggcgatggcagcgcggcggtggggctctgcgcggctccgttgagggcgtcgccagatctggtagccccgccagatctggccggggtacgacggcggcgcggcggcgggtctcggcgtggccggcgacggtctcggtcgacgccggcgccctcggacgtagcaggtggccagcagcttcggcgcggtttcatcggcgacgacagcaccgggtcggcggcggtgctccggcgccggctgccgcgtggtcctggccaggggctgccggcctgctgcggcttttgccggcgacggggaaggcgcctccatctccctccctcctggtcctccagatccggttctccccttcttcagtggtgtttcttccggtgctctctgacggtgcggcgtccgctcccctcttcttaggtgctcctcccttcttaggctaggctgcttccagtcgatgccggggagttccgtggttcggtaggggtggcgtgcggagttgtttcggcatcctgttcgctggtcgtcggccgcgccgttgtttccctgcagctgggttcctgggtgtgaggtggtctctggtcgagctgcagggttggctgttgaggtggagttggagctgcttgtcttgcaagctcggcaacgatgaccctcaacgaacgtcccggcaacgcgacgagggttttgaggtggagcagttcgagagagccttaggtgaaaaccttgcctagtgtcgtaggctctccagaccttccattatatttgagagatgaagtgaataattcaagtcatcaaacaagcataatgaaacatccgacgcctcgagagaggaattttggagacattgctgggcccttagcctgccagtcaacttcagcctgagatgtgcccgtcaaaccactcaaaggcggcgaccagatgtgttacacattcaggagacttgacaaaaatggctaaagatctacaacctctcaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaatagacttattagagaacagcggaagcttgactacccaatcacaagcacaccgactaggggtttaccctattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctactatactacatgtaaggcatatattcaaaggaaggcaatatgtagttcaatttcagcatatagcaagttttgttttgcaattcttttgtaaaggaggtgatgcttcaattaacaaagacaagttttaagtttcattattaacttcttcataattccatcataaacaatctcttattgccatacttaacaataagtcataatgtatcaccacatacacaactcaacacatttatcaatttcaaaccaatgtcacatgatcacatttttaaaacatagtctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagagcctagccttgcaccagcacgatacgtgttcctccatcctaggcatacttggaatatacctggaaccgttaagtggcgggcccacgccttaaacttaacgccgtggtagcggacacgacgggaacccaccacgtggcacaataccgttgtattggacacgcttagtcacctaaactaccacgtcggggtaaataggaagctcctctgaattatacgaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtgtaaaatcacattttacacattttagttcgcaaatacccatcatattcattttattccagcaaaggttcaagtatcaaaaccacattttaattatagatggaatgagcatttgcatatttctaagcatggctaagcaagtaattgcacatagagcatatataaacccatatgagcacaaagagtgtactctaaccatttctagggttcaaacagcaagaggatcaattattcaaggtgggttatgcagcaaataggtcataactaccttaacccagtttcaaataccgatatagtctaagttcacatgcaactttgcaaacaaatattttcattcctcaaatcatgggatccaatgtgttcaaaggatgggaggagaaaacttgccttgatcagagaattgttagcacctaatccacttcttcaccgattatgcaattatctagataaaggacacgacatgcaattaaacaccgaaagagctgaaaatccaaaatgctctaaaatgcatgatttatgcacagtgggttggaaatgatctaaaatgaatttaggtgaaataattcctattttattttattccatttgggagttatgaattttagaagttttatcggtttacaatagtatagtcttaggtagtgttatgaaatacttttgtaaaatgatttttattagattagacttcacaggggtgtggagatgtgttttctaagactaacacatttggtttcacaatttttggaattataatgaattctttatgcattttacaagttataacgtgttttagacatatagtgttttatatgttcatgacttttgagttataggttcagaacatgctacttcctgtttaagttgaataaaaggaataatttggttaactaaaacatttttatctcacatgtttatggtctttactactatggttcatattttataaagtagagatgctttaatctaaactagcaatatattatattaacctagaaattgttatatgagctaagttcttctaattttagtggatggaaatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaatggctgctctatgttagtaaatccttatatgaatatttagagacttttactacacagcaagtatataatcttatttcataacatggaaatacatgttttagtgatcctacataacttaagtttattcaaattgaagctaaattgggttctacatgaatttctaaagtttagcttatctaaaactaatcattatagagataatagttttagaggcatttgatgcaaagtaagtaattacttttatttcacttaatcagagactgtatgatgatgaatctgtagaatttgattttgtttcaaaatgagttgaaatgaattttctatgtattttataagtttgtacatgttttatgtataacctatcttagataaattttagagacattatttgtacagtgagtgtcaagttttatattcctggaataaagttcataacttcaagaatctacagcaactggaataacttcaaaatgagctatatttgattttatatagattttacaactttgtgcatttttctgctaaacatatatttgtttgggcattttcctaatttttcttcagattttaaaggatgggtccacatggctgtgagggaccaatatgcacaaaggcccttgaggtttctaggaatcaacccgcagtcctaggcccatatgtcagtgtgtttctacaattgtaaacagatccctgcacttaatctaattcacggaagtcatccctctgctctaggcagagcagagctagccatggctgagctcgatctggagctcgccggcagcaaacggtggctcgtttgaggttgaggtcaaaagataaaatgaagagcaagctctcgcgattccattcctctagttttcttggttagaggacatcggagtagcgccgatggcgagtgtgagcggcggtggttttggggtgaaagtgcatgtgtgcatggaagtcgattacgaatgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgtgcaaggaatcgaacaatggctcaccgaggcagcggtaatcgacgatgacggcagaggcgatcctagattggcgccggtgaagaaaaggatgtgttctccgtgttcttgatgtttccggctggggttcttgaggcgttttgaagaggaggttgaggtgatgacaatggcgcagcggctttctctgaggtggatgagaatggccggacgacaacgatggttgaagcggcggcgctccggtgcgtgctccagggcatcgtcggcgtggtcgcgttccggtggctgtgatacacaaaacgggaggtggtcaaaagagaaatggttcggcactgtgtggagagaagggaacgcggaaaacctggagatgacctttacccaatcagcgatggcgatggtcgtcgtctccacggccggcggcaaggtttggggcgatggagaggcagagaacctcctccctcggtttcttcggctctgagtggtgaatggagaatggcgacgcgtctaggaggagtagagagcgagaaaaaggaaaccgagatcgacgacacgttgcggccacgcgtcggctcgctcaatctctccctctctcggctggagcagtggaggaagtgatggacagagctgaacctagcctaaggcactgacaagtggggccaactcgatggaaactaggccagggagagagatatgggtagaagactggtaaactggatttttagattaattttcggaattattttctcctctaactttgtaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagagaaggaaaattctagaaaaattacatttattcatgataactaatctagtatttgaataaattattttccatgttcactgatgtgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctaatcattgtccacataaatttttccatgattttatcttgcacaaaatattttagagaattaagttgacctttgtttgtatatgtgttcccacttcataattgcatctaatattattatagggattacattaaacttcttttagactgagaagatgatatttgagtttaatattaagtccacatgttattacccaagattaactataggtttgtttagtgaagtaattcttttagattatgctcatgggatctattatggaatgcaagaccaaaacttcaaatgcacaaagaactcgagcctaggcatgcattatgtacatgtatgcttggtgacatttctagtctaatgttgggaatgaaaatgttttattttgttctcaaattttaatcatgcaatggtttaagttgatcatcacctaaattaaaacggaaatttttggctctcaaaattggagaaattaacctctaactattttgataagaaattttaagtcctaaaatttcgggtatgttacacctagtctatcctaggttgatgatatcgacgcttgtgggcgccgtttcctccttggaggtgtcgtcatgttggttctctcttccttcaggtgaaaaccgggttcctttcggaacgggcgttgacagcatccttaatgttgtttccttgttgaaggcttcgctcagaaggtatttgctccactagaggatgtttggtggttctggagaccttgtcattatgttgtcgaagctgcttgccttttggtaagctcggtaacgacgacttctgtgaggtctcattagttgtttcttttcttttctgtattggtttttgccggtttcccgtttaattaaccgtgcttgtttggttttcgggcccggtttcccttattaactgggccaattctcttcttctataaattccggcaggagaaactcctgccgtcggttcctcgaaaaaaaaattcatatacatatataaatcatgatttgtgagcctatgaccaaagattatgattgtcgtgctatgtatcatgactaacaatacaaggaataattacgagtttattacgacctttacactggcaaaatgtggacaattaacttatatcttaatacatcatgcgctcaacgagctacctcgagttgtctcattaaacaaatgagtaaaagttcaaactcaactcaactcattaactgccaagtcgagttgagtcgagaagagttttacacaaattaaattggggcaatagcgcttttgaccctgttctagaacctaccaatttgaccatactttttcaactttgctcatttgaccctcgtttttaaaactgaagatcaggtctgacccccttctgttaaatcaacgtaacggtgtgcccttcttattcacacgtttgtgccgcctacctccttgtttggaacaaacaggagaagaccgcgtcgccatcctcttcgaagcaagaaggagcatcgccaccacacatcgtcctccccgtccagatcgaggaacagcgccgccaccgtcgccgtcctcccgtcacgacgcggcgccgccacggatttactccctccgtcgccgccgccgccgctaccgtcttccacgagctggcgtgaccgctccctctctccacgagctgacgccggcacggatccgcttcctccgtgtccctccgccgtcgctgctgccttcctccacgagccggcgcgtccgctcatccgccactgccgcaactcgcccctccatgcgccgccgccgcacaggatatatgagagagagaaacggtagtgaatgggtaggttagatgtggattggtttccttgagggtagtttggtcattacagtatttttttctaaaaaaaatggaaccttaacagtgcggtggaaacagggttagacggggtgttcatttttgaaaagcgggttcaaatagcaaactagaaaaaaaaaagctagtttagtagttagtctttcaaatgaggtcaaataagtaattatcccaattaaattagcttacgagtttcgagatttttgaccaacccctattcacacatatccatccagcatcatagacccggttaagcccctcctatttgggcaggcctacatcccgaaaaggtgctccatggaatgccaaaacgcacccgtcccggttcccattcccattcatagctatctaccacctttttcgatcgttacgcaatgctcgcgcaataacgaaatctaccgcgtgccataccgccacgcaactagctagatgccactcactcgaggttagttaggcatgggcatcacatagcaaactggccatcccatagctttcctagctcccacgagacgaccctgcaccctgcatgcggcagcacggcgcacacgctcctttcttgatcgtgcgcgtggagcccagacgtgaccggccggaacggactccggcttggttcgcccttgcacagcactgcacaagcacaacccggtcgatcaatcgatcgatcagtgagtgccgaatattccgcacctacacgtgttcaccgttatgcgatgcacaagtctagctagtgcacttgaggaataatttggatgcatgtatgctgctgctgcgctttcgaatgtcaggaaaaaaaaacacatgggtgatgatcgagtgaacaatgtgtctcatcaatcagctggccctaaacgaacgaaccatactctgattgcgtagcaagtaccgtgggtgattcgattcgtggatttttcgttcaatacaaagagcgctaactggtaacctggtgcgcttagataggagtaatcagataccactggttatctggtgcttagataccacaggttggtcgacaaatgtccagaccgtgtacacacctgcacgcaccaatgtggcaatgtgcaaaacacccggcctcaacctgtcggcaaatgccctcgatcggcatcaattccctaccaccacgtacacccccgggaaacggagagtgaccgtcgagccgctgggaggaggaaacaacaaccggacgagaagaaagaaccagagctcaagcacccaaacaaacaaaaagttcccggttgaaaataacctgcagtagcttagctactagtagcactgtgagcactagctttgtcctgttccaatccatgtcgtagtaccgctggtgatgctggtaggaccggctagatgcaggccggatgcacctaccttcctccccgtaaacaaacacgtacgacgtgccagcccgggacccgattcgatcgaccggatcaggcaaaaaaaatcataccagcacgaaaagcaagccaaccccgcgaaagcggccgcccggcaaccgccgctccgttcgcctgcggccgcagcagcagccgcagcgaccgtacgctaggaaaaaaattttccgaacggcgccaaacgcgcgaagcttccctccgacctcccccgccccgtctcgccctccgatttggcgcatgccgtgcaacgcaccggccgcgtgcgcgtcgcgtcggggacgagacgagacgtcatctcgcctcgggtctagctagccggtgcaacggctgtttcgcccgtgtcccctcccgcgcgttggctttcgttcgggccatctgatgatggggatcacgctgtcacgcagcacgcgccgtgcgtggcgcggacgtgccagaaaaatgctctcgcgtgcgtgcatcaacgcgcgtttcgggtggtgtgtgcccgtgtggagtacgtatacaacctttttcctggttcgcgtcagtgcttgggaagagataactgttttgtgttacatcaggtgaattcagggtttttttatggcaggcagcacgttcacgttaatcggggatagactatcacctattggaattgtcatatgcggtgcatcggtgtgaattaatatctcggttcgtaatcgtgattggctggtgcgttcgtgcttactttagagctcgtcgtgccgggacaagatgtttcacttcacggtcttcacgtccgtgggtgatgacgtatagatgaaagcctaagaaatttagccttttattggtcttttgtttaatcaacgaggtagctgtcgagctttaggggtgccacgtgtacgtccaacccagagaaatttagccgtggatgtagagccgctggtgaaatgatcgatgtttactggagttacgactaggtcatttgtttggaaaagtaaccactaaccagtcaaggtcactggccatctggctccacctggacagattggacgcacgcacttgaagttttgaatagttcatgacgtcttttttagtgctttcttctctaaatctaagatgagcataatatatactgtaaaatttggtcaaatcacgtgtaggtgcaccagatgatgtaggagtaattatgtaatgcaccgtgcgtaatcggttacggaactgggtagtaggtttaccgaattgcaccaatccattgttggactagatgatgcaatcgccttgtgagcttatttacgaacaatatgatcttatattttctccgttcaagtatataagggatattggcctaatcccttatctaaatatataagcaattttacaatcccaagacaatgtttatcttctatccatcaatgaactcatgcactagtttaatcctcacttaacaactttggtactactccctccatctacttttgatagttatattttcaaatctgaaaaatttatttttgataggtatatttcaatcaaacaacctatcatcttaatggctttcttggatttaatacgtgactctcaattctttcacataagattggctctatgggcatcgagaaatgtaaatattaataaatcgcttgtttacgaggaatgactagtagcatatttaaatagatgataagtagaattatctatcattggtctgtctgccaagataacatatgactatcaaaagtagatgaagggagtattagtttattttttcaacctttaccttatgtactggtttatttcctcaaccatcatcttttatactatgatttaaccctcttttaacttccttaattattctcaaaatggcataataccatgtatttaaagacagagagtactttgatcgcagatcattcagaaagaaggtctatttttgagatgattcaggcagaaagtttcttttttttgagagagaggaaggcagaaagtttcgactttcgatcatctggtagcaaacccagcaaaacttcagcttacaaggtgagcgtgaacccgacaggtcgtcgacccttcggctggatggagcagcagctaatcgcggttacacctttgggccctttcctcggttgggccactggaaggccgtagtgctgctcattgtagccattgggccagtgtcacatgggcttacaatgaaaagcccatgttctccgaatgaaaaaaacgtacagaagcaacgccgtcttttcagctcggatgtctgaaaactcctaaaaccccaaagcagccagaccagtacacacaccattttgcttgtcaatggccgccgccgccgccgatcccctcgtcgccggcgccaccgtctcctccgactccgactccgactccgacgatctccacctcctcctcccgaatctcctcccttccgccgccaccgccgcatcagacgcgcagctccaccacttccacctccccgcgctcccgtcccctatcaccgtccgcaccctcccttccctcggcctcaccttccagctctggccatcggcctccaccctcctccgcgtgctccccgcctcgccgctcctcctctcgcgcgcgcccaccccggagagcccgctgggcatcctcgagctcggctccggcaccggcgccgcgggcctcgccctggccgcggcgctgcccgcccacgccgtcctctcggatctccccgcggcgctccccaacctccgccacaacgcgtccctcaacgcgcccctcctcgacgcccgcggcggctccgtctccgtcgtcccgctcccgtggggcgacgccgccgcgatggaggccgtcgctgctccgccgccggcttctcggttcgacctcgtcgtggcgtcggacgtggtgtactacgaggcgttggttgaccccttgattgagacgatgcggttcttcgtcaagggggaggtggtgttcgtgatggcgcacatgagaaggtggaagcgcacggacaagaagttcttcgccaaggcgaggaagctgttcgacgtcgaggtggtacacgaggacccgccgctcgaagggtggcgccatggcccggtggtctacctctttaccgagaagaagcggcgtgacaagaagtgaagaagctcttccaaaaggtaatgactgcctgctcgattgtgttcgtcatgtgttctttctgtttgttgtgaaagatcatactgttagaattcaaacagagaaaaaaaactgagggccaaaacttggttgtgtggttgcatatggatttggatgtgtcaggtgctatcctttgttttatttatggattctagttaattctcatggagtcacaatgaagtttaggatttcactatcttagaataaccaatctaataatagacgatatgattatgaggtggtagtagcagtacaggactttatgattggcaagggactgccgaaatttgtagtttgaacaagacaaagtttttggttctcaagaacacaagtctagcatgtcttcgtactagcacttcaaatggtgatggacggtctctagagaaaagatcaatggcacaattcctctgcatgcaaggaaggaatgacataaaacattatgttacttaacatggaaagttttttgttcttttgtgttacttttatggaattgaagtggaggcccaagaattatgtgttccattgctgctattttccttcaaattgttcatacatttagtagtaagttccttttgttatgggaataaaactgtagaaatccatttacacgaggaactgacctttttcttgttaacatgcaaagctatcaatatattgaaagcgagaaaatcagtacattacaaattaaccccaagagaatgcagatacacaggcttacaccatgacatttagctatgaaacaataattgaatcagggatgttcacagcatttagctagagtcaaatacacgtctgtttgcagttaaacttgagtgcctctcaaaaacagtcagcactgcacaaaggcaaacatgataacacaataggaatacacggcaaacctagtaaccaacctctggcaaccgaacagagggaggggcacaagaatcattggttgcactggacgagctcgtatttccataactgttcggcctttccagctccttcagtgtcccattagatgactgtgaaaatctgcagagagaaattggtggtgcaaagtacattgccactggcatctttggtggaaggtctggtaatggtgcttcaaacttcagtacgcttatgacctggcgaattgaaggccggatattataatctgggtgtgcacaccaaagtccaacaaccatcaaggaaataacttcccgctcttcaaattcaccatcaagccttccatcaattgcattaagtatctcatttcttccataaagatcccaaacccattgaaccaaactgatcctgtcattatcttcctttggcacaacgggcctccttccacaagctatctccagagcaagaatgccaaagctgtagacatcagtctctttgcttgctttcccagtagtgacacactctggagccatgtaacccatggtcccagctatcactgtagtttgtgagcctcggtcatggtctacaagccgtgcgagcccaaagtccccaagcttagcgttgaatccagaatcaagcatcacattgcttggcttgacatcacgatgcacgacacattgttcccactcctcgtggagatacaggagggcggatgcaacacctatggttatcttgaaccgcaatggccatgctaacaggtttccaccatcatagaggtgtttgtccaagctcctgtttggcataaactcgtagactaacaagaactctccatgctcatgacaccagcccacaagttgcacaagattccgatgccttagtctgctgatgatcttgacctcagagatgtactccttcctcccctgtgttgacccttttgcaactcgttttatggcaatttcaatgttttgatccttcaagaaaccctggtatactgcaccgaaacccccttctccaagctttctctctgcagcaaaattatccgtcgccactacgagttcattgtattggaatctccttggccccttgcctttctcaaactcactgtcaatggactcatcacagtctagtttctctttttccttctctcttgaccttgtagtccttctaatccttctaaaacataaaaagaagcaaaccaagccaattgagcagaccacaacactaccgctcgtagacaagcttatgaccaatataccttttgttttctcagtcttcatcaggtgcacatctgtagaatcaaattcccagtaaagaatctggtgcagctctacaaatttacctgtggaagcagagaatccgatggacactttgtcagggagatatttgctgagatcaaccgaataagataggctggagttgccactgaattgtgggttgtcctggtacgacaagaagacactcaagttccttgaatttgcctggtaagttacccaagcattggctatccggccatcgttgatactacttcgccatgtcacgttggctacagatacaattgagtggatgttgatgcctacatggttgccatctggatcccaagtgtttttgtggctgtcaaactcaacagccacaatctggttgagtggatcgctctgatcattactattgctgaagaggccaagataaccatccatggagttattggggaccacagaagggtatgatgagaggaagaaggctaggccctcaccgtacgaactgtcgttcgtgggtgcatatatcttgaacgtgaagcgggttgtgaagctggctaactgaccggtggtgctatcccagagaggcactggatcggtgtagattgctcggcctacgctttgagtgatctttccattcaactcatccttggtgagcttgaccgccttgttgtagaaggcatcctcctggagctgaattgtggctgatccattatgatttgattcagtgaagttcaacttgaaggacagaggattgacatgggcaattttcagggatagggaaaagtagagagccaagaggcaagtatatttggttcttgatcgcatggttggaatcctggaggctggagagagagcaggagggagagatggaaggaaggaaatgaaaagacactacttttgcagacctgataacctgtataaccattaacttggtcaatctccttgattgtctcagcaatacttggtgctattaaagggtagtatcatactgccggcctgtcaataggccctgaaaggacagatgtaagccacaggagaagcagctcaaatttggaacttaactaagctttccaaaaagctagatgaagcttggtttgtatcgtctttgccggccaagattatgaagtcaagtatgtctcgcccataatatgattatggtggttgccggcagaaaaggaggttatctcctctcagcaaatggaacatgtattttctaaggcagaattggactgagttcagacatgcacagaatctgccaaaaggaaagctcttatcgatcttatatgcttaacaaactgggtcatgatgtaatttttgtctttcatgcggcatacaacaatttcatgcagcacaggagagtttattaatacatatagcacaatgatttaccttgtccttagggatcagttcgatgacaacttgacaagcagtaaatatttcttgactgtaatctctattctggagttggcacaaatctattgagttatggcaaccaagatcagacggcagaagtgaagtatatggcactatgatatatcttgcttgtgcactgaaaaaagggttcaaacatggaaaattaacaaagcgaccacagcttatgtatttcgcatagtgtgtagtacacaaggatcagcatcataatctcagtaactagaagaaaatatacaccaactgttctttttactaggagaatatacatcgattgttctattcatgcagggctacttatatacacaaatgattaactcaaaacctgcaaggaatattcgtaaagtacattattgagtggatctgtcatactcaacatgagtttcaagtttgctgccatgaatcgatcgttcatttcgccgtgtcgctggtgtttgtgtcgtccgttggccacgctacagtttccattaacctctgacgcattatctccagattctcattcgaaatcttctcgtacatttttgcatggtcacatttctgcattgatgaagaggtaactaattaaataatttatgcatcaaagatgtctcaaattactctggaatatctcactcttttttattaccttgatccatttgctgtacaagtggagtcgtgtgatcatcactctctctgccaaatcttgcctctcctggtgcatacgaagtcaaattaattagagaatgaaccttggcacaatgctgaacatcatatatatttttcttcattgcttagtaacaagatgcaaaaagatacctttgcgagtgcgatgaggaaatgtttgccctcctttggatcgttaaccacgacgtagctgacaaatcgtaagtgttcgtattttagacgctaaggatgcagattggaactgacaccaacattaacctattctacttagatttcatttcaacatagcacaatatatcaatgtgagattttcttgcaatggggtgacttacttatacagccaagtataagcaggtggattcatttcatacaactggtggagcaccgtgcttgtggccttgtaagtgaagtaattcatgatttcctgcaaaatggagagaacaatcttcagagttccatgcaatctaaacccaattaaccttgcagttagagaaaattaaccattatattgctgtcgtttacagatagcgttccgattatcccctgccggttcaaaaaaaaagaaaatcgaaatcagtagtgtacacgcaccgtgtgcacgtcttcgaacccctcctcgtactgcccggcgaactcgtccacgatgacgaggccgcggcggccgggcctcctccccctccgccgcgccgcccgcgccaccgtgcgccgccgcctcaccccgacgacgacgccgcgggaccacggcaatggcgccgcgcggcacgcggaggaggatgaggacgaggagggaaggcagacgaccgcggcggccatccgcgcgacggcagccatcggcggcgccgcgaaggagagctagagatgtttttttccctcccgacggctcgacgccggctgcgacgatgcgagccgcggcggggttctggataggcagcagcggtggattttttttgctgaggctttggctgattctgtccgcgaaaacagcgcgtttcatgggcttcctgagggcaaacgggagaccccacgttcgcgccgatatttcgtccggcagctcgctgattggtggcggaatggcgacgagagatgattctatttgcctctctgtattttcgcgattcccttgattctttttttttttggcttcagaagtacatttctctttcagccttttccttttttttttgagaatattcacttttagctttttgtgagaatgtaatttgtggaatgcatgactgccaccctaaaatatcttttctgatagtgaacaccaaagtaagggcacttgcgtatgtttatcatagtgaaagaattcaagttctacatttgatattaatgtttataagtacattatttgatattaatgtttataagtacattatttgatattaatgtttataagtacattttactacaagacatcgcaaattcgtgattttagttatgggacaccacatgaaatcacttttggggtaagacactatgtaatcttggttatttgctaacgggcacggctcccatttatttagcgttttagtgttgactatgcaagagctgtccactttttgatgcgctgtgaccaaattgcccctgcccatcctcaaattgactcacctatcggctggcgccgctcttcgtcgtgcagttcatccatctcgcttcaatcctcgagcttcgcctccactcactcctcacctcagacactgtcactccgccgtcaccgcatcctccccaccagcctgctctcctccctcccgacaccataggcgccacccgcacccacgttggtcgaggcgcttccttcccctccaccaccgcaaacctcagtattaggagcaggagaccagcctctaccatggtgttgctcgcacccacatcagtcatggcgcttcctcccctccactaccgccgttgcggcggtagaaccagcatgacgagaagggcctccaccacggcgccacatgcacccacattggtcgcgacacttcctcctcctctactgccacaagacaagcgccgtcgcgagcctagcaggagcccaacccaccgccgtcgcccaagcccccttccgcagaggagttgggctagggtccacctacctcgtggaggtcatgtcggcgtggctcgtcagcttctacctaggagcctagcaagggagctgaggggagccggaccaagccgccacagcggaggtggaggaggcgaggagggagggccagggtggttgctgatggcgagcagaggtggcactgtggctggagtgtgagaaggactgacctagggatatttttgacgtttcatgttgtttatctctcctatttagccggaaattaatattttaatgactatggtgtccataagaaaaaaaaccacattttgagagtgccttcccctaaagatcgacttttgacgtgccctagagttaaaaaccacgaagttacagtgtcctacagcaaaatttgccatgtttatatgagcatctcatttgtactatgttttgaaaaaaatcttgttctaactgagactttagcttagaccctgtcacgtagaatgttttgatactaatttagagtattaaacatagcttacttacaaaactaattgcataaacgagagctaatatgtgagacaaattttttaagcataattaatctataattaaagaatttttacggtagcatcatataggataatcatggattaattaggctcaataaatttgtctcgcgaaatagtccagagttatgaaataggttttatcattagtctatgtttaatacttctaattagtatcaaacatccgatgtgccagggactaaaattttttaaccccatccaaactcccccttaagaagcccaaatccgaacacaacgctttgtagctgactagcttagacctgagggcctgtttgatatagctccaactcctaaatataagtccaggagtttagtctggagtagagttgtggagctgcctaaacccacctccacaactctagtatattttgtgagagagctccacccaactccattcctaattttggtggagctgaaactgtttggctgagctccagcttcagaagggatggagctggagctgaagctgtaccaaacgggcctgactctgagaggaaaggcctgactccacggtccacgcgcaccgcatggcgtacgcgcgaaatggttcacggactcgcggtcatgcacacccgcgaaaacctgcgctaagcaaaagcaccggaaaagcaacggcacgagcccgtgccccgtgaggcaatgaaccaaattggcggccgcgtcaaccacgccaccgggacgcgcgcgacggcaagaaaaagaagtcgcgaagtcgcggattctgcaggcccccacgagaccacggtttcctacggccgatctcgcggggacgcagccggagacgacgcggtcggtcgcgtcgcaccccacgccccggccggttagtggaccgattcccgcaccggcacaccgcgcgcgcaccgcgtcttcttctctatcgcgacaagtctggcttggtcatcgcgtgagtcgatcgcctcgttgctttccgtggccgcgtccgtcgccgcctcgcgcaccagcgaatccggacgtcgaccgctgcctgcggatgttgtggacagctcacagttggtgttcctctgaatgcacaggcgccgtggttcctctcacttggtgtgcaatttaccgtgaaatcccagtgagatataacctacgtcttcgtaacggtctcccgtcttaactccgagtctctgactaaccgtgaacctgatgatgcagttgctagcctcatcgcgtgcgacgaaatatcaaatgatgtcgtccgtgtttagatgacttcttttgtactcctgcactgtctgtcgatgtcatggcagtaggtgcctcctttcaccgactccacctgctccagaacaaagcaggtaccaactgttacaaggaaaaaaaaatctgtattttccaatactgtctatttttattatcttgctttgaatactaaccgggtatttattttggattatagaaaagaagtacacaccattatgcacacacttcaaatattcgtaagccagtagaaaacggaattgtgcaggtggcaagcattctcttttctaaaaaaaaaatcaatatcataaatcacattcatttttctaaaatatttaatttattattaaaattaaatcaagtagataataatacatggtaataattcaatgaataacccatgccaaatagagtcaacaacattgttcacgttttcgacaaaaacaaaatgaaagccaccaaattataaggtttcgacgttgaacacaagcagattctaagtaacttttcaaatgattttcaagaatttaaatttgaaataataaatttgattggaatttatcaaggttcatgaaaaccgtcataagatcgggatccaatgctcaattgaaaatgtgagaccctgccaacaacggctgtgtttagatccaaagtttgaattcaaacttcagtcttttttcatcatatcaacatgtcatacatgtataacttttcagtcgcatcatttttaattttttaaaaaaatttaactttacgctgaactaaagacagccaacgaatcaaagagggttatagccatcccggccgttttcggcccgggtcaaaacgttatgtatgctactcgatttcgtgcccccacacccttgacgagcgagccttgccctcttctcttcccttctctcctaccggcggcaactaccgggaagccgccgccgaccgccggagcggagtcgtcgcggcggcgagggcgaatcggtaacccccccccctccggagttccgggatggggacgccggagttccccaacctgggcaagcactgcagcgtcggcgactgcaaccagatcgacttcctgcccttcacctgcgaccgctgcgaccacgtacgtctttcccgtctcctcccctggccgttttcgtgtctcggtgcctcgttgccgaaatcggatttgctgctgcggtagtttttaaggaaatttgttcttctgtagattgtggaaccaaagaactgattcttcctggaatttttgcttgatatacggtttcttgaagtagatcttggaaagcacctagtttagggaaaatctcgtctgggctttagcctttaggacagtgatccatcacaatcgaggagatggagaagggaaattcatgccaatgcctaggcagcacgaatggagatctttttttgaccgtttggtggatgagagttgatgtgtctatcgttgaccgagaacatgatgaccctttcggtgatgctcttgcagttttgcgcccttttggataattagtttcatctactaattgaatgctatgtagccaatcacataattggtcagaattgttgcttcaataagaatgaaattgatctcagacaaaatctgaaactgggcttaagaatgcaatgggtatggtttcaaatttggaacggggaaaaggaggatttagttgacaaggagtccttcattgttagcttgttgcctatggttgaatgcacataatgataggaaaaaaagaactgaaaaacagtagtggaagtgtggtatttattcacaatgccattcatatctgtattttgtgccagaaacatgccctctagtcattgtactgtttctttgttgccctctagtttctttcgttgacatcacagcatgcagctccactggaatcatgacactctggaattacacaccatataggagtatgcgttattgcagtgttcaagcataactcatcctgagtagcactccaaggtcttgagttcaaatctccataggagcaaatttcagattgggttatttgagggctaagttccctgtttgataggctaagttcctaatttaaaaggctgcatatatccggttggatgtagaggccggataaaaaatacccttctctaaaaaaaaaagcataactcatagacattttgggttcaaaatttttccataatttattatttttgaatcctttccacttcatggcttcccgaatgtaaagtaacattgcatcaacatccaattggcagcactgacatggttatttgatcattgtttaggtcttttgccttcagcaccgaagttatacatcgcatcagtgtccaaatgcaaatcagaaggatgtgactgtcctcatctgcccactctgtgctaaaggagttcgcctgaacccgaacgaagatccaaacatcacctgggacacccatgtcaatagtgactgtgatccatcaaattaccagaaagtaacaaagaaaaagaaatgcccagtgcctgggtgcagagagacactgacattttcaaacacaattagatgcaaagattgcaccaaagaacactgcctgaagcatagatttggacctgatcacaagtgtccagggccaagaaaaccggaatctacattccccttcggaaatatgcttaggagaagtcagaaagcagaatcatgttcaaattcaaacagcagtagcactagttcatcctggtggagctctagtcttcttaccgcagcaacgagtttcaaatcatctgctgaagctgggatgcagaaattgagcacagcaactacccaagccatccagaaggctaaggatgggatctcgacaagcagcagtaacagcggtgatctcgtggagcaatgtgttcagtgcccagcaagattttccaccgtgggggccttaatcgagcattgcgaaaagtcccatcagagcaactcgcaatcaagtcgtagcagagtgacggtcgatgtctgcccgaaatgcagcaaggcatttcgagatccagtgttgcttgtggagcatgttgagagggaccatggaggaacgtcaagagcgtagatctgcttatgtttactgtacctgtgtaacctgtaatttgcttctcattggtcaatggtcatcacactcaataggatttggttggattgtgctctattattacggttgggttcaaaatgtgcccatgaaagaaggtatagtttgttggctgtttcaaggcaagccattgtgaattgaacctcattctagacaccaggaaatcaaatttctgattagttaaaacaatgcgtcgtttagatggctatgctgttgcaagttacaaatattgccttctaccagtttgttaatggtgaaatggaattcataacctcaccgtgcatgcacaggaatccactgtagttacattacctgtcaccattgacaacccttgcaacagggaacatcatcctttggtctgctgaataaaggcgaaggattattttcacatggtttgcatcccagatgctaattgaacactgagagaaacgtgagtttcccaatggttaaaaccacgtaagaaatttcgaatttgtccctaaattggacgtcttttagccgtctaaaatcctttttgttcaacggatttggtcgagatataagccgaaaaacaaatagtgaaacgcgttcctgaagcccatcaaagcaaacctgcctcgaacaccttggatcctgtgacccggcatcgttacgacgctctaggaattgcgaagacgaatggccatgatgttgtggtgacgaacggctgctgttgctgtaaaatcaaattgttttttattcttattctgcgatgaacaattggcatctgagattattgattttgacatttgaagattattggcgaagtggttttggaaataattgattttcagatgatgaacaaggtttgttgttttgtcgtgtccggtcagaccggccaggtgctctgtgtcgactctgtgtcgacttcgggttgtttgtttagaaatccgtggatgtttcgtgtttatggcttctagatggatcctatgtgtatgtaatactgttgtttgctaacaatgagtcaagttgaaaatagcttggtcttggaatatggtttccttgtttgattcatgtgtaggtgacctgatgcctcagaagagtatagtcggtgatggatcgggagtcgacttggagataaggcgacgtccggacgatcggatatcatgcgggatacttaggctaaagatcaatgcacgtggttggtgaatattccatatgacatacgatggagatattgtgtgcgtatgggatgcggaggccattccagggctgtcgaaccgggcggatctataccggtcagaccggcggcacaagcacgatcaaactggcagatcaacctcgattagaccgatctatatcgaaattgagggtaacttttaattccgctaaaaattttggtttttgggtacaccaaccattcaccccctatggttgacttaattctttctacggagttgctagaaatatggcgtcatatgctacagtcgattttttttcagccacttacacagtagttacacctcatttacatcctacttacatatgtaattactatgtaatttttgaatttacatatgtaattttagtacttacacatgtaattttgagacttacattgtaaatacattaaaattagatatgtaatttagggacttacaatgtaaatacatgccgactatttttttttgatgaaaatatagtgccataaatatagctacacccttctttctattcgatcctacagttgtgagggtgacgcgcgccgatactggcggcaagctagcaaatcagaagtccggcgatggcatccaagcgggaaatcaatgtccaaaatccggcaacaaggacaatagaaaggtcttggttagtgtgcttgactaggttgccgttgatttgtgttttgacttttgaaaagactactgttactaggttattccccatagtgtgtgcagtcgcagcgaggaagattggccatttctttgcgtggctcagtcattagttagtggatctcaggaagaaaggggagtgttctgtacagggtgaaattacatcaactactgaaaaaaaaaatccacctctctgaatacgcccgccatcttccatctccttgatgtccccaaacatccgaagtggcgttcgcgctttctgattgaagatcatttcgttcctttcgttccacaccgctcaggttaccagcgtcaagttacatttgttttggacctctaattgtttcttgaattctcttctcctagtcagatatcgctgccgccattaatttgttcccccctttgggaaaaaaaaatattttgagcttgtgccaagttagtcatgggtgccaagaggagctcaatgatccccgcactcttgctcctcgcttccttgtccatcttcaagctaccttgcttctccagatcactctctttcagctacgatttctccaagcccaccactttcaatcgttccgacatcgcaatagatggatccgcgagtctcaatggtctcatcgagctcacgcagaacgctgacccgaaacgtgaaggcatatacgacacggtgggccgagggtcctacggccatccggtgccgctctgggacgaggccaccggcgaggtgacgagttttacgacgcgcttctcgttcgtcatcaagtttaactagtcagacaaggccaagtacgcacccagcgacgggcttgccttcttcctgtcaccctatccgtcaaagatgtctccactcgacggcggtggattgctcggcgtcttcaccaacagcactggcatgaatccgtccgccgccgccccgatcgtcgcggtggagttcgacacgttccaaaatgagtgggaccagagcagcgaccacatcggcatcgacgtcaactccatcaactcgaccgcggtgaagttgctgtctgaccgcagcctctccaacgtcaccgagccgatggttgcgtcggtgagctacaacaacagcacaaggatgctggccgtcatgctgcagatggccccccaagatggcggcaagaggtacgagctcaacagcacggttgacctcaagagcttgctccccgcgcaggtggccatcggattctcggcggcgagcgggtggtccgaggagcggcaccaagtactcacctggtctttcaattcgacattggtggcgtctgaagaacggagagaaaacgcaacgcgaggtaggccggccgctgcggtgcttgcaggtgtcgttgtagcatccgtcgtcgtcgtcggggcctcgatctgtttgtttgtaatgatcaggcggcgtaggatatctcgccggcggacgagagaagagtacgagatgggcggctccgacgacttcgacatgaacgatgagttcgagcaaggcaccggtccgaggcgatttctgtacagccaactggccaccgcgacgaacgacttctccgaggacgggaagctcggggagggtggcttcgggtcggtgtacaggggcgtcttgagcgaaccggccggcgtccacgtcgccgtcaagaggatctccaagacctccaagcaggggaggaaggagtacgcctccgaggtgagcatcatcagccgcctccggcaccggaacctggtgcagctcgtcggctggtgccacggccgcggcgacttcctcctcgtctacgagctggtgcccaacggtagcctcgacgcgcacctctacggcggcggcgcgacgctgccgtggccgaccaggtacgagatcgcgctcgggctcggctcggcgctgctctacctgcactccggctacgagaagtgcgtggtgcacagggacatcaagcccagcaacatcatgctcgactccgccttcgccgccaagctcggcgacttcgggctggcgaagctcgtcgaccacggcgacgcctcgcagacgacggcggtcctggcggggacgatggggtacatggacccggagtacgcggcctccggcaaggcgagcaccgcgtccgacgtctacagcttcggcatcgtgctgctggagatgtgctgcgggaggaggcccgtgctgctccaagaacaatccatcaggtcccgcctcctcgagtgggtctgggacctccacggccgcggcgccatcctcgaggcggccgacgagcggctgcgcggcggcgagctcgagctcgacgcgaagcaggtggagtgcgtgatggtcgtggggctctggtgcgcgcacccggaccgcggcgtgcggccgtccatcaagcaggcgctcgccgcgctccagttcgaggctccgctgccggctcttcctccgacgatgcccgtgccgacgtactcctccttgccgagccttgcattgtactgcgacgcggcggcagctagctcgtcgtcatccagtgcagggttttcttcttccacgagtggcgagcgttcgtcgacgagctcctctgcagcaaccgccgagtcgtcgtggctacttaagcacaacaacaggggcagtgaaaaaatagtattaggcaacaattgattagatcatatctttagtttgatgccaccttgatgttgcttagctcttcgttgtttatgtgtattgttcttccttgggccgccgtgtcatttgtgatatgtacctcaattcatatctccttttctatatatgcgttttcaactttcctagtatagcctgctatctttgatcttaattgaatgtcacaagccgagtcactgtttcgcgaaacgacatatttgcaaacgaaaagtaatttgtgaataaaacttttatatacgtgttctttgcgatctaaaagtaaaggctaaaaaataatttcgatgaaaaaaatttctcaaaatcagtttcaaatttaaggttgaaaattcaaattttgactaataattataagcataagcgaaaagacgaggagcataagcataagcaaaaattcaaattttggcgggacaaaggattgcgatctcgtgaaggtgagctaactccaaaaatccgtcctcggttcggattgtaggttgcaactcatttgcatctcatttgcatgaagcaggaatcgctagttatcaccggttagccatacgacggtgaatccgttcgacacaacgcccgtcacactatagaagttgactatgtttgaactcattaaccttaaccataagaaggaagatgcctaaggctaggcctttgactagagtgaagttgtaacaaggtagggcatgtctgggggagcttctggcagctgtagtttctctcagaatcagaagctctacctaacaattcagtttttttgtccaatttctgagaacctataattgtagaatctagaaaaataaactagaagctagaagctgaaaaactccagactctcagaagctggaaaacttcagactctaagaagctggctatgaaccagctgcttataattttaagctccccaaacaggctcatagtcgtactggaagttgcagctggatcacctcctttttcatgagctaatacttacgtattttggtttgacattaattgcttcatgcccaaaaggaaggcagctacgtttgagctaaatttggatatggaagtcttttttcgtttagggcaaagtacgaccaagctcatgagcttattatcctatatcggaacaattactagttgatattgataggatctcctttttaatggccccacaccctcctgtgtggtgtgtgcggtgtggcagatggggatatcaaaaggaaagggatagagtttttctcgtttttggtatagcataccttcttttgggaggcctgcagccccacacaatgagctccctcataattgcgtcgttgtgcctaggtaaggaattttgaattttttttctctgaattggacatctttaagcagtataaaatcttttctgttcaaaagagccgaaacaaaaactgttcgagatatgagccgaaaaccaaaagtgaacccgttcatgaagcccatcaaacgcatgcagcttaacctcgcctgattcagcagcccagttgaaggtcttcaaatcgtaggatttgaaccctcgtgatgaatccacaaggtgatctcccgtgtgtgttagactgttagtcacccttggtgccagcaaaaggaaaatgaaaaggtcattgtacaagggcccaaaaaatataagaacagttgaagcagagaagtatgaacatatatccacaaaaagttcctttaagaatgatatagatgatcgtgattagaacccacaaagtgatcgccaggagaattgaaaggtctaggcttgactagtgtatcgaaagaaaactgtggaaatatagatgtatcaacatatgcccacaataagaacgatcgaaattacgtgtaaagattattctttcgaaatttgcaagcataaaaaaaaaaaagacctatagcttcatctgaccaacacctcccttgaatgaaccgtataaaggtctcgacctcctgaagctgaatatatcggttatttgatacgagtgcggctgtggctcatcgtgaactatcttttcgtactcggaggaatggagaccgccgtaaacttgaatgctaagaattttcttttgtggtgcattaactttgacatgattattgaagaactcaatcaactcctctttattgagatccctcagtgcagcaacctgcagcaagagaactccaggtataaaaaaaaatgacaccatagggacaaaattacagaaatagagcatacctccgcctcttttctatcaaatttcagagttccttccgaaatttctttccagaagaacgctgattcctctcttatattcttgtatttctccagcttcatgtcaatgagagcattcacgttgctctgcaggtaacagaagtgactgtttactctgtataatgtcaagtatacaaccatacaatagagctacagcaaccttcggccgacccggcaaaagagctacagcaagctataacagaagccaacaaatactgacagcaatcatcttaccttgaactcttcatcaggcatttggtatagagtcccttcaaacatattaagaaaagcttccactctgtcatccaggtttgatggatcctgtttaagtaacttcttagaacaggagataaaaatgatccagcagttgaaattgcattggaaaatatatttaccttcacggttgactgaattatgaattgcaatccccgaacacctgaatcatttctgggtaaacaagatagtgtgaacaaagatttagaggagttgcatgagcatgactactaagtcccattaccacataccaatgcaaaaaagtgctgcacatccttttgcaataaagaacacaattaaaataaaggcaacatcgtacctttgtgtaagcactgttatgtagccaagttgctcaactgaacgcaattggtgaaaagctggttgcttagcaacaagagcaagcaattgaagtagaacattttgtttgagatcatcctgatgaatctgtgcagtggaaacattgttatagcattgaaatgtgtattgcaggtatcttccaggaaaaactagatatggttgatgagaggctagagtaagaaaaaaaactggatgttcaggtattcttctgtaaatgcaaaagaggtccacagagaaaacatcaaagaagtgcaaaggcatacctgaatataatgcaggatggaagaatttttttcatcctggtgatttaggcacaatgctggataataatacctccaacccctttcaagttttacaattcgctttgtaagatgctgtgatgggggtaatgctttgcagaaactgatgggtgcattgaataaggtgtcttcaacatgctgtataacactttttgcttcacccggttccatgttccctaatatagtaatatcgatcacatacagaattaagaacataaaataagtacacccttcttaatgagaaagaatcaaaataatgaagttagttattaaacaaaccagcaaaatagcattcaataaatgtcttgcccagaagacgaggcaaaaaaatctgtagatcgcttgcttcaatatgagaaactgcagcaagtttttcatcccatgcccaagtttgttcctctaatatcaatgaacaatagtaaaatgcctgctcatatggttgtcgaaatttgaaattctcgtagtcctttattatagtttcctgatgacagcaacaaaatatgaacacacgcagctcatgtaatgtaaaatgcatagaatgctaagttaatattgcataatcaggaagatagaaggtacgctagacatcctaggcagacactcttttgtccttcaagacatcctaggcagatagaaagtacgccatatttaatccaattagaattctatagatagaaatgcatatattaggaaatatcacaactgttgtttatagctttttagtcccgtttctgcactgttttttcctaaatgaaagtagctcatgcttctgacaaggaatctcctgactgttttatacatgtccaaatgacaaccaaaacaaaaattctagcaggtctgcagaagatattttaacaaagaaccacatgtaaactgagcatggccgttacctttataacagcaaaacggtcaaccttcacttcaaactcagcaatttttccaatgacagtatccagaagggttctcattttgtcattataaccgaccatagttatctgtaaggaaatcataaatattggacggttagaaaataagaagatttcataaggaaaagtctcataacacgccatgaattatgactcgtttagaaggaacagttgagtgatagatcgcaatttacaaacatacataacaaagttttacaaacatgcaacacaccaacagtgtcagccactcagcctgctaccacacagtatacatgaaaaagtaacagggattaggtaatattgaccatttaatctaatatagaatataatgccatttgtatatgcacatatgaaaaaagaaaacaaatggagaaaaagctgctgtaagactgtaacttatgaaagcacatagccatgtacatcttctaattacagtactaatgatgtctttattgcaaactagtccagttaagaaaatgtacatctgaaccaatatgtggaaaatagttccaagtgtcaagactgatgatagcctacttcttgcttctatatgcaacaggaatcaggattttaatattaaagattaaatgagaatcgaatggcaagcatctgcttattagtaacacatattaccatttttttcatacttgcgcaaatacagtatgtgtttaattaggagaaacaaaaaagtttgagtatagaagcgctatcggtattgatacatattgactgaagagcttggtgtcatggtgtgcatcatgcatgggttatgcgcatcagatggaacacattgtatgaatatatgatgcaggaaggcctgcaccatagtacgattgtcacatgacaaccatatcagcagcatgcaacaagtaccaacatagatgggtataagagtgttcgtactggtttaggtgaaaacatggctaaaggcaactaacatgatgaataaagtaggtggtataaaattattgtgtagttggcaatgggcatgtggtatgtgccacaccacacaagtttaatgtcagtggaaaaccttttatttggtaacttccaagctgcgatgcaataaccctcgggcatttgaccaagaatatttttcaaaaatatatgcactttgtgatccccaggcatatttccccaaaataccccttctgactgtacctatctccgtatgtttcagtgctctgttgattgtgagatattattaaagggtactttcattacattctaaataaattgttttttcgttttgagagggtaagccagtagattgtaattacttggatatatgcaatttagtcaaaagtaataaatattcaaagtggaggggagttaacttatatcaatgcaacagttcaatttccacaacaaccaggaattccttctgaacccgcaggaatatcatagaattttcacataaaacaggaatcggggaaaattccgtatcccaaacagagcctaagagaagtatgaacagcaggaccctctttactaaaaataaaaagaagattcagcaaggacaattattttcaataatccagtataattaatgctcacaaggagtcaagttattcaatcttttctgatataattagtgtgatgtttccatcaacactgcatcatctggattagcaatgaagataaacaatcaattatgtcatgcaaactgtacagctaacctgaaatccagtgtcacttggcctaataaagtagtaaagaccagcaatttgagcatcataagctgaaagcaaaacaaagttggtggattattgcaacagataaatgaaccaaaggcaaactaaccagaggatgaccatgtccttagtccctctattttctaggattgataactgtatgtggagaacgagttcttgtttcggccaacaaaaagaattttccaacttctccattagtatatgtcaattttatgatagaacattgtatgaagagaagtttgaaatatactaaacaatttcatgaacctgtgccataagaatcataaaatattgagatatctcatgtattactacataccaaaatcattcaaataatccattatcaacctcgtgaacatatcagtaagaactgtcgattcaggagagctattggacagtggacagtggaaatccatcttgacgtaggccttgggtgtgaagaacattgtatcaggcttataccatactcttgaaaacattgttttcctaagcatacaaggaaaacttccctggataaaccgaaaatatcaataaagtttcacaaaataaaattatgagcatttttttttaataaaaaataccttttcctcaacatttttcaatgaaagatcacttggaatgaagatattaggttttggaatgtgcaaatcttccatgggagccatatttacccatttctgtacaaattatgttagaaatgtgtacaattccaaatatattaaattggagaatatgataggaacagtaacatccaaatgtacacctgtatgatggaaggagtgactgcttcaactgaatatgatgtaccataccaaggctctgttaagtttgtttgcccttcaaacttttttgattcccagaatattctgaaggagatgaagaagataacccagaagtattaacacccgtaagtaaaagtcacaatgaaaataaaatctaaacaaacagatcaagtgtgtgaaaggaaaaaataaagcaaatggccataagaggatcaacgatgagtgaggagcctgttgctgctttttggaagttaacaataaaaaaaatgcaaagggacaagtaatgaaatttcttccgctttctctgagaaaaaaagctcaaatttatgaaaagtagtgaaagttctcttggctgtgccatccttctagaagagcactatagtgttttataattgattaggccaagaggagtgtgaagcgacagctaaatgcaaagaccgatcattttccaaactacatgcagtagttgaagagtcacaataataagcatatgcatacattatactgttattgctgaaatgaacaaccaactcaaattggctagtccccaattctgtatgataacattaaatgcatgagattactgtcgtgaatagaatacacattgttgtatctttgcagtctcatactgatccgaaattttccattcgaaattgtgggatacaagatgtgctggaagtgctcctgaaaaatcctaggaatcatgtctaacctaagtgtacgggaagaagcatatgaagattttacaatgtggtacatgaaccattcaaggcatcaaagatatgtagcacaaatgaattaatatagatatgagtttcctaagaaagtaacttttgaaatactccaaaaaagagagtataatacataaaatataacttttcaacaaacatgtgctgaatattaaaacataaaaaactatgactaaaccttaaaacagaacaggaaaacccaacaaggccatatggcctggatgtactcaaaacctacctaacattatctggagtcaagtcatttaatatattctgaatagcatctggagaaaactttgatggcacagatgatgcaatcagccaatcttccggcggaaagatctataatagagagagatcatgagatggtgatactgagcagaattaatttgcaatttatgaacaaacattttggcataatttattaggaggaactgatcatttcattgttcaatgaaatatcatgagctggccttcttgttaatttcattttgtgtaacgaaacaaagtagcctacaaacataagttaagaaaagctaaacagtttttagatatgccactccacttcctcccagtcatacgcatgtgaatctatggggaatgcagatccgctcatgtagaaagcttcaattttgtgaatttggcgatattctgttcaaatttgactaaaatttgttcaaaattttggtatatcagcaccctccaatagaaacgtccaaacctaaagattaaaccctggggggggggtgcatatgcaaaaatttcagtcttttgggcctctgaaaactcggatattttggtcaaactacaacaggaagcatgaaaggatcataacctacacagaagcctagagcctcattagtggaactatgccccactgcatccttgctgacaggatcacgttttctctcagggaagtgttatggtagatgtgactatcacctccaaatttatcgatatcattcactcataaattaagaggcaacccatataatatgtcacatttagtacacaagcccagcaaaaaacatttagtacacaaatacattgtaatatatctaatactctcacacccttcttgaaatttgtgtggaggttgcctcttgatttaggggtagctcatcatctctctcctcacttatctccaccatctcatcacttaatccaatgtggcactcttaggggcagcatatggagcattatagtacttgccctcagcgacttctccctcctcaccgtgatccaacttaccgctagtcgctagagagtacaagtatctaatggctatgactagagattgccaagctgatccaggcattaccacattggtctcttacccctagaagccacattaatcaccttgacacataagacagtcgtgcaacatggagtcagtgacaaattgcagaaagaagggagttatctggtggcatatagttcatattctcacttcatttgtgagggatcccacctaatcacatccctatgaattcaaccgagtcttatccaacaactcataggagtatcaagttacaaggttttaaagtagcacagcaatatagttttgcactagattctctcatacaaacatgtcactgacaaaatataataataaggtgcagattgatagtagaattaatgactggtcattcttgacttttgcatgagcactttcatgccttatcaaaagtcacatctgtctaatcagaaaatagttaggtagtaagattttaaaaagtcactttcttttataagcaaagagaagtctgctttctgccctcgattcaaacttttatgagaaacagagatggaatactgtttctcgtaaaaaaaaaagatggaatactgtgataccaccacctatcaggcccgacgagcggtccactgtataggaaaatgggcaacaatgggactcctaactctttcttgaacatgcaggaacagtcaattgcaattaaaacagatgctattattgctaacttccttttaaaatgatgacaagacatgataaagattattagttggcaattatggacatgcaatacagatgcccaaagcaatgactaaaatatacctgcatgtttgaggaaatattgacaacataatggataggaggactcttgtctcggtagtggaatcccatctcagaaatagctacaagcttgacaatcaaaacagagtgaggtagttagctgtgtgcaatgctaaatggacttcatgtgcatcattacaatttacaatgtcgcaaaaacacatagacactgtcattatcgttcaccagttagacaattatacaaattccaagcattactatagtagttggacaaaatagaatttgaaggaagcacgcaaaaacaatgtgaccctttgacaagcattactgtagtagttggacaaaatagaccctttgaaggaacctaatgcatgcagcgtacacaaaaacaatgtgagcaacttgatgatatggtcacatactcatgtttcatgattcatcttgaaaaggtaaagtataattaaatttaaatattaaatagtagctccctaaaatgccatttatagagggatattgggtgataagaaaaggtactggtcaaattacgacaaattagaccaaagatcttatgtacaatcctgaccaaaacaataatccaatttaatgacttcattaatggcctgattgtttaaatttcgaagtagcggtatcagcccaagaaaaatttgcaaagcttaaacggatgtcacgtacagcttacagttgattttggtcattataaaaaaaaaatctattcccaaaaggtacacaaatccaaaaccaaaattcacctcatcaaaaatccactgacgagttccagaggtctggagcaatgctatgtatcggaataacagtccaataatgtcctccatgtgctctatcatcaatgatatgaaataggtaaatattatatacactgtaaatcttcagtacttaaaagtaaaatttgatcttccatcaaaaaatagtaaagtttgatcatatactatccacttagattgaaattaaggatttaccctcctgactctcatgtgagtgaccttgattaccccacgtcttttttttatgcaagagattaccccacatgtcattggcacaggagggtaaatcctcaaaaaattgttgttaaaaaggcccttcttgaatgaaactcaccatagcctacatctgtgagctgtataacaacattgaagaatgaaaactcataactccagtcaccttcccatgcatacaaactcatagcccatcctgaggaatttaacaaagacaaagttaaaaacaacaagcactatgaaagatatatacacacacccatacatagagagaaagggaggtgatcaggtgaggatgatacgtgggttatgtccacccattaagcacagtcaagtcactatttatcttctttattttgttgttgtttattattgattgttatggtggcattatcactattttcctacgtagactccacataggtcaccgagagacaccacggtttaggcacagaggggacatgtggacactttcgaaagttgagggaccaaaatcagaccaaggccatagtttaagggactaaatgtggaccttttccttttctttattgtgtattgtttgcctgttccattgaaactttactttgatttttccttgacaaacctaatgtcatttttacataacaaagtcaatagcttcttgtatcagtagccaatttttttgaggtttggctgcacataatctaaaaatgaaacctatttgaggaaggaggtcgcagtgaattattagcacaccacctaaagaggatattgctgttatacctaaatatcctcgaatgaaacattaaataaaagcaaaggaataagatttcatctccagatttttcctatataacagtacggaagaaccatacagagataaaagagttgaaaacaccacacgaaagcatatacatagaaaacacaaaagcatctggatatgtgcactacaaaatggcatctcaattggaaaagcaaagtaagactaattatatgcatttggatagtaattatatcagaccaagaaccagctcaacacgtcacctcgaaagatggatataaactccaaatcagtgaatcacataacacaatctaaagtagcattcttgaattaaatggcgctatcatgtctaaatgcttcatcaaagtgcgagtacaatcctgtattaagctgacaataaggtcagatattcacattaacagaaatacgtaatatcttgaagcaagaagcatagaaccagaggattttgtattcatgttacaccaaatagcctatggactgaccaaacagccccaaacccgtccaccagaaaagaagctgaacttctcatatatagcttacctaaattttttagcacgtaaaatagagacccctctccttcatggccaactagacgactcacatacttgcaaggcccttccttatagtgctgaatatttggggtgattggccactgtattctcaaagtgtggccttcttttatgggaaccgctttaacaatgatctgcaggtcattaactaccatattaaaacatgttaaagtatccttacatttcaaaagaagtgccagatccagtggtgcacttgacttatcaacctatttttagcaaatggaaaatataaacctggagatgttcacttgaacatggatgaccatgaaaggaaaaactttcccttccagtattcctgacatcagagaacttattttcaacaagattttgaaggttgtcaagactctctgcatacacaagttacacaacagataaaagaaaaaaaaataatttgaagaatttgtacacaaatgaaaaatataatggtgtaattcagtttgatgaaaacctttgccatacacaacaagttgcatcaaattagctgagtaatgtgaattataaaatttaataagctcttccagtgtgtccaatccttccttatttggattaaccagcaaagtgtccaggtttcctaaaataatagatgatcagaatattagtgaaaaaaatagtcgacctttctatcatgtaaaaaaatagcctcttatttggctcaagttaaaactcccacaggttttgattccagagaaataatatctaaaataattttaaggtgtaaatactccctgtcctgtatgtttgttagacttcaacaaagtaatctccaattcacatatttggccagtgacttttagtggtagtttaattttgactccactattctgaaacaacattattttttaagaacaagcacgatactgaccaacagaataaagtagaatcagagggcaggcatcaattattctcaaagtataagaaatgtcaaagtacttcatgtacaaacttgtgaattcagtgcttgttcgagcctatgtggtcctcgccaagagagggacttgatgggttagaaaaatagaggtgtatttgccagatctaagagttgcacaatctttgctcattcatcacaacctttgcccattcatataactaccatgcctcaccaccaaataaaaaaagggatacgataggtggtgctgagaaagatcagctagatgccgagtaatcttagttaggttgtgctggaaggcatgggccgacacaaggggagatgcaaaacatttgactgacaaaggcacaattttacgtgtttctatgtccttcatatgctattgtttcatttgtgaaatcagtgttttttcaaatgatcctcatggtccacatggatcaatatcaatacagaagaacttcaagaaaagatgtgtgtgagccttggatgacagaataaaccacaaatgaagagaatccatcatgaagattgagaataccataaaacaaatggaccatcaggtttacaaatgcagcctttttccttttggaatttggaaggatatatagtgagtttttttttccccatcatgagcaatataagggcattcaactagttaaaaacttaaactcagaagttcatatgacatggatattttctgcaacattacaaaacgaattcttgacttcagcatgcaatacttgtgagttgtggctataaaatgaagatagaaacatggtaccaagcatatagttgcaacatcagacactacaagaaaatgaaatgatgactaaaacacacaccagtgctaaacttgtgatatggatggctctccgagcaaaaatgtttctggagctgaaaccaaaagattatagacaacgaaattattatagcatgaaagagcatggtaacataaatgaatttgacagaaacaattgtaataaatcaaaaaaaaatcatattacaccgctcaagaagaaatgtaaaatataattaaattaggtagaaacatagatttagatgtcaaaaccactatcagagctgggttgcattgctctttaatttggggggacgggatatttttagtcggttttatacttttgttagttaaagtgtgatttttagataaaccctataaagtaaggggtgtaatatagatttatcccaaaatcaaaatagaatatgagtatgataccattcaactataacagaaaatattccactgcgttgatgtttttctaagataaaggtacctgactcattcgcaaaggatctgacaacaagtttttcttattttctgcaggtgaagaaaaaaaagacagaaattagaagttaattctctcagcagaaatgtcagttccagataagagagaagcaatatataccagagtcaacagcattaatttcccttagagttgcatcgggtgagatcaatggctttataaaaaattgtgcaaacctaaaacaacagacgagaagcaaaatgaatcagattctgcaaaataagaacaaaggtgaaaagaaagaaagcagtagaaggtacctatccaaagcatcatccaggcaactattgttcacatcaaaataaaagtttgtacgttcacgacatgtgaaggcgttggttgaaccaccatgctaaaagaaacatccatatcacacaattgatgatttcaaagtagagaagaaaacttaaataccatgatattctttatatgaatttatgaacaattatgccccctattctttaactatatcagaggccagccagacgatttggttttcccaattagtattgttaataatttaaaaggctaaacctctgcttgcaaatctccagtagcagcataacattggaggaacccatggttcaaggcttgaagcactgaaggtacagagcttcattggggccaaacttggcctacccaatgattgtacagtctatatgatacttcctccgtcccaaaatgtaggtattttttaggttggcacggtattaagaaagtaggtgagaatgattggaggaagtgtgtggttggttgaaaagagaaagtaggtgaagaagaatggttgtgattagttgagaggaggaggtaggtgaaaaaaatagcttcattttgggacaagatactgtgctagaaatagctacatcttgggacggaggaagtaagtacttgtatttggggcattttacttattaagcttcaaattggtcccatatggattaagccactcgtgcatcattagtgttgaaccactctcactctgccactgtaagcactggtgcaccaccgcaaactcgcagcagtaaatatatgagtttactcacaagtcacaagctggatactatagttacgtgtgcctattatactgttaccaactgacaactggtactctaggggcaaaagggcagtaaccatgattaaaaaaattaaactagattagctctacagatactgaatttctctaatcgcactctgcttaaagtactataaatataaaaccaaacaagtggcatctattggcataacaggaagcatccaagaacccccaaaatgtggtacaagtctctagtcattgccagtaaattgaacgtagactggacgttttgcaaagaatgcagtatgctgaagttcaattgtccttccaattgttctgaagcatttagattaagttttgagatcaattttagttcgatctaacaaattattgaccacgacaaatcaagatcacttacaaatgtcctcttcaaattaacagaacagataagaaattggccatacatacctctgcaatatactttgagtaatcgtcttccacagggtatttctcgctagcatagaaaagcatatgctctataaaagaagaaccaagcataagtgaatcaaacaatacagagacacatacatgttaattactgcaaaacacatgccatgaagctctctacatgcgatagtacaatccaaccaagataaaaaaacaattcaatgaggtttgaacagtgcctggtgatgcattaaaactctttaaaggtacacactagaaaatatataaaagagcaacatacaaaacaaggcaaattaaacatacactaagcacatcgatagcatgacacacagtgacacaagaaagttgtgcttactttatctgtccaaggaaaaatagttacaatgactagtgagtaaattaattttctaattgaataacagtgtctccttagatttttacaatcaccttaagtatccaaataatatgttcgaagcactctggtgtcgaaatgaacctcctattaatatatgccatccatttcaatacagaggcaatatagcatgtatatgtattacaatattagtataatagtttcaatcacgaataaaatttctgaaacatctgatccttcaatgaacccgtgagtttcagataagtaagccattttaaggcccaactgtatttttctcttaatgccctttcacatgtgggctttgacatctttgcagattaatcaagtaaatgattagctcatatacctttgaaggtatgggccattgtcgcttattagctggatattctgacagcacctatcaggagatattgatactgaattgatacattgagttgcacatgtgaatcaatcatctgtatattttcctggccatgctatacttgttttaatcttctcatccagagatactcagcatgatgctggaaattcattttcagatgttttgcatatatttgtgcacatattttacttatccaaaaaaatatatgaaaaagtatattttccttgcatattttctatgtgacaggggctgtgagaaaaatatgcatacctaaatttcgaccttcttcatctttattacattatcaattcaacaattaaacaactaaaaagggacatgtacatattgtaacagaaccaagccacaacctcaaacagcttggtgtaaaaagccagcaaaattgtagtggtaggctaatagcaggcctgacactgcaacggaaatgcatggagatgatagagatcaattgcataggcatcaaggcccgaacgcactgagattatcattactaacatcatgtacagtgagagccacttaaacggaagcagctaactacaacggaaatcatactagcatccgttcaagccaacaaaaaaagaaaatcatagcatccacgattactaatttctcagaggttttacgcaacaagtcaaaacaggaagctcaccaaggaaatgtgcaaggccagggagcctctcgggatcgcagaagtagcccaccgagacattcatcgacgccgccgcctgcaaacaaacaaagccgggattcacccattcaagccaaaaacccaggaggcaggcaccaaaacccccggcacatccccgatcgaaggagccagcgaaagcacggagaccttgtcggtgtcggggtcgctgacgaggaggcactcgagggcgttggggagcacgacgcggcggtacccgcgcttgtcgttgcggggcctggtgatctccgcgtcgccctccgccgccgccgccgccgagggtgcggccgcgaccgcgccgtcggacgacggctcggcgggggcgtcggtcgtcgtctcgcgcgctggcctcgaacccgccattgcggccgccgcggattcgccgccgctggcggtgggtggtgttggagttggagtggactgcgtccgcgaagacgcgaagttggcttggcagttggaacggcgagtaacaagttgtccccggagacaacgcgagagagggtggcacggcagcagtgggtggacctgcagcgcgggttggtggacttggtagttgggcacgtcaggagtgggcaaatgggctgggccggaatgccggatttgtgcacggcggcgtgcaccgggacatctttctgtttgaagtccggcgtgtaccgggacatcttactgtttgaagttcgaagtcaagtaaacgtctactcgaacgttcggaatttttacggaatgggaagaaaactactccctccgtttcataatataagccattctaacatttttcacattcatatggatgttatatgcgtagattcactaacatccatataaatgtgaaaaatgctaaaattacttatattatgaaacagagagagtagctaggtgtgccatagcagatgcagcatacaaaagaggcagcgagtagaaaactgaaacgcagcgaggaatgtgacacacatgcagagttttcaagcaaaatataagcgtcgcctgcttcggcagctttgctatactctccatgtgtagattgcagtgggagctgaatgtaactttctcgcggcacatggttccatttttcaggaagagataacgtccaaagaaacaacagcgagctcactgaaacggaaataaaatttggagctaaactaaggatctgtaggtggaaccgtggaactgtggaagcacctctgctctggtggttacgtcgtagggtctgagcccacgtaatgagaaaccacaaggtgatctccagtcgtcagtcacccttggtgccagcaaaaaggagaacgaaaggtcgtggcgatagaaaatggtggaatggaaatgcagaagtatcaacatctgtccacaaaaaagtttctttaataatgatcaaaattacacgtaaaaggattattcttttggaatttgcaagaatatcaaaagggttgacttatagcttcatctgaccaacacctcccttgtatgaaccatataaaggtctcgacctcctgaagttgaatatatctgttatttgataggaatttggtcgtggctcatcgtggactatcttttcgtactccgaggaatggagaccgccgtaaacttgaatactgagtatcttcttttgtggtgcattaactttgacatgattgttgaagaactctatcaactcctctttcttaagatccctcagtgcagcaacctgcagttacagaactccaggttttgaaaactgatactacatcagagggataatgtaaatatattgagcatacctccacttcttttcgatcaaatttcagagttccttccgaaatctctccccagaagaaagctgattcctctcttatattcttgtatttctccaacttcatgtcaatgagagcgttcacgttactctgcagataacagaagccactgtttagtccgcatgatgtttacaagtacaaaaccatgcaatttagctacggcaagctgtaatagaagccaatgattaacagtgagtcagtgacatcatctgtccaaccttgaattctgtatcaggcatttggtatagagttccttcaaacatcgtaaggaaagcttcaactctagcatccaagttggctggatcctgtcaaatcaatatattagaataggagaatgattgtttcagcgggtttgaaactgcattgagaaatatatctaccttcacggttgactggattataaattgcaaaccacggacacctgaatcatttctgggtaaacaggatcagtgtcaatgattttacaggaattgcatagtctacatatagaacaccattcttgccaaccaaggcaaaaagaccactgtacatcctatcaattacgtgaaggttgtacgtacttttgtctaagcagtgttatgtagccaagttgctcaactgaacgtaattggtgaaaagctggttgcttagcaacaagagcaagcaactggagtataacattttttttgagatcatcctgatgaatctgcgcaatggaaacattgttacaggatagtaatgtctattagatgtatctttccagggaaaaactataataattcaagctagaaaagaagctagagtaagagcaaggaaaaactgtaaatgcacagaaacaacacccaagaagtgaggcacacctgaatataatgcagaaggcaagaattttcatcctggtgatttaggcataatgctggataataatacctcaaacccctttcaagctttacaattcgctttgtaagatgctgtgatgagggtaatgctttgcacagactgacaggtgcattgaataagatgtcttcaacatgctgcataacaccttttaccgcacccggttccatgttccctaatatcgattatcaattacataatgaattaataacatcaacaatgcagagcattctctaaagaagagagtagtgtggctacaaaagtcattagcagcattacacggtaattttatgaaatgacacatattcatgttagttactccctccgcttcatattataagtcactttgggtttgtcctaagtcaaacctcaacaagtttgaccaagtttatagaaaaatatagcaatatttccaacacaataaatatgctataaaaatattatcgaatgatggatttaataagggagtattaaacaaaccagcaaagtagctctcaataaatgttttccccagcagatgaggcaaaaacttctcgagatcgctagcttcaatttgagatactgcagcaagttcttcatcccatgcccacgtttgctcctctaatatcaatgaacaatagtagaaagcttgctgatatggttgccgaaatttgaaattctcatactcctttgttatagtttcctgatgacagcaataaaagattcacaccctcagttcatgtcgaatgcatagaaatatagcttaatattgcatcatcaggaaggaccacaaaatattgtagaacataatatatactccctatgtccacaaatacaagggattttagagtactagctgtctaatcaatcacctctcattcaaatttcttcccatcttactcccacccaccccacccaaccctcattgaacatgagcatcctagtcttttatcttcatccttgatctctccaaaaacagagggagtatgctctttcacctctccaagatagcatagccatatagaaactatgatatgtttaatccaggtagaattatatagatgcttaaatatccatatgcacctggaaacagctctcctgctgtatatagctgttcagtcccatttttgcatgggaagatagtaatgacaaaaatgttgcatgtgtatgccactaaatgttttgcagatttgctcagattcctttgaattactttacctccagggaaaacaatttcagaagatagtgaggcaaatgtcttcttttataggtttttacctgtgtgccattaaaaaacatgacccctgcctctgtgccactaaaaagttcgagcctccctctatgccatcgtcgaactttatcgtgccctccacaccattccgtcgctattctgttagggtcttaaccgtttggcagcactgacatgtgggcccggacaggaaaaatgtcgctctggccctttcagtcgcgggccccacctctcatactctcacctctctctttcccctcttccccttttcctctttctctcttgagtagcgatggccggcagccggcggcgggcacggcgcccacccgcaggacgactcgcgcaacctcgtccaccttcctcgccggccaccaacctaccacgcgggtggggcccacatgtccgaggaggacgacgactagccgccgctgctgccggtgcagaagcggccgcgcgacgcgcgccggaccaggtgctcgacaacgtcctggagacggtgctgcaccctcgccgtcgcctttgcaccctcgccacgcccgccgcgcacccgccggcgagctcgcactcctcggccccgccggagaggccggcagtcgaggcgacgacgaggtggcgcggcgaggtcggcgagtaggggggtcgtcgtcggggatgtgccggctcctcgccgccgaggaggccgtggcgtccgcagccgccgccgccaccgtcgtcccggcgctcttcatcggtggcgccctccgtcctggctctctctctctctctcttttctctcaaccctaagggcagcaaagtcatttggctacgctgtttgacaccgttaggactaaaaacggacggaatggtgtggagggcgcaataaagttcgacgatggcatagaggaagtcttgaactttttagtggcacagaggcaggggccatcttttttaatggcacataggtaaaaacctccttcttttatctttgttagattcaaacagttcactggagacatcagggaaatgaaaaaatgtatagactgtacatgtatattttgatttctgatcaacaataagtattgtctacacaatacttactcccttcagtaaagaaaaaggtaaattgtgattctcggagtcaagacaatgcccactttgaccactagattataacatcatatgccctgagaaaagtacattgaccactgatatcatgcaagtacttttcatacaaattgaccaatcaaggcaagagatgtcattttacacgtttacgccaatcttaataagaatacacaccattatctaaagcagacatgcccaattgtccacccatgaatgcaaactaccgctttttcctaaacagaggtaacttgtggctaacaaggaacctcctgaatgtttatactcatccaaatagccaaatatcaggcctgaaaagatatttggtaacaacaaattacaagtaaactttagtgtggccattacctttatcacagaaaaacggtcagccttaacttcaaactcagcaattttcccaataacagtctccaaaagagttctcattttgtcattgtagccaaccatggttatctgtaaggcaatcataaatattggagtattagaaaagaagaggattttagtaagacacgtaacatgccatggggtctaacttctggagaaggaataatatcaacatcacaaaacatgcatgatgaaaaatcagggttatgcaatattgaccatttaatctaatagagagtatagtaccatttgtaatccacaaataagaaaaaaagaaaacaaatggagataaaaggccctgttctattcttcaactttctcgttttctgttagcacgtttttcaaattgttaaatggtatgttattttaaaaaattttctataaagaagttgtttaaaaaagcaaataaatccttttttcagatttataatagttaatacttaattaatcatgtgctaatgaggtttctcgttttgcgtgccataaaaatctatctccaaaactggagatcgaacggggccagatgtagcaacttatgaaaagattagatcatgtacatcttataaattaagatcatgtagtaatgaagtatttacaaaccactctcagtacttaactacatctagttaaaaaaatgcacatctattactatctccctacatattgcttccttgaacatgcatgagatattattgaagtgtaattccattgaattatatctaaattgggtttttgagcgtcaagccagtaaatactaatttgatgcacatcgtttggtcgaaaaatggcacgtattcaaaaaggagtagcttagtatcagtggaacaattcaatttccacattaaccagaaaattccttttttgaacccccaggaatttcataaaattttcacatggaacacttcaactccctcaggaatcagaaaaggaatgtgcttatcattatcaacagaagcccctccccccggcgggattaacaatgaagataaacaattgttatttcacgtgaactgcacagctgacctgaaaaccagtgtcatttggcctaacaccgtaataaagaccagcaacttgagcatcataagctgaaagcaaaacaaagctgttggattatggcaatgggtaaatcaatcaaaaggtaacttaacaaggagatgacaacgacaatgtgtttaacccctcgtttttctaggatgagtagtgtatgttcaggacggtgatttgttttaggcaaacagaaattaaggctctcaagcagaaaagaaccttttccaacttcatcattaatcttacctcctttaatatatcccctctagactatatgtctatcgtcagatcatcgtacaaagacaagtttaaaatacactcaaattttactacataccataatcatttaaataatccatgagcaaccttgtgaatacatcagtaagaactgatgattcaggagaactacgggacagtggacagtggaaatccatcttgatataggccttgggtgtgaagaacattgtatcaggtttataccacactctggaaaacagtgttttcctcaacatacaaggaaaacttgcctggataaaccaaaaggtatcaacaaacagtttataaaaacataattatgacttttttaaggtggtaaaaaccttctcctcggcatttttcaatgaaagatcacttggaaggaagatattaggttttggcatgtgcaaatcttccacgggagctttctctacccatttctgcacaaatttatacaaggaacttttatgtttccaaatatagaaattggataatataacaagaacagtaacatccaaatgtatacctgtataatggatggaggaactgcttccacagaatatgatgtaccataccacggctctgttaagtttgtttgcccttcaaattttttggactcccagaatatcctgaaatgagatgtggacgataagtatatgatgcccacagtaaaaaaaaaaaaaaaggtagagtgggaaaaaaatagctaatttaaggaatatatagagtgtgaaaggagaagagaaagcacatgaccattaaaaaaaaaactaatgaaaggaacagattggtttttgaaatttgacaaaaaaaaggggggggggcaatgtaagcaaagaaatttctttcaccttctttgacgaagaaataataaaatttctggcaagcaaaagttatcttcgttttttgacatgaaacagcaggagcatatatatatacacacacacacacatattaaatatatgaaagttctcttcgttagatcagttttctagaagtattacaaatttaagtcaacaagaacaatgaatctggtatcgcagagtgatcgaagagcaacactaaaagcatatacagtattctgttactgctgagataaccaatcaaatcacagtgactagtctgcattactgtatgagaacgttatatgcataagatcattatcattaaaagaatacacttttgttttgtaagttgaacggaaaatttctgtttgagattgtgtgcaatagatgtgctggcctgtgcactcgataagccctaagaaacatccttactgttcaggaagagaagaagtgaagattttgcaatgcagtaaatggaccgttcaaatcatcaaacatatgtggcacaatgaattacgataatgatgaatttcctaagaaaaataaattcagagtactcaagagaagaaaaataagtagattataactggatttaagtatggcaaatatgtgttcagataacatatgctgaacattaagtataatattcagtaactggtgttttgaatcttaaacataaccaggagaacctgatatgggcaatatggcatggtcgcactcagaacctacctaacattatcaggagtcaactcatttaatataccctgaatagcatctggggaaaattttgatggcacggacgatgcaatcagccaatcttccggcggatagatctgtaacagtgggagataacgggaaaaaacatgagatggcgatactgagcagaattcaattactgttttggaatgaaccatttggcagaatttattaggtgaagtggaaatgatctttcattgttcgatataaaatcacaatctgacattcttgtcagtttcattttgtgaaatgacacaaagtagccttcaaacaaacaaaacaaagttgtcacatttttagaaatgtccctcccaccgtcctgcccacttactctccccaaatccacatctcctccaaatcaaagatgcaagcatgtgaatctatagggcatttagacccatcagtgcaaaaagctccaatttttggtgcacatcgaaaaacttcggtttgctctggcagcaaagtgatccagtgatgaggaaaggccatggctgcataacaactactggcaagatgagttcttagcaactatgaagaggtagaattggaggaatcaaacaaagggaaagtggagatgtaataaagaggtacttgaaagaggataatggcaacaatgtgcgtgcctcgcctatgctggggtgggtgggggtgggggtgaaagtttacagaaaataatggaacatggtgactgtagagatgttaatactctgagatgatttctcactgacaaaataaatgaaagaatatcatcaatcttgatcttttgcatgagcatactcatgtcttatcaaaagccacccatccgcttagaaaataacccggtactaagattttgaataagtcactttcttctaagcaaagagatgcctactctctgccctcaatccagactttgaagagaaaaggcggaacagtgtacaggaaaacaggcaacaatgagaaattactattgatacacacacaataagaaacaatgatttaaaatagtgaaaatgcaaataaaaatagatgccattattgctaacatcctatagacatgcagatagaacatggtattatcaacatgcagtgctcaaagaaatggctggaatatacctgcatgtttgaggaaatattggcaacataatggataggaggacccttgtctcgatagtggaatcctgtctcacaaatagtttgaagcttgatgataaaacaagtgagatagttagttgtgagcattgcaaaatggactagcgcatcatcataatgtttcaaaaccaaattgactcagtcggtactgttttaacagtcagataaaatacaaattccaaccattactatactaatgacacaataaaccatttgaaggatgcacccatgctttatttgcacaatagaggaagcagttcaagtatagcctcaagcagaagacatatttgtctgtaatagaatgacaatcatgcaataattacttttccctccagttcttttttgtaaatactgtacattttccctctccaaaaccatatacagttcgtccaaaatgctaatggccaattaataaggacaatgaacctcataaatgcagagcgaacaaaaaaaaactgtacgagtcttctaggaagatatggcatgtttcatgattcctcttgaaagtgcagaacataataatttaattaattaacaaagatcactaaaatgccactatagagggatagtggaagcagaaaagtactaataatactaaaataaattactccctccgcccccaaaatatagcaacttctctaccagcacaaccttccccatctagttttacctactttcttaataaccatgcccaactctaaaaatccttatattttgtgacagagggagtactagatacaacaatagaagatattacatgtcagatcaaaacaagaatccagtttaatgaattcataaggtcatttgtaacaatttgattgtctagatttcaaaagatagcactaccaactcaggaagacatgtgcaaagctttaagctgatatcacataagataacaatcgattttggtcattataacacattctatttccaaatgaaacgcaaatccaagaccaaattcacctcatcaaaaatccacttcagagtgccagaggtctgaagtaatgttatgtatctgaacaacagtccaacaatatcctccatgtgctctatcgacaataatagtaaatggaaaatatcacttgcactgtaaagattcaatattaaaaaaggaccttcttgaacgaaaactaaccgtggcctacatcagtgagctttatgacaacactgaagaaagaaaactcataactccaatcaccttcccctgcttccaaactcatagcccaacctgaggaatttaatggaatacaattatacaatgttaaaaacagcaagcactatgaaagattataaattgaacttccctgaaaaatgagcaagtaaactatgtaagattaacataaaccaagaaattatataaccaaatctttggttttccttttagtgtttccatgtattgtttcaatgggggtgttcttgtacttttctttatcgtgtactctttcatttgtttcagtgaaactgtagttttattttccatgagaggtttaatataatttttgcatgacaaatgtttgcaccttttgcatattaatactcagtttgtacagtttggctgcatacatcccaaaatggcacctatttgataaaggaggtagtgaaatactaatgtgccacctaaacaggaaatcattccaatatgtaaatagttttgtacggaacattaactgaaagaaaagggacaaaacttgaagttgcctgtatataatactagtaaggaagcaccctacagagattcattaggtgaaacaaatatcacatgaaaacatatgcctaagaagaaaaacacaggaggcatcctgccatgtgcactgccaagaaatgaaccaattagaaatggcaactcgatgggaaacagggaaagccaagctaaggctggttagatgcattacaatgctacaaattagaacaagaccaagaaccagcttaaacatgtcacttggaaaatatggatagactgaatccattaatcacgtaacacaattgaaagtagtataattgaattaaataggattatcatgtctacacattgcatcaacataaacaatagaaaggttggactgccagtaagatcctgcggtaagttaacaataaggcctggtattcctattaacagaatcccttgaagcaagaggaacattacaagaggattgtatactcaagttccaatggaccaatcaaaaaccccacaactcactcatcacaaaataaattgaacttcttgtataaaacttacctaacttttttaggacataaaacagagacccctctccttcatggccaattagatgactcacatacttgcaaggaccttccttgtaatgtcgaatatttggggtgattggccatagtattctcaaagtatggccttgtttaatgggaactgctttaacaaggacctggaaatcatcaaatatcatattaaaacttgtaatatttcagaaaaatgcacctgattgaagcaatgcacttgatctctcagcccattattagcaaatgataaatgtaaacctgtaggtgttcacttgaacacggatgaccaggaaaggaaaatcgttcccttccagtattcctgacaccacaaaacttattttcaacaagagtttgaagattgtcaagactctctgcaaacacaataaatataagacaaaatataaattgaagaatatgtaaaagagatgagaaaaatagtgtaaagtagtttgctgaagaacctttcccatacacaacaagctgcatcaagttggctgagtagtgtgaatcataaaatttaataagctcaagccttgtgtccaatcctttctcctttggtttaacctccaaagtgtcccaatttcctagagcaataaatgatcagaaaaaaatgaaataaataacatttcaacctttctagcatgtaaaacataagtgtcttgtttggttcacattaaaactcccatggattttgatttcagagataaatctaaaatactattacggtgtaaatattcctgtctcataataagtttgctacaatttacaactttcaccagtaacctttcgtagtagtacataacttttactctgttagtaccttttttttgcgggaaggtaacttttagtacctactccctccataaaaaataaaatcgatttttttacacaaatctggacatagtgcatgtccagattcgtgtataaaaattgaattattttcggacagagtgagtaacttacaagtgtttcttaaaaaaacattgttattatcaaaagtttatgtttgactgcactattctgaaacaacattattttaagaacaagcacagtattaccatgctggcaacttaatgaagtacagtagaataagagggcagatatcagttattctcaaagtataagaggcaccaaagtaatccatgtaggatttgtgaactcaatggctgtccgagactatgctgttctcgccaatgataggaaattgatggtgtacaaatagaaatatattcgcctgatctaagagctgccgtagtgttctcccattccaatcacttccatgcctcaccacaaaatcgaagggagatgccaggtagtgttgcaacatgttaggtagatgctgagtcatattagtctggctccactgttgaaaggcatgggccagcacaaaatgtgaaggcgagcatgcaaaacattttactcacaaggacacaattctattcgtttctatgtccttcatggctattgtctaatttgtgaacacagtgcttttgcaaatgatcctcacagcccacatgtgtcaacagccaaacttcaagaaaagatgacctgatcctcagatgatagaatgaaccaccaacgaagggaatgcatctctttcaagaatacatgtagactggaaacataattatataaaagggctgtccagtttaccaattaaggcttattttctcagaagaacatacagtaagttctttttatatccatatcgatagaagagaattcagctagttaaaatcagaagttcatatggcacagacattttctgcaacaccacaggatcttatcactaagttaaatgggtgaagtctaacatgttcttgaaatatgtatgagttatgattataaaatgaagatagaaactaggtagcaagagttgcagcgtccactgctgacatataaatcagatactacaagaaaatgaaatgaggattaaaacacacaccagtgccaaacttgtgatatggatggctctccaaggaaatatggttttgaagctgaaaccaaaagagaatatagaatgaacagaaacatcataacattaaatgagatgagtaacatctatatctttcaatttaaggagcactacacactatcatataaatacattatcgcagcaatcacattaacatgagggtggcccgactatcaggaataggcaggtcaagcctctaagtggcgaattgcagcctcactatcctaatgagagatgcacaagtaggcaagaaagtaataggtatagtagttttctagtttctagcatctctcttagcatagaacaaagaaataaaaaactaaaagcaataatattttttgctggaagacagagtgacgagcagcagccaggcaccctagcatggcagaaacttcagaatgaatgacccacatattgttctttttcttgctatctgaacacctaaaaagttaaggacaaatggacaacttccatgaaggtaataagggaatgtttttgttcaaactttaaacctatgctcctggtgaggtaagtcatgagccaaacatatactgttacagtatgtcaagcgaagtcaagcacctcaggacaatggattgataactcaacacgcaagtttggaacagtcaaaggcggttctaagtttatctctgacgatatacaaattattttgttggcaaacctttcctagaatcacaacactcttgtcagtaagcaaaacttgtagattcaaccagagatgacaatcagtttcactaggcatatgtttctgatgaaagatcttctgaacaataatacgaaatgcagctatcaggatatccttgcttcatggcattcaaaacaagaacaagaacatcgaatctaacataagattgatagctacagcaatttagaatgaaaaaacatgtaggagtagatgaatttcccaaaaataattgcagtaaatgaaaatgacatatgaatacggtaccattcaactataacagaataagattccactataataatgttttttgcctttttaacagtaaggtacctggttcattcgccaaggatctgataataagtttttctgattttctgcagacagagaaagatcgaaattagaagttaattctctcagaagatctggtagatctagataagagggaaagcagtatataccagagtcaacagcttttatctccctaagagttgcatcggctgacagtaatggctttatgaagaattgtgcaaacctaaaacaagagatgataagcaaaatgaatcatattctgcaaaataagaataaaggtaaaagaaaagaaagcaacaggaggtacctgtccaaagcatcattgaggcaatcatggttcacatcaaaaaagaagtttgtatgttcacaagttgtgaaggcattggttgaaccaccatgctataaagaaaattcccatattacacaattgatgattcatagtagaggaaatacttatagatcatgatatttttgtacgattatatgaaacaactatgcctcccatcaactatgtgaaaggccaggcaggtggcttttccaactagagctgttaatggtttaaagggcccaatccctgcttaaaaattccaatagtaacataccctacaagaactatattgtagtgtgaccaactggcactaggggaaaaaggaagttatccattatcaaacataaactaaattaatcgtacaaatatagatatactctaatggcactctacttttaaagtactataaatgtaaaattaaacaagtggtatctgttaagcatacagaaagcagccaagtacctccataatgtgctacaagtctctaatctttcccaagtgattgagaatatttatacatagaatgagagattacactacattaactttcagctgccacagacccaacagtcatggaccttccagttgctctcaagcattccattaaaaattggattcaatttgtgttcagtcgaactatagaccaaactaagatcacttacaaaacatcgttttcagatgaacatgacaagtaaaaaaatggcctggtaaaatacatacctctgtaatatacttggagtaactgtcttctataggatatttctcactagcatagaaaagcatatgctctacaaaagaagaaacaggcataagggaatcaaacaatacagagctacacgcttatattacaatacatgccatgaaacttttcacatgtgatagttaaatccaaccaagataaaagaaaacaacgcaatgaggttaaaactatggctattaatgtgctaatactcttttaaaggtacatcctacaaactatactaaaatgcaatatgcaaaacaagccaatatgtaactgttcaaattaaacatagactaggctcagaaacagaatgacacataagaaagttgtgcacttgcacttactttacttgtccaaccaaaggtaaatacaatgactattaagtattaaggaaattaattttctaattggataacagtggcacaccagatttttataatggtagtatccaaataagatgttgaaaacaatctggtgctgaaatgaactttttattaatacgtatcatccctttcaatacaaatacaatatctcaaacccactttgacatatttatactgcattagtataacagtctccagtcccgaatgacactgttggtacctttgttctttaatgaatctcatgagtttcagataagtaggtcattttacgtttcatcttttttttttcttttttttttttttgctctctgacactttgcaaattcactaacaaaattttagttgcttattagctggatattctgacagcacctatcataagattctacaatctccgtcccaaaataacttcattttttacccatcagacacataccaatacaaaagcaaaaagacaaaaatgccctctactttatcaaatccgaatgcggttgttcccaaatttatctagtcccaatgcatttgttccccacttccataaactccaatgcaatgattgcttgaaagatgaagctattttgggacaaataagatgatgaaaaatgaagttattttggaacggagggagtagtgttgaatttgtacatttttttacatgcgagaatcatagttgaaaaaaccgaaccggatcagcagcttaaccgggaaagaggaaaaacagaaccagtttctaagctcgggtcagttatgcgctaggaccattcatgcatttcagaccactttaaaccatttcaaccatcaggtttcacggtaaagtagtgaaccgatgtcaaaccaggactggttgaaccagctgagtttgggctgcactgttgaaatgggtccagaaggaaggcccaagttctcatcaaggcctccaccaacttcatttattctaaatatttgtgataatagctcgagggcagggagtccaaccttggtctctgaactgaacaccacctcttgttgctatcctgccatctcataacttgtgtttgtaccagtagataaactacacagaacagtttgttgaaccgtgtaccactggactagtgaactagcttgggcagttcgctcaacaggtccaatatttttttgctatggtgagagtcaatcatccatgcattttcatggccatgctatacttgttttaatttctcatccagagatactggcaagaagctggaaatgtcttccagatgttttgatggatgtgatcccaaaatcgcaaaagtagcaagctgctgtctctagacctaaagtatttttttcttgcacattttcatatggtatgcctgtgataaaaaatatgcacaccaaatctcgattcttcatgttcatgatcaattcaacaacttaaagcaaacatgcttgttatgactgtgtcagtccacaacctgacaacctaaaacaatcttatgtaacaagccaaatgtagtggtacggtaagcaagcctagcattgaattatcatcactaacatcatgtgtagtgattaccacagcagccacgactaccatattctcaggtcttatgcaacagctcgaagcaggaaaaactcaccaaggaagtgcgcgagcccctcgagcccctcgggatcgcagaagtagcccaccgagacgttcatcgacgccgccgcctgcaagcaaaacaagtagtcgcgggattcaagccaagccaaaaccccccaggagataaccaaacccccttccccatcccgatcgaggtagagcgcggggcgagcgaagcgggaagaaccttgtcggtgtcggggtcgctgacgaggaggcactcgaggtcgttggggagcacgacgcggcggtacccgcgcttgtcgttgcgtggcctggtgatctccacatcgcccgccgccgccgccgccgccgccgccgccggtgggaccgcctcggcgggggcgtcggtctcggggggcctcgaatccatcgcgtccgccgccgctgactcgccgccgatggcgtggactggctgagtccgcgaggcctccgggcggttgcggttgggttgggtttggctttggctttggcacggcgagaccgcgagagaggtgggggcggtggatctgcggcgcgggtggtggacagtggactggtggttaggcacgtgaggggtggggggggagatgggctgggccggaatgccgccaggtcagcgtgcgtgcaccggggacatctttctgttcgaagttcgagtcaagtcgagtaaacgatttgtcagttttctccgaatttccagtggcgtgtctagaacgttggaatcaaaaggatagtcactggacagtatggttgtgtttagttcagcgcaaagtttaaattttggttgaaattggagatgatgtgactgaaaagttgtatgtgtatgacaggttcatgtgatggaaaatgactgaagtttggatccaaactttgaatctaaacacagcctatgtgaaaatatagaatatggtacacgattaaattcttctattcccttgaaaacctgaaaagtggctgaggacctctttcctatggcttataagccaacgctaaaatttatcagcttcaacttttaaaatgctaaggacacctatataaaagttttacttatattatttttaacattgataagctgttacggcttatagttagccataagcaactgatacgaatgatatgaacttgaagaaagccattcatcaaatcgctggaatgcaacgtgacaaacaaccaaatttggcacacatgcaagagtacatttttcccatagtaatgcatagaagctacgcagtgcttaactgttcattaataccatgtgtaagagagttgattgtcatcagatgtaaataaaacttatttcacaaatagacccctgaaaaaacttattctataaatggtcctttttggacgccagagtcactggcgttgtcctattgccaccatagcgggtcacattgacatggcaaggggagcgtgccaatgaggttggtgccgcccccctcctccccccacccacgccattttttttcctctcctctatagtgtagaggagatatgtgcaacttttttattttcttttattttttttatatatttttttcacattgaagagcacacaagaaccaaccatagaaaaattaaactcaaatggatgaaatatgtgacctatagaattttccaaagctcaactgaaaagcttctcgcctcgaaaacacaatcttgcaagcgaaatttggagtttctaattttgccaaacccaaaaagcgggggagaatcggatgtaattttttttacatatccatggatatataaattgtctgattccgagtccgtatgaatgcctattaaaataaaggacactcaaatgtaaaaaaaaaaaaaactcaacaaacccatttttttatagaatgtaaaaaaggcaatgtacaaacttttttttgtttttttactataggaaaaacaaaaacaaaaaacaacgagtgaattttaggagaggggagagaggggggggcgctcaaggggggagggggcggcgaggctagcacgctcctcctggcacgttagtatctgaccgccacggtggcaggggcgacgccagcgacgcgtctcaaaaagaaccatttcttggataagtttttttagtgatatatttgtgaaataagtttttcaaaaaactaaattgtgaaaaaatccagtcttcttctccccttccctctctccttttctcatgcaatggggtaggacttgggctgcgttcgagagcatgggttgagaaccctccctctcatgcacgcaaaataaagcgactgtttaatgcatgattaattaaagtgttagcttaaaaaaacttgaagactgaattaatatttttctaaagcaactttcgtatagaaaactattgtaaaaaccacaccgtttagcaatttaaaatgcatacacgtgaaaaacgagagaggtgagttgaaaaaatcggggaaagaactcagcctaaggagggacttgagtcccccacactcacgttggatcagcccctatttgcaagttgctacacttgtgaatcagttctactgggcaagctctggtgatgaatgtgaaacctcataattagaataaaaaaagaatgctgctcgtcaacgctacctttttttcctccttttcttttttttttttctcaccaagttggtataagatacttcctccgcctcgtaatataacagattttgacattttacttatactgtttgatcattcgtcttattaaaaaaattaaaattattatttattttatttgtgacttactttattttccaaagtattttaagcacaatttttcgtttttatatttacacaattttttttaataagatgagtagtcaaacagtgcaagcaaaaaatcaaaatcccttatattatgggacgaaggaagtacgatatatgtgcatacaactgatggtattttttctgctgaggtgcgaattgctttttttccctatgttttcacaatgaaatttgatacgttgaattctggtaatctcaccactcaaaaagaggtgattgaactcaaacccttttgcaaccaaccaaacaaaatatcttcaatacaagatcatttcatacattcatccaaacaacatctcgctacaaccaggatcaaccaatccagccaaccaaacaacctcgttaggatctactcagccaggctatagtcatcctgactcatacgagccaggctagcatgatgcgagcaaccaaaaacaccctaggtgatcactagtgtcacggtcaccctcggtgccagcaaaaaggagagtcgtggagaaagtgtcgaaagaaatacatgcaattttgtctaaaaaaaataagaacagatgaaattacatgccaaatttcgctgcatacacaaatggaaaccaactataaaatccccaaattatatatgctaaatcatccacactaacaatccaaccatctccccaacaggagatttcagtaaataaccaaatacaacgctggtgctaatcatttgattccttattaccgcagagattattctttcggaatttgtaaatatataaaaatgttgacctataacttcatctgaccaatacctcctttgaatgaaccatataaaggtctcgacctcctgaagctgaatatatcggttatttgataggaatgcggctgtggctcgtcgtgaactaccttttcgtactcgttggtgtggagacggccgtagacttgtatactgagtatcttctttcgtggtgcattaactttgacatgattatcgaagaactcaatcagctcctctttcttgagatccctcagtgcagcaacctgcagttgcagaactccaggaattgaaaaatggtacatcagaggggcgatgtaaagaaatagggcctacctccgcctcttttctatcaaatttcagagttccttcagagatctctcgccagaagaaagctgattcctctcttatattcttgtatttctccagcttcatattgatgagagcattcacgtcactctgcagattacgcaaatcactgtttattccatataatgtttacgagtacagaaactgccaatgaataataatgacagcatctgttgaaccttgaattctatatcgggcatttggtatagagttccttcaaacatcttaagaaaagcttccactctggcatctaggttggctggatcctgtcaaaccaacatattagaacagaagaaaattgtttcagcatttaaaatcgcattgagaactctatgtaccttcacagttgactggattgtaaattgcaagccacggacgcctgaatcatttctggataaacaggatagcgtggtcaaatttttaagagggattgcatgctacctggaaaacattattgcaaaacaacacaaacaaacaagatacatcttattatgtacctttgtttaagccatgttatgtagccaagttgttcaactgaacgtaattggtgaaaggctggttgcttagcaacaagggcaagcaactgaagtagaacattttgtttgaggtcatcctgatgaatctgcattgaggaaacattgttacaggattgtaatgtgtattgggtgtattaaggaaaaactataataatgtaaggtaataaaagaagctagactgcaatgtttgtcatatgtttgagagttggctatcatgtgtccccaaagagatgaggaatctgcttttgatgggtgcaacagctctgtgttgatccatttggctaagcaggaatggagtaatttttgataataagatggtgtcttctcctttgtaggttatcactttagttactcggtggctacatacctgggctatcctccaccaaccgggactgcgggatactattgccgtggtatcacaacagttggaccaggtggcgcatgagtttttttacccaagagcatgggtggcggtctagtctatggattgatagccactaagatatatgtttatgtcaaacttttgtgcttgggagatgttctgattgtttctttcttcttttttggctgtgtgcattttatgcagaggccgggggtgactcagtttgtttgtatcatcttgatgtaattaactgagtctaaataaagcttccattatctaaagaaactgctagagtacaaaaggaggggaaaactgtaaatgcacaagaaataaacggaaataacaccaatgaagtgaggcacacctgaatataatgcagaagggaagaattttcatcctgctgatttaggcataaagctggataataatacctcaaacctctttcaagctttacaattcgctttgtaagatgctgcgaggagggcaatgctttgcacaaactgactggtgcattgaataagatgtcttcaacatgctgtataacaccttttacctcacccggttccatgtttcctaatatcaattacataaaaaagaacatcaataatgcagagcattctctcaatgagtagtgggagaaaaagggtcattagcagcattacaaggtaatataaagagcagtactaaagggcctgttcactttgatgctattttcaaccttaccaaattttggtaatgttactaaaaaagtggctacatttagtaggttttttttggcatcaaagtgaacatgcccaaagatgagggaaagtagctgtgaattaacattcaagttattaaacaaaccagcaaagtagctctcaataaatgtcttccccagcagatgaggcaaaaatttctctagatcactagcttcagtatgagaaattgcagcaagtttttcatcccatgtccatttttgttcctctaatatcaatgaacaatagtacgatgcctgctgatgaggttgctgaaatttgaaattctcatacgcctttgttatagtttcctgatgatagcaacaaaagatagaacaccctcactttatgtcaaccgcatagaattctggtttaatattgcgtcatcaggaaggaccagaatgtttgtaaactgtagcaagtcattacctttatcacaacaaaacggtcaaccttcacttcaaatgcagcaatttttccaatgacagtctccagaagggttctcattttgtcattatagccaaccatagttatctgtaaaacaatcataaatattcaaggattagaaaagaagaggattttgtaaaaaatatggctcataacatgccatgagttctgagttctgactcctggagaagaaacatttgaatgatagatcacaatttacgacacgtccataataaagcttcaccacatacaacaatgtcaggttgctaccacacgctatacatgaaattaacagggattaggcaatattaaccatttaataattgagaatctaatgccatttgtatctgcaaataaggaaaaaaataaaataaatggagataaagctgctgtgatgtgagactgtgacttgtgaaagcgtaaaatcatgtatgtcttctatactccagtactactactaatgaggctttataagccagtgcctgtacctaaccacatccagttaaagatctgaagcagtatgtggaagtaagaaggaaaatagttcaagggtcaacactgacaatggtatattccatgcttctatatgcaacaggaatcaggattatgatattataatgatttaagtaagaatcaaatgacaagcatctgcttattagtaacatactatcatcttatcacatttatgcaaacacggtatgtgtttaggacaaaaaatgtttatgcatagaaacactgtcagtactgcatcatctggattaggaacgaagataaacaattgattatttcatgcaaactgcacagctgacctgaaacccagtgtcatttggcttaacagcatagtaaagaccagcaacttgagcatcataagctgaaagcaaaacaaacttggtcggttattgcaacatggaaataaacaaaggcaaactaaccaggggatggcaatgtccttaatcgctcgattttctagcataagcagtgtacgtagaggatgagttttttttccgccaataaaaagtacccaggctctaaacagaaaagaattgtctccaacttctatattaatctcactcttgcatatgtcctttctaaaatgaattatatgtgttagactattgtatcaagagaagttgggaatacattgtaactgtttatgaaactatgccataagaatcataaaaaaattaagacatctctgtattactgcataccataatcatttaaataatccattagcaaccttgtgaacatatcagtaagaactattgattctggagagctacgggacagtggacagtggaaatacatcttgatgtaggctttgggtgtgaagaacatcgtatcaggcttataccacactatggaaaacagtgttttccgcagcatacaaggaaaacttccctggataaaacaaaagatatcaataaaaagtttcccaaaataaaattatcaatacgttttaagaaaaaataccttctcctcaacattcttcaatgaaagatcacttggaatgaagatgttaggttttggtatgtgcaaatcttccatgggagctctatttacccagttctgtacaaattatgttaggaacgtgtccacctccaaacacatagattggaaaatatgataggaagagtaacatccaaattacatgtacacctgtatgatggaaggagggactgcttcaactgaatacgatgtaccataccatggctctgttaagttcgtctgcccttcaaacttttttgactcccagaatattctgaaagtaaatgtagaagacaatcgatactacgtaagtattaatgcctttaagtaaaagcacaatgaaataaaactaaacaaatacatacatcaagtgcgtgaaaggaaaaaaggagatggttgtgataggatcaacttcgtgaggagcctcttgctgttttttggaattataacagtaaaaaatgcaaatggactagtgatgaaatttcctccactttttcgtaggaaaaaacttgaaatttatgtaaagcgaaagttctctttgttgtgtcatccttctagaagagttatatagtgtcttacaataggttaagtcgaagaatctgaagcaacagctaagtgcaaagcctgaataattattttccagacactacatgcggtaattgaagagcaacaataatagcatgcattatactgttactgctgaaatgaacaatcaactcacagtagctagtccccagttctgtttgataacattaaatgcataagattactgtcaaatagaatacattttaagtatgttcatggtttcatactgatctgaaatgaaaacaaaaaacagagtataacttactaaaatacatataatatacctgtgtaactaacatatgctgaacactaaaaacaaataaaaaaaaacatgactggtatctcaaactgtaaacatagcagaaaaaaaccttatatgggccatacttacttaaaacctacctaactttatctggagtcaagtcatttaatatactctgaatagcatctggtgaaaactttgatggcacagacgatgcaatcagccaatcttccggcggaaagatctgtaatagagggagattaggaaaagtcatgagacgatgatactgagcagaactcattttgtaatttatgaatgaacattctggcagaatttattaggtggaactggccatttcattgttcaataaaatttgatgtctaaccttcttgttaatttcattttgtgcaacgaataaaagtatcctccaaagatcactcaagacggttgtcacatttttcaaaaatgcccctaccttcttccctcccacctgctcactctccccaggaccatctctctttcagttcacatatattttcaaacttttttgagggcatatgcaaatttaaactttgggggtcttccaaagctcagatttttttttgtcacaccataacaagaatcatgaaggaatcataagctacacagaagcctagacctagagccttctcattacccaagaaccatgcaccactgcatcgtcactgccaggatcacctttttcctcagttacttctctggttctcccttctcgtccctgatcccactaatgctagagaatacaagtatccaaaggctatgactagagattgccaagctggggcccaggcattcaccacattggtctcttactcttagaagccacatcaaccaccttgaaacatactgcagtcatgcgatatggacttattcagtgacaaattgtagagagaagggagttatctggtggaatacagtgcatattctcaaatcccacccacacatccctaggaattctccccgcaaaaaaaaaaaaacatccctagggattcaaccaagtcttatccaacaattcataggagtcatcaagcaatagggccttaaagtatcacaagaagatagttttgcacaagattcttcctcgtacaaacttgtcactgacaaaatataatataaggtgcagattgatggcagaatgaaagacaatgtccattcttgatttttgcatgagcactcacatgactaatcaaaagtcatatccgtcaaatatctaggtagtaagattttgaacaagtcaatttcttatataagcacagagatgccttctctctgccctcaattcaaacttctaagagaaataaaggtggaatactgtacaggaaatattgacaacatatacctgcatgtttgaggaaatattgacaacatattggctaggaggactcttgtctcggtagtggaatcctgtctcacggatagttagaagcttgacaatcaaaacagagtgaagtagttagctgtgtgctatgcaaaatggacattatgtgcatcattataatgtctcaaaaacacattgacttagtccttatcatttaccagttgggaaattatacaaattccaagcaataataatatactagttatacaaaataaacccttttaaggaagcattaatgctttgtttgcatagtaaaggaagcagtgcaagtatattgcaagcagaagaaatttgctagtaggatcaacaatagaacatgcacaagtactcctccagttcttttatataagttgttttagacagtaaacttctctcctgaaccatctacattttgtcctaacttctaacagccaattaatgtggaacctaatacatgcagcacacagaaaaaacatacgagcaatttaggacgatatgctcacatattcatgtttcatgattcatcttcaaaacgtaaagaactatttaattaaataagaaaaaggtagctccctaaaatgccattcacagagggatagcggaagctcaagtaaaagtactgacccaattacaacgaattggacataaaaatacatgtatcctgaccaaaacaattatccaatctaacgacttcattctgtcgtgtgtaacagcctgattattcaaatttcaaagtagcactatcagcgccagaagaatttgcaaggctcaaactgaggtgacaatcaattttggtcgttgtgacagtatttccaaaaaaaaaaaaaatccaaaaccatagttcacctcgtcaaaaatccatttaggagttccagaggtctgaagcagtgttatatatctgaacaacagtccaataatgtcctccatatgttctaccatcaatgatatgaaataggtaaatattacatgcatcataaatcttgagtataaaaaggcccttctggaatgaaactcaccatggcctacatctgtgagccgtataacaacactgaagaacgaaaacacagaactccaatcaccttcccctgctctcaaactcatagcccatcctgaggaatttatagaatacaaagttaaacacagcaagcactacaaaagattatagattagattttactcggtgaagaatgagcaagtaaaccatgtaaaaataatataaatacaggaaactatatagcagcaaaaccaaatcttgtctttcctgaagaataataaagcattcaaaactaacataaacaaaggaaattatatagcagtaaaaccaaatatttggatttcctattagtgctttcatggtttgttcaaaagaattttcttgagctttactttagttaaaagtccatatttggtcccttaactatggcatcggtctgattttcatccccaactctcaaaaccctccacatttcatccatgggcccaacagggtttgatgtatagatggccatatggcccgacggcccggcccaaggcccggtgatttggcccagcccgactcaggtcgtgcccgtgccggcccggctggacagtcgtgtcgtgcctgggctgctacctcggcacgctgggccggcacggcccggcacaaagttcagggatgcgaaacagacgtattttcaaccatatgtaaggcatggcacaaagaatagggaggaaaaatagacgtattatatggcacggcctaaatagtagggacgtaaaataaacttattttagctatatatatgtcacagcccaaaggagggaggggaaatagacttatttcaaagaagacacgatgggccgcccatgccttcgggccggcacggcacggcccgactgctggtgggccgtgcctgggcctgaggtgcagcccgtgggcaggcacgacacgacccgaccgtgccgtgccagcccgatcgcctcgggccgtgcctagcccatgcctaggtcgggcgggccttatggctatctatagtttgatgtgccaccacatgcatcatagttggcaaattaaaaaacaaatatatgggttctagtattttctttttctattgtttacttttgattattatggtgaaatttttcattatttgcctatgtagactccacataggtgccacatcactgaaaattgtcccggtttaggcacagggatgaaatgtggatggttttgagagttgagcgaccaaaatcagaccaaggacatagttgacggatgaaatggggaatttttccttttctttattgtgtattgtttgcttgttccaagggaacattagtttggcttttcctaatgacatttttacataataaatattaatagcattttgtatattagttacaaaagtttttaaggtttggctgtacatataaaaggcacccatttgaaggtggtatgaattatcaatacaccacctaaagatgatattgttgttatactttctccgtcccataataagttcatttttagctccttccatttctcctaaaaataagttcatttttagagtaatcaatgcgtcagaatttgtgaaagtagaaaaataatagtattgggagtagataaagtaactagtaaggaatagttgcattgggatttgataaagtaggggtattctagtcttcttagttttgtattggtatgggtaagatggatgcaaaatgaacttattttgggatgagggtagtacctaaatatcctagaatgaaacattaactgaaagaaaatgaatttcatctccagattttttgcttatactccctccgtccctaaatatttgacgtcgttgacttttttaaacatgtttgaccgttcgtattattcaaaaacttttgtgaaatatgtaaaactatatgtatacataaaggtatatttaacaatgaatcaaatgataggaaaagaattaataattactccctccgttccaaaatataaggcacaaccacccttactccaaagaccaagaaacaattattatcacctcctaatttgtatcaccctaataaataacatgcatgcacccaatagaattagagatcttgatggtggaggacttaaaaaaatcataatttaatggagaaaagatactaactaattgcatacatgcatgcacgccttatattatgaaacatctataaaaagtagttgtgccttatattatggatcagagggagcacttaaattttttgaataagacgaacagtcaaacatgtttaaaaaagtcaacggcgtcaaatatttagggacagagggagcatatgaaagcagggaagaaggaagtgcacagagataaattaggtgaaaatgacaccacatgaaaacatatgcataacaaaaacaggcatctgtacatgtgcactacaaaaacattagtaatcaactgtaaaatggcatctcaatgggaaaagcaaaataagactaattagatgcatttggatagtggatcaggccaagaaccagctcaacacatatcaccccgaaagatgggtagactctgaatcagttaatcacataacagaattgaaagtggcattcttgaattaaattgtgttatcatgcttaaacacttcaacttcatcgacctaaacaatagtaataagcgacaaaagtgacaaaagtcagactgccagtacaatcctatagtaagctgacaataaggtccgatatccatattaacataatattttgaagcaagttgcatagaaatagaggattgtgtactcatgttacgtcaaatagcccaggccagccaaaaagccccaaaccgacccaccagaaaagaagttaaacttctcatatagaatttacctaatttttttagtacataaaacagagacccctttccttcatggccaactaaatgactcacatacttgcaaggaccttccttataatgctggatatttggggtgattggccacagtattctcaacgtgtggccttgttttatgggaactgctttaactaggacctgcaagtcatcaatttccataattaaacatgtccaagtaaccttacatttcagaaaaaatcaccgagtggtgcacttgacttttgaacctatctttagcaaatggaaaatatcaacctggagatgttcacttgaacatggatgaccataaaaggaaaaccgtttccttccagtattcctgacatcagagaacttattttcaacaagggtttgaaggttgtcaagactctctgcatacacaagttacacaacagatataaggaaaaaatatataaaaattgaagaatttgtacagaaatgaaaagaatggtgtaaccagtttgataaagaaaaaacctttcccatacacaacaagttgcatcaagttggctgaatagtgtgaactataaaatgtaataagctcttccaatatgtccaatccttccttatttggattaaccagtaaagtgttccgatttcctaaaacaatagatgatcagaatattagtgaaaaaaataattgttcaacctttgaagcatgtaaacatagggcctgctcgtaactgcttgccggctgccgctgcggcttctatacagaaacagtagccagcatagctctttgttgcggctgtgcagccgcatccagcagttccaatcaggcctatcgtcccgtatttcattcaagttaaaacttccatagattttgatttcagagaaaacatctaaaatggttttaaggtgtaaatattccctgtccaggagcaataagtttgttatgcttcaactgttcaacatagtctccaatttacacctttgaccaatggcttttcatactagtacataacataaaattcttagtacaaacttacaagttcttgtaaaaaaaatattattattgaagtattttcaagttacaatgggaaatctgcagaaatcattttcatatggtcaataagtaaagtaaaatcatagggcaggcataaattattttcaaagtataagaaataccaaagtacttggtgttcaaattgttgttgggatggccattgttattaagattgaggacaaaaaggtacaagaaacaatatcattgacacaaggttgtcgaggttggttatgcaccggagcgcactcccaagaacgcgcttcccctcaaaaataactttttgtgaacgcactactcagtgcattcccctgatcttaagagctagctaccacaattttcaccaaatccaataaacaccacgcctcaccaccaaatcaaagaagggatatgtaaggtgttgtgacaggctaggtagatgccaagttgtattagcctggttgcatgggccaattcaaatgtgaagggggaaaatgaaacatttgtcccacaagagcacaattccatgtgtttctgtgtccttcatatgctactgtttcatttgtgaaagcatttttttaatcaaatgatcctcatggcccacatgcaatacaacagatcttcaagaaaaggtgtgcgcaagccttgggtgatagaatagaccacaaaagaagtgaatccatcatgtagattgagaataccataacagaaatgggcttgtccagtttacacacacagtcttatttttttcttggaagaacagtatgtttttttttccatccatgattcaactagctaaaaatttagaatcataagttcatatggcatggatattttttgcagcattacaaagcgtattcttgaaataacttcaacatgcagtatttgttagtagtgagttgtgactataaaatgaaggtagaaacttggacaccttggtaccaagcatgccgtatagttgcaacatccaattgtggtatatagaatcagacactaaaaaaaatgaaattatgactataacacacaccagtgctaaacttgtgatatggatggctctccaagcaaatatgtttctggagctgaaccaaaagaatatagacaatggaattatagcatgaaagaacatggtaaaataaatgaaaacaataaaatagatcaaaatatgatatgaatatgataccatattactattcagctataacagaaaagattaatgatgttttttggacataaaggtacctgactcattcgcaaaatatctgtcagtaagtttttctggttttctgcagacaaagaaagaaaagaaagagattagaagttaattctctcagcaaaaatggcagttccagataagagagaaagcaatgtataccagagtcaacagcattaacttccctaagaattgcatcaggtgacatcagtggatttatgaaaaattgtgcaaacctaaaacgacaaatgtgaaggaaatgaaacagagttgcaaagtaaaaaacaaaggtgtaaggaaagaaagaagtagaagttacctatccaaagcatcatccaggcaatcattgttcacatcaaaaaaaaagtttgtgtgttcacgagatgtgaaggcgttccttgaaccaccatgctaaaagaaaacccatatcacacaattgatgattcaaacatagaggaaaaacataaagaccatgatattatttatacaaatttatgaataattatggctcctaccaactgcatcagaggctagacagatggttttctaattagcacagttaataattaaagggatcaatctctgcttgcagaattccagtagcagcataacatgtgggagggaaatcatggttcaaggcttcaagcactgcaagggacaaagcttcattgcggccaacgttggcccacccaatgattgtacagtctatatgataagtaattgtatttaaggcattttacttattaagcttcaaattggtcccatctggattaagccactcgtgcacattagtgttcgaccactcactctgccaccgaaagcactggtgcgccgcaacagacttgcaacatcaaatatatgagttcactaacaagtacacgtgtctattatattgcgaccaactggtaatctagggaaaaaagggcagcaacccatgatcaaacataaactagattagctttacaaatactgaaacactctaacggcactagccaagtacctccaaaatgtggtgcaagtctctagacattgccaaagtaaattgggcgtggactagacattttgcaaagcctacagtatgctgaagttcagttgacactctcctgaacaaattgttctcaagcattttcactaagttttgagatcaatttaagttcgatcaaacaaattattgaccacagtaatatcaagatcagttagaaagatactttttaaattaacagaataggtaagtagatctgcctggcaaaatacatacctctgcaatatactttgagtaactgtcttctataggatatttctcgctagcatagaaaagcatatgctctgtaaaagaggatccaggcataagggaatcaaacaatacagagctacacacatgttattactgcaatacatgtgccatgaagcttttcacatgcaatactacaacccaaccaagatttaaaaaaaaaacaatgaggtttgaagagtggttctttatgaattaatactctttaaagggacacactagaaattataaagagagcaatatacaacagccaaattaaacatagactaagcacagtgatagcatgacacgcaagaaagttgtgcttactttacctgaccgagaaaaaaatagttacaatgactagtaagtaaattaattttctgattggataacagtggaacattatatttctattgttcaccttaagtatccaaataagatgcttgaaacaatacttggcctgcccgagaaaaaaagttagaatgactggtaagtaaattaattttctaatcggatggcattgccacactatatttttataatcacctcaagtatacaaataagatgtccaaagcactctggtgctgaaatgaactttctaataatatacgtcatccatttcagtacagaggcaatataatgaacccacattagcatttataatgtattacagtattagtataacagttttcagtcacaaatggcattgctggtacctttgatcctttaatggcatgtgaatttcacataagtcattttaaggcccaactgttttttttctcttaatgccctttcacatatggactttgacatctttgcagatttatcaagtaaatggttagttccaaacgttattatgcaactcataaacttttcaaggaatgggccgcttattagctagatattgtgacagcacctatcaggagatagtagtgttgaattgatgttgtacatgtgattcagccattcgtgtgttttcctggccatgctatatttgttttaatcttctcatccagagatactcagtatgatttggaaaatttattttgagatgtgttgcatgtatttttacagctattgatgttacccaaaaatgaaaaagaagcatgctgctgtctgtggacttagaagtattttttacttgcacattttttacttgatgggctctgagaaaaatatagatatccaaatttcgaccttcttcctctttacatgaccaattcagcaattaaacaactaaaagcgcatacacgtattagaacagtgccagccacagtgcacagcctaaaacaaccttcttgtaaaaaccgcagaatgtagtggtagcctaagcaggcctgacgcaacataagtgcatagagatgatagagagatcaagggtattaagcaccaaggcctgactgcactaagattatcgtcaccaacatcctgtatattcataaccatttaagggaagcagctaactacaactaaaatcacacatccacgattaccaatttctcacgttttatgcaacaagtcaaaacaggaagctcaccaaggaagtgtgcaagcccagggagcccctcggggtcgcagaagtagcctaccgagacgttcatcgacgccgccgcctgcaagcaaacaaacaagtcggggttcaagccaaaaaaccagagagataccaaaccccggcggcccatcccgatcgaaggagcgagcgaagcaggaagaccttatcggtgtcggggtcgctgatgacgaggcactcgagggcgttggggagcacgacgcggcggtacccgcgcttgtcgttgcggggcttcgtgatctccacctcgccgttcgccgcagccggggccgcgccgccggaaggctcggcgggggcaggggcttcccggggcctcgagtccatcgcggccgccgactcgccgccgcgggcgtggactggactgaccgagaccgagtccgcgcgggcaccaggcgggcgaagagccgaagacgaggagttggcttggcacgagcacgacggtgtcttcgcggcggagaggggtggggaaatgggcttgggccggatgagccacagcgacatcggggcaacattttgttcaaagcccaagtcaagtgtactcaagtcaacagctacgtaccgctccctccattttattttcatatatagcaagactttctagtatattcatctagatatataaatatggataatattagaaagttttacattgtgaaacagagaaattactactatggttctagtgcgaagacaccgtcttaactaggtgtgtttagttcacgttaaaattggaacgatctgatgaaaaagttggaaatttatgtgtgtaggaaagttttgatgtgatggaaaaattgaaagtttgaaaaaaaaaatttacaactaaacatggtgtgaaattttgacattcttcaacgaaaaaaaatgaaccctcacgctaaagtgtacttcagcattatgtactctggccctaacagctctaacgtactggcacagaatccaggtcggcatgattcagtgtgagcaatctaatgtgcttcattgcctgcaatatgacaagtagcctagtggttagatgaccttcatgccataccagcgtcgctggttcaactgttggagcatccacgtctctaagagggaaagctacttaaaaagtactaactctgcaattctgtggtatcgtgtagacccatataaattcaggctgtgtttagacccaaagtttggatccaaacttcagtcatttttcatcacatcaacctgtcatacacacacaacttttcagtcacatcatctccaatttcaaccaaaatccaaattttacgctgaactaaacagtaaacacagcctcagctggcattcttatggctggttttcaaggataggttaaatactgaagccaatatggtcagcaaaaagtggaatgatgacccccactgccctgtttgccttgctcttgagacagctgatcacatcatcctaagatgcaaaaataccgacaatctctggagaaaactaggactcttgcatctggcaaacaaagcagaaacaatctctgatttcatccaagcagccattgacaggaaacaacacaaagggtgataccaatctgatttgcagtctgcgcttactctctgtggaaatcacgcaacaacatgatttttgacagacagatggacaatctccagggtatcatgcaacagatctgtgattccctaaatctctggtgtgtacgaagtaatgaagacactagacacaaaattcgatcatggtgtgaaagactgtcctaaacaacagcctaatgtttatgcttctgtaaattctttcttttcccccgtttttttctttcttccttaacctctataactctttttccacttcactcttttttattccttcttctccctacctctctcttaactaataatcttgtaaccctaaacctcatttctataaatgaaatgactataaggtagagcgctctaccttcttgcgttaaaaaaaagtactaactccatcccaaaatacttgtcgctttgagtttttgtttgtaatgtttgatcattcgtcttattcaaaaaaattatgaaactattatttattttgtttgtaactcgctttattaaaaaatattttaagtatgacttatcattttttgtatttgcactaatttttcaaataagacaaatggtcaaacattgtaagtaaaaagtcaaagcgaccactaatttagaacgaatgtagtaaagaataatgaatatattaagtctttattgcttcccgagtcaaacatggcaccctcaagcagagaagggtggacaccacactaccacaccacaataactctattgtttacttaaacatggcactgaggtggtgtttttttgtgttgtagatgaagataaagtgttttacgtaaaacgaggttgtattagcgtgtgattaattgagttttaattattacaaacttgaaaaatagatttatctgatattttacagcaactttcatatagaaagttttcgtacgaaacataccgtttagcagtttaaaaagcgtgccatgaatatctaaattttcatccaacttttgttagagaaaagaacaaggcctgagcccctagtgatatgaactgcgtgaccatatagcaatgttcccagcgccaagtatacaacgctaagttgtacttcagtaccaaagatgacaacaataaggttggcatctttttaatttttttttgcgagattcattcttcaaataagttttaaagacggccaaatgtaaaatttcaaccatctataggtagggtacgtgtgtatttacataaacaagactcaattgtcctaattaatactctttccgtttcatattacaagttgtttgacttttttcctaatcaaacttttttaagtttgatcaagtttatagaaaaaatgtagtagtattttcaacacaaaacaaacatactatcaaaatatattcaatgttaaatttaatgaaactaatttggtgttacaaaatgttctaattttttctataaatttggtagtttgactagaaaaaatgttaagcggtttataatatgaaaggaggattaggctaatttaatgatatccctatttcatcatgtcttgtactaagcgcacgaggtaggatttgcgtgtgatctaagtcttccttctcttcttattagctcacttgatatatcaagttttttctactccctccgtttcataatgtaatactttatagcattgctcatatacatatagactatgtgtttaaattcattaacatctatatgtatatgagcaatgctaaaatgtcttacattgtgaaacggaggaagtacatgacatagcgttaaaattatgggttgtatttttggtttaaatgtactatctatcttaaaatatatcaatttttatacacaaatcctaacaatggttcttatttttgctagaccggctaaagaccaagctagccaaatttcattaagattaggattatttacaaagagataggtccttatcatggtgcaggtgaaaaaaatggttcttatttttgctagaccggctaaagaccaagctagccaaatttcatgattttacaaagagataggtccttatcacggtgtaggtggaggtggggaaaaaaacaagattaggataaagagacatccctccaaactttttttttaagaaaacattgtgaacatatatattggaaattgatcacgagacaccagagttgaaaccgtacactttttaccattatcctatcaaatgcatctctatggtgcaggtgaatctcgctgctgttaggcgtgtctagagcgtcggagttttacgtaacttttgtagtaagatgtttcttcagacgtattagtcttctagttttgagcaaaaaatctcgcattctagttgttgaggtgtgatacacatatagctgcaaaatctctgcaatccttgccggaggagtaaatggtaaagggggaggtgtcctgatgatggggggactctgaaatgcagacacttccgcaaggaactcccaaacagcaaacaatctaacatgtttgtagcaaacgagacaaaataacaccggttcgttgttaactccatgacaacactgtcttttatcatgtggaccaaataaactccaggagcacatcgcacgacgcccgtgatatctgacggccttttctgaaactaaaatgcccggttctcgaagagatcaggctaggagctctggagctgaagtggcgaagacgtgaatcaagtaaactgttctctcttgagataacttctgcatcatggattctgtcagagaaggtaaggacaaatggacaatcactcttgtcactgcccaagtttaacaggttgctccttctgaatgaaacttcgagctaatccatctgaatttgttagtagtaaatactgtagtacaatttactggtgcaagaagtaagagctccatgacacccagctactctgaagaaaatgttcaggtgttcggcaaagttgcattcagatgttaggctactcggctactgtaagtacacatgttagtacattgtatgagtccttgttatatcgagcaactgaggtggtgtttggatccagggacttaactttagtccctgtctttagacactaatttagagtattaaatatagactacttacaaaactaattacataaataaaagctaattcacgagacaatttttttaagcctaattaatccataattagagaatgtttactgtagcgtcacataggctaatcatggattagttaggctcaatagattcgtctcgcgaattagttcaagattatggatgggttttattaatagtctacgtttaatatttataattaatattcaaacatccgatgtgatagggacttaaaagttctagtcccatctaaacagggcctgagcataggggacaaacaaagggcctgttcactttgatgccatttccaaccttaccaaattggggatcctctagagtcgacct

SEQ ID NO: 70874 - DNA, 563 bp, Oryza sativa
atgtaacagatcatgacttgggtattttttttccttgtatgatacggaacggcctaaagtcctggtttgataatattgtaaagaagatttaggaaaccgataccgttttggttaaggtgtctatcttgtaatcctgccccccaccctatataaggtgggcaggaggccctctagggggcatgagacaacctgatcgtcaaacaggagtagggtattacctctcattgagagggcctgaacctgtctaaatcctttgtctccgcatccatccacttttaggtctcgtgcgtcacccccttttattattgccgaattcatgtttcgacaattatgtcatgcacaattatgtcatgcatgttggctataacttttatatttcaatttgagttgattgggtaaaatatagttgctacttttacctactaacacgattttgttatttctaggattttgataattccgtgcagtacagagctgaagtgttctatatttgtttgcgtgcacgtttaactactcgcaataaataaataatatatattattagatataatacatgcaaaaga

SEQ ID NO: 70875 - DNA, 1189 bp, Oryza sativa
ccgatcgccggaagcgatacagcctccgccgggagcaaagccaacatactgccattctcgtgcgcagcactatcgccgccgtcgggcccagcagcagccgtccgcttccaggaacttgcttccgtcagtctctctagcgatataagttcttgagtattaaaagcctgagcccgtgataatatataactactgcatgtttgcatcagacttgtttgatgattcaggcttcatccgcttcaataacaatggatacaagcaataattaagttaattaacaagtctaattctctacaaacacttgtgaatcggtacatatgttttttttataaaattcttcttcacttttttaaaattgctgttgtcgcatgccgccgcggggcttccctgccctgctgctgctgcatgccgcactgctgcttcggccacctgccggctgcccttgccgctgcgagctgccgcagctgcgcgccggcagcggctgctttgactggacgcctatcgaccggatctaactgagaaaatgcgaatttacaaaattaccccctatataaatagatgaaaagacaaatataccctattcaattttatactgcaggataattaggaagaagatcagattaatttacaccgttagatcaaatataatggcagtatatacttgcagtacaatgtaccataaaaatcctaaaaagaggaaaagagctaagtagtattctttctttcaagtttcaagagcatatatgctcttagtgggttttatttaattcataacaaatgattaaaaaactaatatgtttattaagtatcaagtgcgcgatatggcaacaactattggcataagtgtttgcgtccctcaacctataagctgagatcgattagtatccctcaattataaaactaggtataacacactaattatcaaaatcagtgcaaattaactctctctcggtggttcttttgagcggtctcatttaacttattattttgactttgtctacacacatactatgtgacgtttatgtagcaatcatatattctaataaaaaatcagaaaaaccatactccttttttctttgctcctaggggttgtattttctcctactctattaagtgaaaaggcatctagtgctgttttccgttaaaaaaaaaaagaaaaacagtagggctctcatattagtcatgtggaaaa

SEQ ID NO: 70876 - DNA, 2606 bp, Oryza sativa
ctagatgtgtatatatatcacttcattttcttaagcaaataatgaagtttagaagacttagctagctgttagtctttgttatttttgctcatcacgatggtgtcagctccttcccatgtggtacgtaggtgtatatcatttctttttcattagcaaataataaagtctatattgattctcttaaaagattcatattgacgtaattgttagattcatattgatgttcctgtagcccatccgaaaatattttctcgccatcatccaccattctgccaggcttgagtcgttgatcgtcggcggcaagaagccaatgccaatccatccttgcatcagcgcccatactcgtctagtgaagtcgcattttacaaatagatgcaagcagctttcttcctcccgttggcagagggagcagagatcttcgtgcggccagcctctcttttcaaaaaatggtttcatgacaacaaactttggtttctcccgctaaagcctagtaaaaaatggtttcatgacaatacaccattgaatgatttcaatccgtttaaaaactgattgaatggtttcgacggcctcacgctacacaagctgctcgtctggggagccttcctgtttaactacccggtgatctcctacaccatcggcctgatgcagtcctcgtccatccagaacgaactgttcgtcgtctgggcctgcttcctcctcctcctcctcggcagcgccgacaccatgacggcgttcagcttcaatgacagcagccagcagacgaggtccatgatgaaccagaccctccacgtcgtgtacctcctcttcctcatcctctactacaaaggccagctccgcggcaccttcctcgtcagcctcttcctcctctggtgcttgagcgtggtgcggctgggcttgagggtcaaggcgtacctatgaacgaaccgctcccatgggctcatcagggagaaccaggtggtgtacgagtacatgaagtacgagccgctcaacagcgctggcattcaaggtggctcctcggagtacatctatctcgtcgacggtgaggaggtggagaaggtggacaatggggaggtcataaaagtgtcgtacaaggttccagagacggtggacgtcgaaaagtgtccacaagtgaggttaaggttcgcagccgatcatgtcggtcatatcaacttccctttacagtacgacaagtgccgagactttgtcgtcaaggggctcctcgccaatgacgaagacctcggcagggcattccgggtgatcgaggctgagcttgggttcctctttgacttcttttacgctcggtacccctcaatcaaggacaccctggctcctgaccttgctgtgtacatcgtgatcctggcgactagcttgttcaccctcttctctccagaccttctccgatacaggtcccattggcagcaacgctgccaacaacatccttatccatggctttaatctcgacctccttgtcacccgcttggtcattgtctggtacatcttcctcgagtcgtaccaattccttgcctttatcttctccgactggcacaaggtgaagatgttgtgccgatatgtacgcaatgagtcatggcaatggaggtcccgctaaaggtgttgtgccatttcactgtcaccaggtactggaaggggaccatcggccaatacttcatcctcgacaacatccaacctcactgggtcaagaccttcctctcatggttctctctcgaggcccaggcccttgattcatcattgatgactcgctccgtccgcttgatgccggtggtgctccgtgagctcaacaactgcgatggcaagatcaccgacgggaggatgtggatgtaccggacaggcattatcgacttgaacctcgatcgtgatgtcttgcacggtacatactgacatggcacatcgccacaagcatatgtgactatgggcttagcatggacaccactgctggtggcattccagccggagctggtcccggacagcacgtacacgagcacttcgatggcccgtggcacactgcagaatgcctgcgacttcctcgccaaatgcgagtccgccagtgacaagtatgataagctgatggatctggggcgcttggaccacacggagcacaatgttcggttcctatctgagggcgcaaggatcgccgtgtacctcgttgagcggatcgaggatgccgggaagcggtggaaggtgcttgccgccttctgggcaaacatgatgttgtacatcgccccgtcggatagggcggtcgcacacgccacgaggatggccactggcggggagtttgtaacgatcatttgggctctgctgtcacatgcccatgtagtagacaagcttcaacatcgtggcggtgccccgggattgcctattctacttgaagaagaggaagataaaagggcacaagcagggccggccctgatctgatggaacttgttagatccttgattctccgttggcaacttggcttgcatggaggaatgctaatcatatagtataatgacaattgtgggcagatcagatgcatatgcttggctcattggaggattctgatgcatatacctggctcactggatgatttgagaaggttctttcacaaatca

SEQ ID NO: 70877 - DNA, 30888 bp, Oryza sativa
gcttgcatgcatcaactttccaaatgaatatttgtcacgtcccgataaatttatcccgaaataaaattcattctctaaaacgaaaaatagaattaattaaaattcgaatgtggcccggagaatttttgttaaattctccttggtctaaaatgagcccttaaattttacttgaattttcagagcaccagaaataattattaagcaacaaaaacaattatcagagtttattaaaaagaaaaactaaaaataaaccctctcctccctttgggccaagcgtccctctctctccctcggcccgcggccgaagtccttctcaactccctctattttttcttctctctctctctcttgggccgccctccttccccttggcccagctcccttcccctccccctccctcccggaccactccctcctcctccctctctcccccgggctgcctctccctcctctcctcctgggccagccgcccggcccaatccgcgccccccctgctcgagccgcgcccctcacgcgcgttgcacgcgagctgacgtcgcgcccgcgtggggcccacgcggcggtcgtcgtcttcttcctccagccgcccggcctttcctttttttcccgaaaacttagctcctttcctccctcaaatccgtgcgattaaatcatgggattccaaaattgattatagcgaattaatcccctttccctcctctctctttcccccacaattcccccttgattcatgcttttaatcacccggaacgcccgcgccaatcccggccgctttccatggccaccggccgacttttctgccgccgttctcacctctcccgtgcccggctccctccctcggcgtcgcagcagccgcccctaccgcctcgcccgcgcgccggtcggccgcgccgtctcctccctcggcgtcgcagcagcctcccctccaccggcgtcgccttcgtttcgcgcggaaacccccggaggtgcgtccctgccggcaacagtggtgttgccgccactgctccgcctccagccgcctttgccgcctcgcctttgcaccggccgacgtcgccaccacctccctcggctccgcttcgccgtcctcatctccggcatcacctcctcctcgcctgaagctcgccggagtggcctcctcgtcggtgtccagtacctccccgtctccggccggctcctgttcgtcgccagtacgccgatcgacgtcgctgtctcctctatcgacgtcgcaacgtcgtcctctcctccggctgctcctctgtttcgccggaacgccgtcgcccgtgccggcctctccatcctcctcgtcgccgacgtcccttcggtcggccgctcctcctcgccggctcatcaccccgctgcaccaccatcgtcggcatcgcagcggcgtgttccacgccgtcctcgtctccgtgcagctactgtcggctgccctcgtcgcctcatcgccggtcccggtcgtcgtcctcatcgtcgtggcattcgtccctccgtcaagccgatcgcgttcgtcgcccgcgtttcgtctagtgtgctgctgcagccccgtcatcgtcttcgtccttggctccgcgtcgtcaagccttgtgtcggccgtgtctcgccttcgtccaaggatcgccgccgaagtcgttccctcgccgttcgcctccgtcgtccctgagtcgtctccgccgcgcccgttcttcgtcgtcgtacccacgcctcgtcgtgtggtggtaaggatctctccttcactgcttccgtcctcgtcctttcggtgtcgccccgtgcccgttgtgcggctgtctaccccggtacccgtgtaccggtgtcggtagtcgttcgtgtgtgcgtgtggtgaccgtgtttgtgtgcccgctcggtagccgcgtggtttccacgtgtgcagcccgcatggtgtctagtggagtccgtttgtcggccacccgtctcggttgacacacggggtccgcttccgtcgacccgtggaccgtctctgtgtacccggtctgccgtggtcccttaggttgacatgtgcggtccgcatgtcaacagcgcagccttcctgtcttttccaggctagcgcttacacatgttttatagttgcaaagcctaattacaataatccgtaaatctccatataacaacattaaacttcggatgaccatgtcttggtcatacgagctccgaatcgacctgttcaagtctcctaatgtttgttataacctaaagaaccctatgctttctttttatgtattgttattgtttctttataggcttgtagctttgcttgtgtgcttcgcatagcttctgtcgttccggaggttcccgaagcgtggttcgtggtcgtcgccaaaggttcggaaggctgttctctctgagcaaggcaagtcacatcatccttgagcatattgaatcccagtttataaaattattttgttttaaattaatgcattaccgttttatttaaattcccgcgttatcactgttttatttagccatgcctatttaccttggttatgattttattattattgctattgttattattaccttgttcaccctaggataaacaaaaccccaactagtgtgtactctattcatggttccactagtatgaatttaggtagatgcttcgctgattaattaggcaacattaggtggttttataactttagactttgggaattctcatatcatttggacagtatggaatggttggcttatgttggaattggacacacctccccctcttttcaaaacccccaaaacggttttaggctgggctcgaggtgcgtggttgggttttgttagtcgtacctcgggtactataaggattaagctcaggcctctgttgcaaagcactaccgtacttccacatgtctagttggtaaggcatagtttgtggctcagtctggtcataaacaaaagtacacggatggagatggacgaagtcggggctcgatggacatctctaggacaaatgaaggctacacgagctgcggctcggtagtcgagacgtcatggcacagggccggtgttctgctgctaggggctcaatcctgcctacctgtctcgggggttccggccgtaggcggggttgggtcggtactcttgtttatggctaggatgggttgggaactatgtcacgtctttcgtccgtatgccgtggtggtatgtggcacgtggttacgcgtgaggaagatgtgtcttgtgggtaaagatgtacacctataatcagagtataatctattcgaatagccacgccctcggttatgggcaagcctagcaatgtacccaagttagtgttttaattcttaaaacctgcttaacaactaaaatatggaatggttggcctgggttggcttgggatgagctgggacctgggtctggttgccagttcggtctgaatcatcgtaggccttgggttaaggcaggttcgtatgggttcacggccttgaataataacattgtgtagctctagaatcgtatttataaaatagctttgggcaactaagtgacttttaaatgctgtttactgtaaaacttaacccctattattatccccttgtacccccttgcattaatcatgcatctgccggtgtggcttgctgagtactgtggttgtactcattcttgctctatcttccccccctttagtaagagaagctttggagaagaagtcttaggtgaagtcctggcttataccccagttgagcacctgtgaagatggagacgtaggcccgctagtccgctgctgtttatttttgtttgtcaggcctgaagtgcctttttaataatgtaaatattatcgatataataaagatgtgtcttttatatcatgtttgtgtggtgtaccccggcttttcctgggacggggattaatacactagcgttctggaaaaggtatttttccgggcgcgacaatatgattgtgattgcatgaatgtaatttatttccaaattatatgtacataatcaaacccactaatttcgatgtaattgctttatttccgtccatactaattaatactttctatgtcttgtgtgtatatatatacgtgcagcgatggcattctattttttacacactccagtttcatatctctatgccgttacaccgctggacgtcgaccgtatactcgagtcgctaccggcctatcgtataccgagccgttaccgcaaactgagttaagtctactggtcgtgccacagctgtacactagccataaatcgttcgttcgcacgaagtatagtccaaagcctagttcgttcggtcgtcccgagttgctcattattaatagagtcattttaagccaccgattttgttcgccggttcggttgaccgtttgagtggtctcgtatcacggtgggttgactcgttgagttgatatcccgcgaggcttgcttaccaaagttatatttccattgatctattttgtttaatatgtaataattgactatggttttccggttaatagtaattacacatctcatattctaaaatctatatccaaacaatctgagctccgttttaacccattcaagtttgtagtgaatttgttgaaatgtctagaatccattaaaattggtttcttttgctgtttcaatagccttattgcttgtatttcttgtgtgctttgtttgtcgtttagattccggcagttccgacgctccagtttattttgaagtggttgtcgaggttccgtcagctcaagagcaaggcaagtcatacatacagcactgatcatgttgaacctattttataaaatcccctgctttctattaaatagcagtatttttgaacgtcatgtgggatggatgtctatcgtactcagcctgttgatatctcatgccattgataacttgggatataattgattagatgattggtttaggaatgcttaaccatgcttagatcaattagttcacaatgggattcataataatttagtccttaattatatgatgatgtaccaccatggttattgtttaattaaactaaatatgcttagaaggtgggttgtgggtgcatggttttgctagtcttgcccatgacaattaaggaccggttctcgagaatccctgaaagatataatcatacttaccacaggctagcatgggctccaggctaaatctagagtataacttaacttagctaacatactacggcagtgatagatgcgatggtgccgttcggacctggctttggtctctgttgtttccggatttacctaggcacgagaggggactgcccgacttggctaaaaaggagtagggctggacgaaaagctcgtggctcttgtctggcttggctcggctcggctcgtttgaatttgctaccgagccaacctaaggttttagctcgttagctataatgagccagctcgagctagctcgcgagctgctcacaagctaaacaagtctagcccaagtagccatctatgactcatttagtgaaggagcctgttgacggccgttatcgaccagtttcgaccatcaatattacccaatgtgtgaagactagctattcttgcaatgcataaattccaaataaaatatctacttccactatatactatgctactaacatgtatgcaggagaagcacatataaatggaggagaatcgacagaaaatagaagaatgatcaatcagacgctgtcgagaagtagccttgtggatagatgggctgataatacagaattaacatgagtaaacaagcccataattcacatcactaggctgaggaataaacgaggagtacacttgccaagttctgggccagatggaccagactagggttcggccgaacccctaggttctgccgaaccatggcccagaaattccacaggccgatagttatcgacatccaatggcggttatgaccgtttctacctgaagcaaccgccgtggacacttttcacaaggagggagaaagatgctctttggatgcttcaccatgccacatgtcaagaggagagcaaaaatgctcctaggatgcttggagcatctccacactcccaaggcacctctccacctataaatacccctcctctcattcattccctcacacacctcaagaagaagatcaagagctctctcaagtattgtttagtagttctacagatagtggagtaggaaatagaattgtcttcatagtcctcgagttttcaggagatttcgggtatggctttaatagctttcctctcttcttttgtgagacttattaaattaatagaatattcttctttatacaagttcggtattttattccattcatattacttgagtgctgactttactttatactcgtgtaacaagctttccagataggtgtattgatgtgggtttagtgtccgattattcggttgctctatgtcggttgcaaggatgtagagtagtattttactaatgtaagcgcggtgcttagattattaggtaccactaattggggttatatactgcggatgagaggtgggccgctgatggttacagctaagtacgggtattcctccgcgccagtatataatcctaagttaattacttggggagggtactcctccgtatttagccctggttgtatggtcatgacgggctagggtggcttctcgaaacaccaagaggacactgggtacggggtattggttgcatgactgtataatagcaagtatagactaaagatgtatgtatactagaagtacaggaatgatacttttcttattctttcaccacttagcttagactatattttagagtgagtatttcttagttctttcttctgtgtgtcaccctaccctttgaactgagttaacccctgcatagactttgatgtatataagtaacatataaactattaccatagtactctcttatcatatcttcccttgggataaaataaatacgataccttggaatactcccgggtgaaatgctacaatggtatatccgtgcgcttgcggatcacatctgtaaccataatataccatgagtatttctagtgctattgctggaaattatatttccagtagtgccactaagaaataccaaacaagcatttctggcgccgttgccggggaagataaatgattaagagttcactacttgctaataattttatatttacctctatataagtcactgtcctttgtaggcaaaccttgtttgttttctcttttatgtgaaaacagggtagtacaggactggttatgatctgccaaccaaattcatatctagagtcactggtgaagtgaagccgacctcgtgtcgttcatcctcaaggttactctatcggcaaccagaccagtcaatttcgcgccacaagaattgcatgatacggctgagaagaccctttgcaagtttgctgctccctctgttgggtaacatgctagatggaacccacgtcagtatgggagatggtgctttgatctgaaaatctgcttagtcaagatggcgcaggcttgcacattctgtggcaagcctaaggaggatgcaagtgcttatttacagcaattcctggaaagctgtagcacgtataccgtcaaaggaatcagactccaactgttgccgctctccctcctcgagagagcagaacagtggttctacatcaaccgtgtaacagtgaatacccggaataagcgctcaacggcattcctctcaaaaattttcccgatgggcaagaccaacactcctcgtggaagaatatctagctttcagcagatgagggatgaaaccattcttgaagctggggaaatgctgcaggagtacgtcaccacccgtcctcatcatgggcgtccatcctgcagaatttcttcaacggattaaccctctcgtcctgggatcacctggacgctgctgctgaaggagcacccttctcaaagacggtcagtgatgccaaccaacctgattgagaagatggtctcaaatattggttggagcaaggaacgactccaaacccgtcaacgcggcatgtacaccgtcgaagggatggaaatgctcgccgcccagttggatctccttatgaagagactggacaacaatgagaaggacgccaagcagagtgccgttaaggctttgggctctcacataacatgtgaggtctatggcaaaaccggtcactctgggacggatcgtccggaaacccgtaagaacgtcatgctcatgaacaacaacaatgggtatcgtccacaaggagaccaaggatggagcattgctccatagggtagatcaagaacggaccgaacccacaaggaggtcaaagtaaaaccccgaaggacgaaaagcctcaacactttcatgatgaacttcctggagcgggaagaaacgaggaaccatcagtaccttaagctggcttccaagaagccgggaatacaggtcaggtcaacctgcgctcccagtttcaaagatgccgctgcctgcacctaagaccaagaaggtatggcggattaaggagaagacacccgttcctataccttctgaactaggtgcctcatcgagcaaaatgcgttggaggtacggtcgtgctcgtcggacctgaaacgacgtcgctcttgccaacagataaattggtagttatctcatatttattttccattgcatcaaagcatgtttgaattttcaaacgcacattgagatttgaatttgaggcgatttcttcaaatgaatttttgtgagaaaaataaaatgcaatttttggcaaaatttagcacagccaccttcacactagtcgttggaccccaatggctgctgatttttgcagggtagcggctagcggggcccacatgccattactagccgttatccatgcactatatatgcagctcggctgggagagggaagtcacaccactttaactcattttcactccctctcaaaaccttgcaagcttgcctcaaattcacacaatttgctgtacttagtttaaacactttgcatatacaagtttgctttagttcgatgcaaggttaatcggcgggtatttgcctaacccccgtccgagtagtcttgtattcttgctctttgttgtagctatgaagaaacgacttttgggcatattcaagagacaatcaagctcacggacaagaagacatgataagccgagtacaccttcttccgcggatgcatccatcgaggaggcgtacgttccaccaaggctgtacgacaactccgatctcgacctcgtgggcgaccgggaaatgcaagcctatcatatgctgaaagaccgaacgtgtgctcagacctgagcatacgactcgaccttctgaaaaggataggtgtggatgctgagtttcatattgttcagcgtgctataggttgggataaatttgcatgtgtagatgtgccgggttcccgtttgcttaacatgcagtttttatgtaccttgctagaggtaggtgatgggttaccttccggctattctgcaaggaatatcaactttcttggaagaccttagcttgcatctaggctttgacaaaacatgcaaggttaatttcaggaacacatttcctgattttaacaagcgtatgttttagcaaagtatttcgggtctcatcctgtaaaaagcctagaactagtgacatccataatcctaccctggggctattgcataggttgcttggttttgtgttgtttcctagagctgatatccggataggacgaacttatcctcttgtatgccatggttagaaaaaaaatcagagtttcacctgttcaacccatgatcaagcaatggttagaaaatgtgaagttgtctagtcctgttgagtgtatttatttggtgactcatttagcatgaggagttgggactatgctttatatgcaagtatcttgtatccctgctacccgctcttatgttggtgaggcctacttggttcaatgccacatactcaaacatggtccaaatgattctcttatatttttgtttcctggctatacaaatgagattccgtaacctatacgggagtttcatttgtataactaccaagaactaaccatttctctccaagcggagttgccttgtgatgtcctatgcaggtaacatgacggatggcgagagaagcacctcaggaggcgtcttcctcttcaccaccagagcagatgtatttagacagttgggacccgaccgtgcatgcccttgattggacccaattcatgcaacatgacaccggaggttcgtcctggcagagtgccagcgacagccggtggcatgagccataggagttgcactggggatactcacgctccttcagtccaagtggtcaacttccatcttcttggatgcattgctcagtctcctctcgaggggggtctaggagaactcatccgggggacggatacacttgaactgcaggcagtgaacgagcaacacaccttggaggatcatgtggtacagtcacgtgaatggtagcactctgttggtgcacagctcgcaaacttcaacactatgatgcaacaacaacaagttggcaaaattttgcacggccaccaccacactagtcgttggaacccaatggctaaatgtggggccggttgggtccaccaggggttcggccgaacccctgcatggcactggctagctgcaaatatctgtagggtagcggctagtggggcccatatgccattactagccgttatccatgcactatatatgaagctcggatgggagagggaagtcacaccactcattctcactccctctcaaaaccttcctctcaaaattcattcaaagttttgcaagcttgcctcaaattcacacaatttgctgcatttagtttagacactttgcatatacaagtttgctttagttcagtgcaaggttaatcggcgggtatttgcttaacccctgtccgagcagtcttgtattcttgctctttgctgtagctatgaagaaagacttccgggcatattcaagagacaatcaagctcacggacaagccaacacgataagccgagtacaccttcttcagcggatgcatccatggaggaggcgtacgttccaccgaggctgtacaacaactccgatctcgacctcgtgggtgaccgggaaatgcaagcctatcatatgctgaaagaccgaacgtgtgctcagacctaagcatacaactcgaccttctgaaaaggataggtatggatgctgagtttcatactgtttggcgtgctgtaggatgggataaatttgcatggtagatgagctgggttcctgtttgcttaccatgcagtttttatgtaccttgctagaggtaggcgatggtgtacttcccggttattccgcaaggaatatcacctttctcgaaaagaccttagcttgcatctaggctttgacaaaacatgcaaagttaattccgcaggccggtagttatcgacatccaatggaggttatgaccgtttctacctgaagcaaccaccgtggacacttgtcacaaggagggagaaagatgctctttggatgcttcatcatgccacatgtcaagaggagagcaaatatgctccttggatgcttggagcatctccacactcccaaggcacctctccacctataaatacccctcctctcattcattccctcacacacctcaagaagaagatcaagagctctctcaagtattgtttagtagttctagtgctagtggagtaggaaatagaataatcttcatagtcctcgagtctttaggagatttcgggtatggctttaatagctttcctctcttcttttgtaagacttattgaattaatagcatattcttctttatacaagttcagtattttattccattcatattacttgagtgccgactttactttatacttgaatcaatatagtcgtgtaactagctttccaaataggtgtattggtgtgggtttagtgtccgattattcggttgctctgtgtcggttgcaaggatgtagagtagtatttagtaatgtaagcgcagtgcttagattattagataccattaattggggttatatactgcggatgagaggtgggccgctgatggtgacagctcagtacgggtattcctccgcgccggtatataatcctaagttaattccctagggagggtactcctccgtatttagccccagttgtatggtcatgacggctgtcgtaatgaactcggcagtaaggggtggcttctcgaaacaccaagagaacactgggtacggggtattggttgcatgactgtataatagcaagtatagactaaaaatgtatgtatactagaagtacatgaatgatacttttcttattctttcaccacttagcttagactatattttagagagagtagttgttagttctttcttctgtgtgtcaccctaccctttgaactgactttgatgtatataagtaacgtataaactattagcatagtactctcttatcatatcttcccttgggataaaataaatacgataccttggaatactctcaggtgaaatgctacaatggtatatccgtgcgcttgcggatcacatctgtaaccataatataccatgagtatttctagtgctattgctgggaattatatttccagtagtgtcgctaagaaataccaacagagcccacgtatgtagccaacgagcccaagtgaagtggctaagcccatgaaggaaaaatgcaaatagccctgtagcatctagtcctttactcatttacttgtctgatgtctccaactctggatcgaatcaattgattccttctcttctcgttcacctagtgacgctgcttccttgttctcgttcccctcttgccgattctctcatctcgcgttgccattgattatcatatcttctcgtagtgccgttctaggcccccaaccatcgacgcctaccctattcagattctcctcgccgtctccttcaccggctttgcctcgcggcactcgacctctgccactcaacctctgcttcgccggttgaagcactgccacaccacgccatcatatcccctctgtcggatattcctcgtgtgctttttcctcgttgacctagctagcctgttgccagtagccttcactgggcaacaaagtcgtggaggtcgcggtaccccacctcgtcgccccacgcagcagtcatggctccacctcgtcacctcactagcttggctcacgagccaaacgtgctagctcgagcttgcaggcaagccgagccgagatggggttctagctcgttaggataacgagccaagctagctcgttatagctcgttatcctaacgagctagactgagccgagctgagccgagccagctcgatgtccatccctaaaaaggagggggtgaaacctgaggtgggtatgtttggttagggagggttatataaagggttttttcatgatttccccctttgcagtatcgcggtggtactttggggcatggtaacatatgtagaatcgtgtcttgtgagtaaagttgtactcctctgatcagagttaaaactattcgaatagccgagcctgcggttattgggcggtcaaccagctcaccgtgattagtctcattctagttaatatgacataattaactggtgtagttaaggtggtttggttgggactattgcaacgtggtttagcgttgagcagtgatttttaatattgcttaattataattattgttttattgtattcactttatgatttataaatgctgcttttgttgcaaatatcctatagcctatcctttgtgaatatcttgcatcataccttgttccggacattgaggatccctgtgggttatgaaggaagcaacgtgttttggtcgtgaagattaagtttagattatttgtttatttctatagcatttgtaaaaattatttattatttttgtaagacgtggatttgtttatcaaattatcgtttgtgtactctagctggtcctggacagagattttattacacattctacttggagttcaggtagggaatttctgggcatgacattagctgagaaggaattactggcggctagcttgccatcggctgtgtggccgatggctgtgaacttttggaaattttcattgtcttgaacaattgagccagccgtggcgactgttatccctaattttgcggacttgctctgattttgggaaatggaaagaggagatcaagtggataaataactctcaaccaattttaggagataaaaaaaggctcaactggattttgatataagggcacacaagaattgtcatacaaggattgtctttcaaaggttctagacgctgagtgaggcagccggccgtgctagcttggtctacgactctatttgtggacgggatagaagagcggcaggccgagcgaaaaaaggtaggaatagactgtgctaggactgaaaaggaaaaacttaatgggcttttggctcaaaaccaagaaaaaattttgattaactttttcattatagtgtatagcaatcataatatttcaagttattgctcagtttataataggtgttgtttcactatgaaaaatacatttacccgttgcaatttttttcagagcgtgtacattcccgtgtttgtctgctccggctccacccgaactccggcgcccaatccgccggcctcgacgccggttcgatacccccgatgttatcctgtgggcggaggacctaatcctatctatcctgttccccaacacccatggcaactagccacctcacctctcgctccctcctcgtccaagcccagtaccccatctcacggctcccatccaacctccgcctctccctctcccaccacaagcaaccagccgccgtcgccaagcgccgccgagcccccgccccctcccacccggccttctcttcggtcatccgcggccgtcccaagaaagtccccatcccggaaaacggcgagccagccgccggtgtccgcgtcactgaacgtggcctggcctatcatcttgacggcgcgcccttcgagttccagtacagttacacagagacgccgcgcgcgcgccccgtcgcgctccgcgaggccccgttcctgccgttcgggcctgaggtaacgccgcgcccatggaccgggaggaagccgctccccaagagccgcaaggaactgcctgagttcgactccttcatgctcccgccgccgggcaagaagggggtgaagcccgtgcagtcgccggggccattccttgccggcacggagccgaggtaccaagcggcgtccagggaggaggtcctcggggagcctctcacaaaggaggaggtcgacgagctcgtcaaggcgaccctcaagaccaagcggcagcttaatatcggtgagttgcatctgatgcagcatcactcaattgtacacatggaacatcaactaattcgacagataaatgtctgcaagatttgtttcccccttgggctctggtaccctgttatgtctgtctgtgttcttttgttttctttcctataaaagactcgtgctctatgtgttttggctttctttacaaagccagatcaataataaatattgagtaaatttcacaaaactacaggtatttttgcacaatttatcagaaaactacagatttaagagctttcgcaaaactacagatttagtatgtccgtttattgtacaatctatcacaaaactacagatttaagaacttgtttcacaaaactatagatttagtgtattcgtttatcacaaaactacatatttagtgtcttcatttatcacaaaacgataaatctagtgtctccattatcacaaaactacaggttttaacaaggaaggggatggagaaagaaaaataagtatattttgttattatactcaccgatcaccgtgacatttatctcttgagtttagttcttatcatgtagccgctttgtcagccctttcttgtattcctagtcagtctctcattgccaacttttgcaggtagagatggtctaacacacaatatgttggagaacattcattcgcattggaagaggaagagagtgtgcaagataaaatgcaaaggtgtatgcacggttgatatggataatgtctgccagcagctagaggtcaaattttgctacttacctcagaattcttaaaatgcatacggtgtactactcagttaaattggtgactgttttattttttttttctttatggaccaatgttctagtaactcatctgaaactaatagaatttagaagttgtcttagctctggttattcattagtgaactcctttctgcttgaacttctgttttccatttccatatctgggagcaccttatctgtgactcttccctgattacttcatatcatacatgagcaggagaaagttggaggaaaagtaattcatcatcagggtggtgtgatatttctctttcgtggtagaaactacaattacagaactcgcccaatctatccacttatgctttggaaacctgctgcaccagtgtacccccgcttggttaaaaagatcccagacggcttaactccagatgaggcagaagatatgcgcaagagaggacgtcagttaccaccaatttgcaaactcggtaagtctctttgtttccatgtagttgactcctttaactgcctttcaaattgtggaatctgcaaatttcatagttaaaagaatgaaaaatatatgcgctagttgccaaagtttatttttgaaaatattagtgcctttgcagccaagagtaatgtccaaaataggaagtacctgagggaggttgatgtcgaacatgaaactactacttttatttgtcagaaacacttgaaatgtggaattacagttgaaccaatgctgcttcttttgctgagtgtggtacatattgtctatccacattagcccatcttcttgcatagcactgttccatgtttgtgcagtttgttgtcattgtttacattccattttttttaaaaatttttaaaggaaaaaatggtgtttatcttaacctcgtgaagcaagttcgagaagcatttgaagcatgtgatcttgtccgggttgattgctcaggtcttaataaaagtgattgcagaaagataggagctaaacttaaggtttggtaaatgctcagaatattatatcgttatgttattttgttcaaaacatgattaattctacctttgcaggatctagttccctgtaccttactgtcttttgagtttgaacatatactgatgtggagaggaaatgattggaaatcatcccttcctccattagaagaaaatgattttaaagtggcgagcgaccaaattttgaatagcaaagaagcaggttctggaagtgctctgaccccaattgagctggtcaacaatgccacgtctctcaagaaatgcaacttgattgaaggtgcagaaaaattggaagattccatgaagtctagttttgaaaatggtatgattttgggttctgcatgtggaaaccctggagtatgcaactctgaaggtatagatggaactgagtcctcagctgatgctccaattgaattttctccttcaaattcagcaagggatttagatccatctcaaacatcaacattgtattgccaaagctccctattggacaagagtgaaaatggagagctcattgagatgtaccctgacagatgtggaaactcggaacaatctccagatgtaccagaagctttaacttgtctaatgggcagcagtgatgagattcatgaattggaaactatgaggagaaactgcaaacatttaaacggcagcgatggtgttaacagtgattccatagtcccttcctacatggaaggaattttactccttttcaaacaagccattgacagtggcatggcactcgtgctgaatgaaaatgagtttgctgatgccaattatgtgtatcaaaagtctgttgcttttacaaagacggctccacgatacctggtactccggcatacaccaaggaagtcccatggtacccagaagactgagccagccaagaatgtaaggataaataagcatcttgaagaacataaagtatctgatcatgtcaaaaagaaagaaattgtcatgggaggatcaagaatgcagagaaatgatcacgcacgagaatttctatcagatgttgttccacagggtaccttaagagtagatgaacttgctaaattactggcttaaaggtgatcggtcctttattaaccgaaggtgtgttgcgttatcaaccttgaattaacgtgcaaagtatatacatgtacattgatatgggacgtataaaacttttcgtcaatttggtcatgctgtgtaactgatcacgctttctgcattgaaatgttggaatgtaataatatggaacggcgaagcattttcagacaatgagctctacctatagtgtgatcatctaggttgtgtccgttagctatggttgggaaccttcccacctagcacgcaaaacggatcaattcattagtgcatgattaatcaagtattttaaaatatttaaaaaatggattaatgtaaatttttaaccaacttttttatagaaactttttctaaaaaacacaccatttaacagtttagatgtgcatgtgaggaaaatgaggacttgaagttggtaaagtgttcgaaataacccttttcaaaccattgatcctaagcatatgcctggaagttgaagtaagattttatagatgtagcttactgtaaaatcaagaagttgatttagattttgtgatgaaaatattggttgtttgctgatgaaattttggagatttatagacgattgattttgtgaagtgagagtgttcggttgaccctggcgatcagaccagccaaaccaatggtctgaccggtgggatcttgaccgttgtcggtttcaggttgtcttattggatatggatgtttcctttagggatttgactttaagatgatttctatgcatatggatattgttgttatactaatatgagtcaagttgggacgaacttgtgctcggaatatggtttcttggttgttttacatgtgcaggtgttgcttgaggcctcgggagagtattgctggtgatagattggagttaacttgggagaagttgatgtctaggtatcaacagattataggatcaagatgtcgattagagggggggtggtgaatagacgatttaaaaatgaatggcacctaatcaaaactaacctaagttgctaggcttagtgagggttaagtctaattaagcaactaagttatattttacaaacctagggtgatagtggcttaagtatatctctaagaaagtaaatcacactcctaagttaagtttagcaatcctagagtgatatgatctcaagtatgtctctaggaatgtaaattgcacaactgtaaatgcgacaaataaatgagacaaggagacaaaagattttttaccgaggttcggaaattcgccgatttcctactccctgttgaggcgagcccaactccaccgctcaactagtattaggtttactaactttttgcagagaatgattatgaagtagaggagaatcgacatcaactcggacgataaatcaatcggacgatgtcgagaaccagacttgtgtgtgaataggccaagaactcagaattgacacgatgaattaggccaaaattcacaagtctgcggagtggagcaatagaggaggccaccagccgaaactgggctggattggctagccccaggttcggccgaaccaatcctggcaccgttggatccaggttttggcatggacgtccaggattgcatcccaatgacggttggagggcacttcggacaattccccttccacaaccgtcataaccacctctgtataaggagctcactctcttcacttcaacacacacctcaagcaatagctctctcattcctcccaagtttagtttagtagtatctagctggtgtaatagaaatagaatatgagtcaggagtccggaagccttcagaagagttcgggtatggctctagcagctttcctttcctcttttgtaagatttgtacttttattagaatactcttctatatatatttatggtattgaaatactttccgagtatatgagtaactattatacattatgttcttgttatactgaatataaggctaacttatctgggagatgctttggtgcgggtatagtgtttgcttatgcaattactctatgtcatgatgatgatattatagtagtatctagtagtttagacgtggtgtctagattacgagatatcattatttggggttatatattgcggatgagaggtgggccactgatggtgacagctcagtacgggtattcctctgcgcctatatataatcctaagttaatttcctggggagggtattcctccgtatttaaccctggttggatggtcatgacaggctgccgtaaggaactcggcagtcaagcgtggcttctcgaagtaccaggagggtatcggatagagggtattagctagtatatcagttaactagaatgtatgtatactatgtatattagaagtataggaatagatttcttttctctttttttttccacctagcttagataaattattaccgaggatgagtagaaatgcttgtgtgtcactctacccttggattatcttaacccctgcttagaatatgattatcacaagtaatatataaattattagttgagttctctctacatgatcttccacgggataaaataaatacgatacccttgaaatactctcgggtaaaatgctacaatggtatatccgtgcgcttgcggatgaactctgtaaccataatataccaggagtgtttcggcgccattgctgggaattatatttctagtaatgtcgttaagaaataccaacaccggcccacggagaggattacccaagcctcgatcactaggggtagttcttccttcactccgaaggtggtgaactccaaaccactcacaaccagcgtcggccttcctccgcaatcttctcggagaggtcaccgggcaactactccacaagccgtctaagaggcggcaacctccatgagtaacaagcaatgacgcggctcggagatagctctacaatggaagcaatgcacttgactcttggctagaacaaccttcaaccactacaacggatgaacacaagctcaaatgagtgtgggagaggtgcaaggggtgtatacaattgaagtggatgccaagagagtctccttgctgctggtgggggagtatttatactcccacccaccaaaactagccgttggggggtgaaatcccccaactctgtgtactgccagtctgaccggagttgtgtggccggtcagaccgtgctactctgcaacggctagttttctagttgttgtagggctgtcattgggccccatcggcctggccggtcagaccgcagttgggtggtagaccggcctcggctcggtcagaccgcccctagctcggtctgaccgaatgcggctctggcggctctggatcgccaccccgagagccacagggagaggttccctaggccggtcagaccggggttcacccgccggtcagaccggctgacctacgccggtcagaccgccactaggtggtcggtctgaccggccctggtcacacagcaggcacaacaggataatgagagcaagccaaatctaaatgcataatgacctaatgtggaaatttaaatcatctctttgctaggtcattacccctcttaatagtacggcaaagctataaataaactagcacagtttgattgcccaatacctcgatcaatttagaattcaactactagtttaccgtcatctatactttgctttgcgccatcaatttttagtccatcgataatcaaccatgcgcacacatgatgtgtacctaactcaaaacacataactcgatagaacggttagtccacaattagcgcttgtcattaattaccaaaactaacaacgggggcctagatgcttcaatctccccttatttggtaattgatgacaaacacttcaaacatatataatcaaatataaagcacatggatatatttttcaatgtatagaaaatactccccctaaacatgtgcatatcaatctcaaagaacaaatttggaacaaatgcacatttcaacatagttcaacacaaatacaacatatgatgtgaacttcacatatagatcaatcaattgcataggatggtcacaaatatatcaaaatcacatccaccatccatcattgcacaagttcacatcaataaaccatccaaatcataaaagttcatccatagatcatccaagtcacaaattatccaaagagggctcacaaataataacctaggctattacatgaccacggagggcccaaatctcacaagagagttcaacaaacgataaaaacacacaagatagataatatagcccattacatatagatatagccctcccaacttagcctaatagatatgaggactaacctcactacttctagtcccaacccacctaagatagatgaatttcttctccccctttggcatcaaggaccaaaaagcttcattcttgaggaatagagggaggatggggtataggatagtgagacgaagaggaagaagggtcacggcaacgagaatacacataggcatgtgtgttttccatggtagtcatacgccggtccaaagaagtgacttgagaggatatcctggcaacctcagaacgaatgcccctcgcatcctcatgcattgcctcagccctcatgctcggtagttagcctttgaatgctttcacttaagctatttatagccccaagcaccgagttgaaatagtcctgaggaggcatgccaaagtatgcataaggaggagtgaagtactcattgataccttgaggaggaggaggtgctgagcttgagattgccccagggtggaaagaaggttgcctcatcctaggagtatggggagtgccaagctgaagacgaggcttatattgcttatgcttctttagattgtttccaacactcccaagctgagcttgaatctacctcataatgtagggcgcatggtaaattcattgactaaacgtgcccttggatattgcaatctcttgcattatgaggttcaccacatcaaactgacgaccctgcatgatggcatctatcacatgccaagccacccccttaatatcatcattattcccacatcgagggagaatggtggctctcacaatcctgttcaccacactacgaatagtcatcaaccctgcaactttcccatgggtgtgtcgccttccatcttcatagaactgtgaaagataatcaatggagagcgggttgtgagtatgctcctcatgcagatcatcaccaaagtcaaagcggatgttgagtaacctccggaactgcctcctagagatagagtactggagggtgtgtgacatccacttcatctcactacaatcaccggcaacccacgttgtggcataaaattggcggatgagctcctcatcatagtcttgtgccataatgactatgcaatctatccccacagccctgaaaagggcttgcaagcttgtaaactctagagtctcatttatgttccgccatgaaatccacttgtgctttgcaaaagccctgctcctgtagagctgctcataaatagtcttctggaaggccgtgtgaaaacggggatcagtggtgtctctaggcctcttgaactgatcatgatgccttaggatggtgtactgagcggagttcctgatgttaaccacaaactgaacagaaggatcaatttccatctcatttccttcttcctcatcctccccactgccactgtcatcaccatctccactttcctcttcaccctcttcccgtccctcattcacatcttgctcttcttcctcacttgctcatattcctctccgctcgactcctcatgctcgcactcgggctcttgcacggccgcttgatgaccatggcgagtgcggggaggcattgctgaatccaaagagcaataaaggaatatgagcaacaaatttagaaaacactcggttaggcggaaagaaattttgcactgccggtcaggggcggtcagaccggtggccaatggccggtcagaccgcccgtagggctgaccagaccgccactaacaagtccaagcaaaaactctttcaccacaacacaaatgattctaaataggctaggataattttgcacagggtaagatcgtgaatcaacaaggatacggtctatttcatcaagattggaacaatgagggaaactacccttaaccctatttgagagtaagcacaaaagggagagtgatttaccggttgaaaggagatggtttgcacgaagaacaacccactaatttgtgcaaatccataagcacttcttccttcacctagagttccaatccatggatcaaaaactcaataaaaaaacaaaagaatccatggaatagagagcggaagagcaggagattcacttacggtgtaaccggagtgaaatccacggtcaaaccgaggggatttggtggaggagagtggctagggtttgagagaggagagagagatgagtttttcgagttggggatgagtggggaagagaagagaaggggtaggtgcaggatggagaagaagaagaagggcaaaactacctgggcccacctcagccggtcagaccggccctatgtggtcggtcagaccgcctcacctggtgtcacgtctagaaatttagcccatatttccagactattttgtgtattaaatccctgtccaggaccaggaccagctagggtacacaaaacaataaattaatatacagacccaaatgtaaataaagcgtaaaatacttacagaagaggcacttagtcctcacaccgaaagagaacgacagcagcagaaaaggcgatcctagcggggcttcagctccactccacaggcaaaactgaactagggtttgagccttggtcctctaacttcatcttcaactcagaagcactacacttctgaaaagggggaacaacagcaagactgagtacaaccaccgtactcagcaagccacaccattgatgcagacgtgcaaggggattcaaaaatggcttgtggctatttgcataaaggcagttgtaaaacattttgttgagcaaaacagtaaaactgctgattaattaaggtaacattaaatctctattgatcaacactacaccacgttgaacaggcccaaccaacccatctgaactacagtgcattgggtcgatttattaagtgtgagactaatcacggtgaatctggtcgaccgcccataaccgtgggcacagctattcaaatagttttactctgatcagaggtgtacaactttacccacaagacacagccccacaacacgttcccgtgcgccgacatgccaccatgacatactggaaagaggccgtgataggacccttcgcataaccccctctaaccaatcgcaccacacctcaggtttcacctccactcctcgcaaggcatcgggcagtcccctctcgtgcctaggtgaatccggaagcgacaaaggccgttgcagggcccatcccgctccatcatgcccacccttgcctggatacgtcggctagaggaaagctacactacaaacccagccgttgcccacgctggcttgtggtaagtacgataagttcttccagggcatcccgcgaaccagtccttaattgccatgggtgtgactagcaaaaccatgcacccacagcccaccattcagtcgcattttagttggataattacgaccaatgaaacatggccaggtgtctcgagcacgcagctcgttctgatgctaaaaaggtctaatacttcaattatcccatcaactgagctagtggtaattaagcatggctaagcatatagttctagctgggtcacataagtaacaagagctagtcgatttatcacccaaggttgacaaaggacaaatatcaagtaaacatggcacaagtgagcagataggtaaacccgattcccatgtaattggcaaaacatgcatatttatttgcaaacagtaaaacatttgtaaagtaggctcaacatgctcaaggggaatgtgtgacttgttttgcttcttcacttggatcttccgaactcttatccttgcgatcgcgatcttccgaaacggcataatctacgtgctggcatgcaaaatgaggaaaaactctaataaaaaccaaggaaacggtacataaagagtaaacaaacatgtggatctcagttttagatgaattttgcaagttgaatggcccaatttggagttcgaatgaattatatatgaattttagaagttttgagccatttaaatggatttctataattattattgatttattacgcaattaatgattatttttcacaaggaaaagggggttgctgacgtcagcaaggggtgaggcgtggaccgcgtccacaaaggggtggacccacacgtcagcggcacaagggcgccggtccaccgtggaccgggaccaccgaggcggtccaccaccggtccacgggaatcgacggcccggatcggcccaagccgatcgggcggccacgggcggcgcaacaaggacacaggcacggcatgaagctggcccgggcgagccatggcacggcagcggcacggccaccggcggcaacagccgacgacgccgaacagtggcgagcggccggaagacggcggcgttcacgggcagcggcaatgcaaacggaagggaaggggagcgggaggaggggctcaccgagcgtgtgggccgacgaggcggagccggaggtggccagcgatgggaagaggcgacggtgctcctcaaggaggcgaagcggacggtgctccggcggccttccgcgagcgggaactggcggacagtggccggaagaacctggagaagaagacaggggatttagggagcgaggaggaggcacgacgccgagggaaatggcggccgaaagcggcaaggatcagcgaagctcaccttggacggaggaaagcggtctcccgtgatgattcgtgaggagggaggggtggacgggcagtgcatggtgactgcggtgccggggaaggcaacgacgcagcgcgaggtggtcgggaacggcgtcgagaggcggccggaggcggctgctatggtggcggtttgggtggtgtggtagagtgacggttctagcggcggaatggaggagcggaggggatgccggggtacgagacgacgcagtgaagccgtcggtggcggttgcacggagcggtgtcggcctgctggagggcgtcgacgggcggcggagctcgggcccgcgctgcggcggtgtttcggaggcggagagggtaaaaggagtaggggccggggtgcggcacggcacggcgatgccaatggtggtggcggcacagcgtggcggcgtgcggctagaagcatggcggcgagcggcggagctcgggctcgcgtgggaagtgcgggagaaggcacgacgggctcgggaaagttggggaaatgagcgaggggagtgcgggaaggagttttatgggtgcgggacaacgggagggggccggggcgatgcggattcggggcagcaaccaccggcggcgtggggtggtgacgtgggcacgtggcggggcaaaccagcgcagttttcttgggggaaaattggggaaatggtggaggaggtgggggggtgcagttccaccacttgggcttgagcaggaagggctgggtggtgcggattttgcgacggagtaggcagcaatggcggccacgggcggttactggcgaggtggctggaggaacggggaggagctgacaggtggggcctcgggtccacctgtcggcgagggaaggagagaggaggccggggggcttatgtggacttagggagagatggggagcaagcgggccgagcggcccaaagaggagaggggagggaggctgccgggctggagggcaaagaaggagggagagggattgggccgagggcggcccaaaaggaaggagagggaattttcttttttttctttttatttaattgtttaaatgaactttgtgactttaaaattatttcttgagctccgaaaattcgtggaaaaatccggagagtactttagggcacagagaatattgcaaaatatttctggccaatgatttttatgggaaaattttaagtctaccattatttcacttgattaaattgctttaacttttatttaatttatagaaaatgatttattaattgatttttaatcccgaacgaaatcgaggtgttacaaatctaccccccttacaggaatcaagtcctaagattcgggtatggttagaaagaaagctgggtgtaggcggtctgatcgatctggccgatctgcacactgcattgatcccttttgttttaaactgactgatggactgaccaaccagcataacttaactgaactgactggcatcgaccattctattcttttgctcaaaacaaccgaactgactgggattcgaccctggagttctattgcttcgcaaaacttaattgattagctctactcgatctgaccctgacctgaatcacgagggctcatggaacttcctgtccctgtactgaactgctagcattatcaccttttggtaacctgagagctcaccaagcagactagaaattggcagatctttcatgaaatcttgtatgtgagcctgcatgaatgacagattctaactttactttgacctgctcctgactaccagaactattctaagaggctgcttgaccggtctttcgtctgaactgcaactgtacctgatgttacttctctgatgtgaattgttgtcctggcctcacgggtgtatcttagaattcaatcggatgacttgagatcggcatgactctattgacaccttgtagctggcttcttcgagtactacctaaattgttgtactgggttgaatctttaagggaaatggcgacgaggtgaaccaaaattcatctctgcgacctaccccccttacagagagtagtcatactttcgggtgaccgggaataattgaactattgtccttcaagaacaatcgacacttctcggatttacgaatggccctgacattgaaaacagaaaacttcatcgatcaatcaaaataaagcaatgacgatgcactttcatccaggtcaaggcttggaacttaaccctcagttgctgataggaaattccacataaagaaattctcatttagctcttgatcttactaactcttgactacttcccaatcagttctactgctggcatatttagcatgcttctggcctgacttcggtgtcatatgcttgaacagattgcatagtcgacattctttgaaacacatactgaccacttaacagatcaaactcaagagtccttctcatgacataacatcacacgtcgattattcttttgctgactcttcctgtattgatgaactgtaaaccctgcaactgctttcccaaaaatattgtaatctgcacggctgccagaaactgactttgatgctgtcgagagtttctgttctttgatcataacaacttcgctttcatatcttcggtaaagctgatctgtcgaaaagaggttctctgccacacaccctgctgactacacatttctgaacctgattcttggatatttcttgcccatgtatggaacaatttctgccaacttccgagaaacatcatgaggatttctagaattcgtagtggttccttcgaacatatggagaaccatccatgattcataatcgtaccactagggtgtaattgttgcttaccattctctaacagtttccaagggtagagagttcccaagattccttgtatgatgttacttctgaatttttttttcattactccctacacttgaatacccttgatactacctttagagagatttcatagtgtcgagcgctatggatccaaccattgtcacttccttggttaatcctttctttactcgctcgcaaacaggttttggagcacaacaaaagtgcgatgagttagaagggaaactcttggtttcttgtaacttgcagatacacatgttaacttgcttttgcatactcaaaggtgaaaagaagagaaacgcttgactcctactctattcaatattcccttttcaactatatcactggattggaacttctatgcacaaggaaggtatttgaacaccaaaggcctgtgcacaattgttgactcttgctgacagaactgctgatcagtagcacatttacccattgtgattctgacatggttgacttgtccttttgttggttactagctgaagctcccacaagaacaaaactttgactgatgacgttcctaagacaaacatcaatcctcttggtagctaaaaggaacgagaccttctcactatcggtgcaactcttctgttaatttcttgcgagacctctgaattggagcagtatgagatgcatggctgatgttgacaaccacattgaagtctgatgcttgagacattgattgcagtcgctgctgaagaattgagccgtctctccgtagctaaagtagatcactgatttcctggcttcgtctgctctgctggtgctgattctgtaatcttgaagtgattgctagagaaacaatagagaccttgtcagtgcacttaatgacaattcatcatgatggaaactttacacccaagtgacggttggtagtacttctctttctagggtctttggactggatctgaccacttcatacaggaactgatgtaacttgaggagacaaaggagttttaaccatgttgctgacttgatgagactgacgctttggcgctgaacaaccttttgagagatgataggtcttccaacaattggaaacaatggtggactatctttcttggtctcgagagtagaccattactgaggtggtgtcccggctcaaaacgattgagacacttctcacttgatggatctttgatgtgcactctttccgctgtgcatgctcccaactgaaaccagagtagagaactcataaccttggtgacaatgttattactatcactgtggg

SEQ ID NO: 70878 - DNA, 30344 bp, Oryza sativa
  unsure (1)..(30344): unsure at all n locations
tacaaccgtacaagacgttgtgttgcgccttagcgatcgataatgtaacaccccaggtagccacatacctagagtgccacaccaaaatacactaaaaaaaccaccaactcccaaaattattagaaatttcggcagagtaacctaaaagtacggacatccatgacaggcagttacaagataactcaataacgatataaaccacacaatccaacccatcctatctccacaaattccacgtgaaaataaggaccagaactttaaatgaccttcacaagttctacgcaaaacttatgctaagtagaaacatagtctaaaagtaaatttcaatagtgtgcaataataatgtgtagttcaagggtgctactcccgtcccatgccaatcaatatcattaggtacctaaaaaccaaattaaatacaagagtgagtaaaaatactcagcaagtacaatattgaactagtaaaacatacacaggtttaatgcaataagaaaaccaatatgaaatatttgtcttcctttaatttaaaaggaaggaggcaaaaagtagtagttccctcccgggcaggtgtgaatatcctcttagcattaccggtaagccgagcaagcgtgatcagcgcttctcaaggatcatgaatgaagatccaaattgcactcccatgactacgcatggtacttgaataatgtaaacaaaaacttccagaataatgaaacatgaataacgtcgtgaatttgaacatgaagtgaaatatgaatacgtaacataatactaaaatcacacaattgattataggaaggttcgaataataattggataaatgaaaccaaataaagtaacacagtttatctatcacacaagtccatcttgtacttgccttaactccttcaataatccgactcaactcctccaacattggaaccctccacacctgtggagcaaaactacgcataaaccactatatctaactaataatagttacaaggatatttactaaaatcgaaacccagttcatataaattattaccgatttgtattaaatagcctatagctgttccattactgttttatacgtaacgtacaaaccgtctaatggaacctagcaaataatataacttcggacatctagacaaaattgtctaccactttcatgttgagtcctgatttccagacccggtcagcagtactgtttttgttgtttctcccaaaccgtttatcggaattgagtgaaaccagcggcgttagaaagatatcgacgatgactacaaactttatttatgacaactaacctgaatcacgatggtttaataccagatttgaaaatactattgttagcccataatcaacaactaagaaaacactgaaccggcaatttaatcgattcccacgtgaaaattgtatttctatggactaagaggagttacacttgctgaggagaaatcgaatttgagatcaatttgtgaatacccagaaaatgcccaacttttgcctctctttcctttttccttcttttctcctgctttccctgcttcttgaaactcctgctctctgttcgttccagaagcacagcaacagaccagcatcagcagcagcagcgaggaacgttaacagaaacagccgtaacatggatacatatcagatcgatggcagcagcagcagcaaggattggcggcaacactcaccaaggagtcgagcaggagtggcgctggacggcgatggctgaacctgcggcgacggcgcagcagccattggggtgatggcgactagggtttgtagcggctgcagggttatcgatctcttccccttttctctttttttctttttttttcagttggttaaatagatatcctgatgaagatcgaacggcccaaattaatttaatcaccagtacttcattcggactccgattattataaactcatagtctattttgcactactcggcgagctctacgcatccatggttcctgatcgcctattcgaacaatggtttaaaaattgaacggcgtttgtgctaatattccccgaaatatactattttgaaactcggggcattacattcttccccccttcaatcgaattcgccctcgaattcgcccaaccaaactctagaacacggggtattacattcctccctccttcaatcgaattcgccctcgaattcgtccagttattcctcgaacaagtatggaaaggaactcataggtaggacttatataactcaccaggcgtgaataactctggctacttctcccgcatctatgtctcaagttcccatgtggcttctcgttcggtcttgtgcgtccaaagaaccttgacatatttgatagttctgtgcctcagcaccctctcagattcctccaatattcttagtgaacgggactcaaatgtcaaatcttggtcaatggtcaccggctctacggtaatatgatgttcagggtctctcaaatattttgtcaacatggaaatatggaacacatcatgtacacctttcatggactctggtaactcgaggcgatacgctaggattccagctatttccactatcgagaatggaccaatatacctacggctgagtttgcctttcgttccaaatctcacaacacctttggtaggagatacctttagaagtacttggtcacccacttcaaactctaattcccgtcttctgacatcagcgtagctcttctgcctactttgagctacgagcatgtgttttcgtatttctgctatccgttctgtggtttgttgaacccaatcgggttctaaaacagctctctcccctatggaatcccaacacaatggggatcgacactttcttccataaagtgtctcatagagtgccattcgaatgctagcatggtaaatgttgttgtaagcaaattctacaagcggcaaatgatcctcccaacatatcctctagagtttgaatagtccactcagattgaccatcagtataagggtgaaaaaccgtactgaatttcaattatcaaatgcctcttgcacagattcccagaacttagaagaaaatttaacatccctatcagaaacaatcgagcgaggcacaccatgtaacctcactacctcgcgtgtatagatcggtgccaagtcactcgcagaataagtggtgcggataggaatgaaatgtgccaccttactcagacgatctataaccacccagatggcgtcctttccttatgaagttcgaggtagcccaaccacgaaatccatagcaatatcatcccaaggccatacaggaacttccaatgattgtaactttccagcaggactcttatgttcagcctttactcgctgacataccccacatgatggcacgtactttgccacatccactttcatcctcttccaccaatagatcttcttcagatcatgatacatcttggtctcgccaggacgcacaacatatggtgttcggtgtgcttattgcaaaatctcttccttgactttagcttactgtgggacacataaatgcccatggaatcgctcaactctcgaggactccaaagtgaaatctctagtttttccttcctttacacgtttcttaacttgttgtagcaaccgatcgtgttgttgggcatctagcactcgttgtggtatgacagactcaagaatgactcgtgactcggtactcgccactccggcgtagcaataggagatacccatccgttcaaaatcaattatcaaacaattcacagttggaggaacgaccttacggcttagagcatctgcaaccacattcgccttacccgatgtatacggaatgttgagatcataatcttttattaactccagctacctcctctgctttaagtcgaaatccttctgagtgaaaatgttttgaaactattatgatcaacaaaactatcacaagactctccgtataggtagtgcctccaaatcttaagagcagagaccactgctgcaagctcaagatcatgagtggggtaattctgctcatgcttctgtaactgcctagacgcataagatataacattgccctcttgcataagaacacaaccaaggcctactcgtgaagcatcggaatagacagtgaaacgcttaccaaggttggggcaaagtaagcaccggagcagttaccagcctctacttcaattgctggaaactatgctcacattggtccgtccattgaaacttcacacatccttatgtgcgagcatcgtcattggtttagcgataattgagaaatccttcacgaagcgtcgttagtaccctgccatacccaaaaagctcctcacatccttaacattagtcggcctttcctacccgacaacacttgaaactttgctagtatcaactgagataccctgctgatcgattacatgccctaggaaagtcacttcaggaagtcaaaattcacacttctttaatttagcatagaacttgttttcctgtaaactccctagcaccatcctcaaatgacactcatgctcctctacatctttcgagtaaatcagaatatcatcaataaacaccaccacaaacttatctagaaagctatgcaacatgctattcatcgcctccataaaataggccagagcattggtcaccccaaaagacataactctacactcataatgcccatacctcgtggaaaatgcggtcttctcaatatcctcttctcgcactcgaatttggttataaccagattgcaagtcaattttagaaaacaccttttactccctttaacttatcaaacaaatcttcaatatgaggcaatgggtacttgttcttgattgtcgcagcatttaaggcccgattgtccacacacatacgacaactcccatccttcttctcagtaaaaataacaggtgcaccccatggcgacacactccgtcggattaacttcttggataatagatcatctaactgttttttttcaactcttcttggaaaggacgagctaaccggtacggggctctagagatcggtcgtgtaccaggaacaagatcaatacagaactctacatcacgctcaggtggcatccctggaaattctacgggaaaaatattgggataaacttcgttcggactccgattattataaactcatagtctatttttcactactcagcgagttctacgcatccacggttcctgatcgcctattcgaacaatggtttaaaaattaaacttttgcacgtttgtgctaatattccccgaaatatactattttgaaactcggggcattacagatacacctctcagagggttgttgatcttgccggtgcagatcaaccctattcctacaagcaaatcgaagaaacaagtaagaacaagataaaagcaatatgatattgcaaataggaatgaatacacacgataagttggggttttgaatacaagcagacggacggtctagctgacacgcacgctgtaaggaagtagcaatggctaaactttcatctaaacaaaacccaagaaaccctgaagggtacctagctatttataggtgtgggaagatgaccaacggtgccgtagggtcgttctccaccaggttggggtgcactccacatgggccccacttgggccggggtcccagacgaagttacaagcccataggcctattacaagtgatgcaacaccttgtttcttcaattgcggctcactaagatggaatttcgcaatgaggttggatccgttttaaagacaactccgagagctttttattaagtactcgtggacccaaaacggagctcgtatgcatatttggcggccatttgaagtcagcaatgtagcaggtggccgaatcgaattccagcttttagagaacttgatcttgatgtcttcttgtagatccatgatgtgagcaatggttgtatccatagtagccatggtcacattatcctccccttcttcatggaaaaacgtcctcggtttttccatgtggtgctcttcacgtagtccatttaaaacaacctgtttcttccaatcaaaacaaggcaaactcgagataatttggttagcattaacattcctctctagcttgtatgttttatccacatgtacaagaggtttctaaatccgaacatatgtaaactctatgcaccaaatatattccaacatcattatattcaccaaagatatgaaaaatagcattagttggacatggcaaattagatttagcaaataatttctccttcaaattttcaagctcacaaaaatcatcaaaccgaacatacccaaagtatttaaagaagatagcaattcacattcctctatttcattagcaatgtgaacaacatgcttaaaatcaacacacaaagaaacaatagaaatagcatcttctttcaccagttgtggcatggatataagtgaagcattatcacacaactcttctttatcacaaggaacagcaagtaaatcaacttgtgataaaggcatctcagcaattggttccactaatggttgctcttctctagtatgaaaagtggacatgttcaattaattaacggcacagtcaccttgattaattgcagcaccattaagtttaccttttatgccacttcagataatgtaggtgcatcagtcttctcttctgtcttcgtgagcgatggagatggcatctcgatcatattgctcttctcctcatggtgaatgttctgagctccctgcaaaatgtcagtaataggaggcacaagcatagcttgtttctcccttgggttctttaaaatattgctctcaacactgcaagcaagcatgaacaagtggcctatatgattatatgtcacattaataagcctagcttgaatatcggaattaagccctctaaaaaatctagtcattgtgttctcattgctttcttttaaaccactaaaagtgatacaaattttaaagttatgaaagtactcctgcacggttttgtcaccttgttttagatgtgaccatggcaactacagataaaaccattgctcacatcatggaagaacaagatgatatcaagatcaagtcctccaagtgctggaatcagattcggccaactgctacgctgctgacttcaaacagccgccgaatcttcatacgacctccgttttcagcccatgagtacttaatggaaagcactcggagtcctctttccattggattcggcctcatcaccaaattccatccaagtcatccacaaatgaagaaacaaggtgctgcgtcacctgtcatgggcctatgggcttgtaactttgtttgggaccccggcccaagtggggcccatgtggggtgcgccccaaccaggtggaggacgacctagggtcctcccacctccttaaatagttaggtaccccttcagggtttctcgggttttgttagattaaagtttagccattgctacttgcttgcagcgcgtgtatcggctagactgtccgtctgcttgttcttcggaaccccaacttatcttgtgtattcattcttatttgcaatatcagattgcttttatcttgttcttgcatgttcttcgatttgcttgcaggaatatggttgatttgcaccggcaagattaacaacccacagagaggtgtatcgatcgctagggcgcaacacaataacgtcatgtacggttgtagtcgggtcgtcaatgtttctcccaaatcgtagttgtctcaactcactgaaagatcgggccaaacaacaaccttgagtgtcgagtggaactcagggttcatcaggtggtatcagagctttcgttgctcggtgagtttttatctagctataacctgaaaattttcctacaaaaaaaattgcatcctgtacctagccatctttgtgccattgtattgttcttttcagtttttgcgttgttgaattttgtgttgcatcgtcacgtcgtgttgctggtcttagcgtctagttcgtttagagtttcgaattctagtcacgttttgtaccactgtcgtcgcagccgctgtgtcttggttgtcatcgggacctacgaaattggaatcgtctttccgccagagttccatatttgtagttttcagaagtttctgtcggttagttttgaagttgcgtctagggtatgctgtttagacgggcttgtgtttgtgccgtggttatgttttgccgtgaggaagaaaaaatgggaaaggaatatagcatatctgtttggattcggttcggtggaaggaaaggaaaataataatacattggatcggcaaatcagtttctgatttatctcattcatttaatctggccggccgatccatccacccactgtacccgcacctccccaccatctacagttgtttcccccaataccgtgagtagctcaacaccatggtgaaaatttttcaagtgtcggattggaaatccgtttgaaacaacggaacctatgagggacgagagcattccatttttgtatagttctaattttgggattgaacttttacacttgagtccctgtaatttttagattcgcatttgagtccctgtaatcttgcattgaggtccttgagtttgtttttttaaaaaaaataaaaaaaaggcagaaaggtgcataaaaaaagcaaagaaaagcagcaccaaaaaagaaaagaaaagaaaaagaaaagaaagaaaaaaaagaaagaagaaagaaagaaaagagaaaatattgttatctttgagctgaacttcatatatcagagtgtgcttgagttgtttctagtgctatcctgtggtatcgtttgtgtttaggctcgcgtctctagtacgttctagcctaggaccagcacggtacttgactttgaacgattattcaactttgcattctctgatttgagcatttgctattcctttgctacatatttaagcctacccagagctccacagatttgattacagccgtacaacaagtgtttgccaaggcattcatacatccaaacttcgttgtggtgcttggttgagtcggtgtacatcaccattccgcttgctttggtaagaacttgtaagagcttggttaaaagcttgagtgtgtgtgatatttgagctaccactacctagtagttgataggaacgtgcatattcttgtgtgtgtttcttgtttgctactaaccatggcaggattgcgcaagggaatacgagaacatcaacttctacaccttcgatgagatatgacgacttctccacgtgatgcatatgaggtacatgactataattttgcacaagttgcatcaaagttaccattctatgatgggaagtatgattttgttgcatatattgattaggagctagcagtagacaatgaatttgatatatatgatttttctgatgctcaaatgattaaggctgctagtaataagtttacctcttctgcattattttggtggagttatgtttgtaacaaacctgaaactttggatgaattcaaaaccataatgagaaaatgctttgtgagttcttattacaaatgtactcttcgggagaaattagaacatctgaaataaggcgatagaactgttaaggactacattcatgaatttaaggtctgtatcatctacagtgatctcaaagagtgcaatgaaaatacaatgcgtagatttttcaatgggcttaattctaaaattcaggttttgtttgataatgtgacatataatcatattgggcacctattcatgcttgctcgtagcattgagagttagatcatatcaaatgcgaggaagcatgaacaatgtgatttatctcccatttctgaatctcctatatccttatgcaatgatgatgtgcaaacattggaggagcaatcttttgtctctcctgttactaacgttttgcagggagttcagaacattcaacaaaaggaggagaatggtgtacttgataagaaagaggatgaagcacctgcggtttcggaagaaagtttgcaaggtaaattaaattgtgctgagataaatgaatgtgagtattctcaagctgagctacacgtgtccacttttcatgctatagtagagcaaccattggtggaaccaattgttgagatgcctttgtcacaagttgatttacttgttgttccttgtgataaagaagagttgtgtgataatgcttcacttatatccatgccacaactagtgaatgaacatgctatttctagtgtttctttgtgtgctgattttaagcatgttgttcacattgcaaatgaagtagaggaacatgaatttctatcttatttaaatactttgggctatgtttggtttgatgatttttgtgagctcgaaaatttgaaggagaaattatttgctaaatttgatttgccatgtccaactaatgctatttctcatatctttggcgaatataatgatagaggaatatatttggtgcatagagtttacatatgttcggatttagaaccttctgtacatgtggataaaacatgcaagctagagagaaatgttattgctaacaaaattatctcgagtttgtcttgttttgattggaagaaacaggttgttttaaatagactacgcgaggagcaccatatggaaaaaccgatgacgattttccatgaagaaggggaggatgatgtgaccatggctactacagatacaaccattgctcacatcatgaaagaacaagatgatatcaaagatcaagtcctccaagtgctggaatcagattcggcttacatgtgtgtgaaccctcgtccaggaatcagccgaggcacacaataaaaaattgataatagagtacaattattactctaattaataagcgaataaaatgtcattacagaggtagatagttactctcaatcaataaagatataagcagcggaaaaaaaataagataaacggcgcagacgactccactccacaggcagcttgaccagggctacacctaatcctccacaccatcagcatcactgtagaactcctcctctgatgaatgattgcaaggtgagtatatgacatactcaggaagccacgcagcaaatatgcaagtgcacaggataacaaaggatggcatagtagggtttcatttgaataaacaacatttaatgaacatttcagaatttaataaaacagttaagtaataattaaacaatattaatccaacgctatacaacataccctgttgcataggcccaaccattctgaacaaccatcccggctgcacagttctatctccaaaccaggaatatgccattccaaaccagggttgtttgggatctatgtgacttgccttgctggccttggaactcttcaaattcttctcctgcgaaaacggactctccggaaacgtcggaatctaaacagaaaggagcaaaacaccaaaaaagcacataaacaagcatgaacagtacatgtggatatttttaacatgtagatctcaattttagaaaaatttagaaacttgaaccaactaaatccgagctaagatgaattagttatgaatttttaaagattaaatcggattaaaacacttatatgagtattaattgaattatgatgcaataatgaattatttttgaaaaggaaaagggaattattgcgtcagcggctagggttcacggtgaaccgggtgcacggcggcggctcacgaaaacgaacggccgagatctttccatccaaaacgaacggccgagatcgaccggtccacagccggaccacggaagacgacgacgatgacgtcagcggtgacgtcaccaccggcggcggctcgggcgcgcgtcacaccctaaaaatcctaaatatataaattgttgtttaattggaattattagaatttattttaaaagcctagaagagaagatctaatttgtaattaataaatcccaatataaaatggggccagataaaatttcattaaatactttgcttaactctataattcttagatttttctgggatttatttgaggtaaggaagtatttttaataaatggaattgcatttaatgaataatttaaattggaaaaggttttaaaagttctcttttggctttgggccgaaagtcggcccaaaaccctctctctctcctcctcggcccagtccgcccgcagccgcccgcgcgcgcgtccgcccgctgacaggtggggcccacctgtcagtcttcgtcttcctcgcgccgctgccgccgcccgagccctagcgccgcgccgccgtcgtctccttccaaatctagccgccccttttcgtttccggtgaaattaatagaggggaaatgatccccgggatcacctctatcttttctcttatggaatcgtcaactaatttcgtttggaaatccgtggattcaagttcgattcggatcgatctctctcctccgaaccctagactttccttcgccgtcgccggtcgccgtgggccttcgccgccgccttccaacccctatataaggacccccaagcccgctgctacccgtcgccacccttgccttcgtctctcgtcgtccgtagcgccctagccccgtgagacctcgcgccgccgtcgtcgccgccgctccagccgtgcgccgctgtcgctcggggaggtcgccatcatggtcgccgtcgcgtcgccgtcctcgtccgccactccgccgtcgctgtcgaccgccggaacaccgccgtcgtcgtcaagccgaaggtcgccgccgcttcttcctcgacgccgtcgccgtccgttgatcttccgccgttgttttggtcaccggtgagttcgccgcgtcgccctctacgtgttcgttccctccgttcgcgctgtcgtgccgtcgttcaccggcgggcatgcgcgcccgagccgccgccgatagtgacgtcgtcgctgacgtcatcgtcgtcgtccatcagtgagccgcggtggatccgatcgatcttggccgtccgttttggataggatcgatctcggccgttcgtttccgtgagctgtcgccgtgcacccggtccaccgcgaactctagccgctgatggaataattcccttttccttttcaaaaataattcattattgcgtcataattcaattaaaacccatataaatgatttaatctgatttaatctttgaaaattcataagtaattcatcttagctcggatttagttggttcaagtctctaaatttttctaaaattgagatctacatgttaaaaatatccacatgtattgttcatgcttgtttgtgtgctgttttggtgattttgctcatttctatttagattccgacgtttccggagagtccgtttttgcaggagaagaatttgaagagttccaaggccagcaaggcaagtcacatagatcccaaacaaccctttgagcatgttgatcccgtttaaagctcttgtttctattcaactattgcatttattttcgaatgtcattgggtggaattaacctattgtttgttatagcccttttgttcttgattactttattccttgataccttgggttattataacttgactagttgggctatatatattggttcagctaaatattagatatgattgcttagccatgcttagaaacattagcacactattgggataacttatgactcactattatttaattatggcttaatgatagttcacgatggtcaatcgtgattggttaattaattacttgccaactaaaacttgataatggtgggttgtgagcacatggttctgatggtcgtgctcatgacaattaaggaccggttcacgagtttcggttgtgaaacattaaccgtgccaaccacaagccagcgtgggcaacggctttaccttttgtatagcatggttcattgcggagcaccagactaagaagtggcggagataagcccacgagggtcgctggggagtccatgccttgtttataagggggtgattatgatccaggaacggtgcgcggtggtggattgtgttgtgcgaggggtactgtcacagctcctttccgaagtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcatcataataaaagatgctataactggtaataatttgattagctcctggtttggaatggcatattcctggtttggagatagaactatgcagccgggatggttgttcagaatggttgggcctatgcaacagggtatgttatatagcgttggattaatattgtttaattattacttaactgttttattaattctgaaatgttcattaaatgctgtttatgcaaatgaaaccctactatgccatcctttgttatcctgtgcacttgcatatttgctgcgtggcttcctgagtatgtcatatactcaccttgcaatcattcatcagaggaggagttctacagtgatgctgatggtgtggaggattaggtgtagccctggtcaagctgcctgtggagtggagtcgtctgcgccgtttatcttattttttttccgctgcttagatctttattgattgagaggaactatttacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagcgcgcaaactcgctggcgaacgacggcgcgacgacgcgaacggaggacaccaacacgtagagggcgacgcggcgaactcaccggtgaccaaaacaacggcggaagatcaacgaacggcgatggcgtcgaggaagaaacggcggcaaccttcggcttgacgacgacggcggtgctctggcgatctacggcgacggcggaggggtggacgagatcggcgacggcttggtgaccacgacggcgacctccccgagcagcgacgacgactggaccgacggcggcgcacggctggaggtgcggcggcgacggcggcgctaggctacacgatgctagggctctaccggcgacgagaggcgaaggcgagggtggcggtgggtagcggcgggcttgggggtccttttataggagcaaggaggcggcggcgaaggcccacggcgaccggcgacacgaaggaaagtctagggttcggaggagagagatcgatccgactcgaactcgaatccacggatttccaaacgattttagccgacgattccaaaagagaaaaggtagaggagatcccgaagatcatttcccctctattgatttcaccggagaaggaaaggcgcgagcgaatttggaaggagacggtggcgcggctcggctagggttcgggcggcggcagcggcgcgaggaagacgaagactgacaggtgggccccacctgtcagcgggcggacgcgcgcgcgggcggctgctgccggactgggccgactgggccgagagagagagagagagggttttgggccaactttcggcccaaagccaaaagaagacttttaaaaacctttttcaatttaaattattcatgaaatacaatcccatttattaaaaatacttccttagctcaaataaatcccagaaaaatctaggaattatagaattaagcaaagtatttaatgaaattttatctggccccattttatattggaatttattaattaaaattagatcttctcttctaggctttttaaaataaattctaataattccaattaaacaacaatttatatatttaggatttttagggtgtgacaaacctaccccccttaaacagaatctcgtcctcgagattcggaagaactggtgaatagatgcggatgagctgactttaattcatcttctcgttcccaagttgattcttcttccgagtgattactccactgaactttacaaaaacggataactcgattcctggttcttctctcatcggtttccaagatacggattggtttctcaacatatgtcagatcctcttggatttctatctgttcaagactagcttcctcagtgggtacccttaaacacattttcaactgtgacacatggaacacatcatggactcctgccaaagattgaggtaactccaactgataagcgacctctcctcttctactgacaatcttgtaaggtcccacaaaacgcggtcccaattttcctttagtgtggaagcgatgaactcctcgaagaggcgtgacacgaaggtacacataatctccttcttcaaaactcaaatctctacgacgattgtcggcataactcttatgacgagactgggccacacgcaatctttcttgaatgattttcaccttttcttctgcttccctcaggatatccgtcccaaaaacctgacgttcccccatttgatcccacaaaagcggagtgcggcacttccgaccatacagtgcttcgtaaggagccatatgaagactagcttgataactgttgttgtatgagaattccgcataaggtagattcttatcccaacttccaccaaagtctaaagcacaagctctcaacatgtcttccaaaatctgatttaccctttcggtttgtccatctgtctgcggatgataagcagtactaaagttcagcttagaacccatctcttcctgaagcttcttccaaaactttgaagtaaactgactacctcgatcagacactattttcttagggacgccatgcaaacacacaatcattgccatatacaattccgccaaccgacttccagaatatgttgtctttactgggatgaaatgagccactttggtaagtctgtcgactatcacccaaatagagtcatggcctgataacgttctgggtaggccagtgatgaaatccatgtcgatctcctcccacttccattcaggaatcttcaaaggctgcagcaaacctgcgggtttctgatgttctgccttgactcgctgacaaacatcacatactgctacgtattctgcgatttcacgcttcatacttgcccaccaaaatttttccttgagatcctggtacatcttggtactaccagggtgaatggagtataaagtatcatgagcttctttcagaattgtattttttaaatctttgttgtctgggacgcagattctctcacccaaccatacagttccttgctcatcttccaagaaaccgatagcttttcctcttctcatattcttcttgatttcttaaatatcaggatcattaatttgggcatctctaacttgatcaattagagtgggctttgcttctaaggctgcaacgaaacctctactgacaattcccaaatttaatctttcaaattccttacataactccaatggcaactgtcgtccttccgtagcattgcaatagcctttcctgctaagagcatctgctacaacattagcctttcccgggtgataatgaattcccatgtcataatccttaattaattccaaccatctccgttgtctcatgtttagatctggctgagtaaagatgtactttaaactcttgtgatcggtgtacacctctgtacgagtaccgaaaagataatgacgccaaatcttcaacgcatgaaccactgcagctaactcaagatcatgagtagggtagttcttctcatgcgggcgtaactgacgagatgcataggcaaccaccttcccatcttgcatcagaacacagcctaacccaagcttggatgcatcacaatacacttgaaaacccttctttgggtcaggcaaaattaaaataggagctgatattaagcgattcttcaactcttgaaaactctgctcacattcttctgaccacttgtactttacatccttttaacgtaatcgtgtcatgggcttagcaatcttggaaaaattctctataaacctccgataatatcctgcgaggcctaggaaactacaaatctctgaaactgtctttggttgtttccagttggttacggattccacattactaggatcaacggcaactcctccagctgagatgacgtgaccaaggaacttcacttcagacatccaaaattcacacttgctaaacttggcatacaattgatgctctcgtagcttctccaatgcaaggcgaaggtgttcttcatgctcttctttggttcgggagtagataagaatgtcatcaataaagactaccacgaacttgtctaggtattccataaacaccttattcatcaagttcatgaagaaagcggggcattggtaagtccgaaaagacataacagtacattcaaacaacccatacctagtggtgaaagccgtcttaggtatgtcttcctctttaatcctcaactggtgataccctgattgaagatcgatcttggagaaaacagtggcacctttaagctgatcaaacaaatcatcaattctgggtagcgggtacttattcttgatagtcacatcatttagtgcacgatagtccacacacatcctctgggtatgatctttcttttccacaaaaataactggagctctccatggagatgaactcggtctgatgtatcctttctgaagcaaatcatctacttgcctcttgacttctgctaattcattggctgccattctataaggtctcttatggatcggagttgttcctggtaccaaatctattctgaactctatgtcccttttaggcggcataccaggtaaatcatccgggaacacattgggatactcccggactataggaatctcttccaaagtcatttggttcagacttgaccttaaagactcagaagacaatgcatgaacagttacaactcgaccatcattgctggtgagagttacttttctgttggcacagtctatctttatacctggctaaccagtccatccctaggatgacatcaaggtctttggattctaacaggataagattggctagaaatggtacttcttgaatttctattctgacagaggggctacgttgcaaagagagtgcttgattacttggggtactaaccatcaaaggacgtctaagatcttctacttccatcccatgatttcccgcaaaactcatagataaaaatgaatgtgtagcaccagaatcgaaaagcactgttgcaggaactgagttaacaaggaacgtacccaaaatcacatctggagcaccttgagcttctgcagcagtaacatgattgacacgagcctttgatgctgatgcggtagagttgctctgggcagggacaaccttcacgcgtcggggcttcggacacttgtcagcgtaatatcctgggtctccacagttgaagcacgccctgggcttgctgccttgctccctcttggcaggctgttgctgtgttggagctgcaacagggcgtggagcttgattgcggatgttgttgccagcattgttgttgaagaactgacgctgcggacgaacaacagacgaagaacctccctgtggcatggactggggtcctaaagtaagacgcggcctttgactattcccctgttgtgccttgaagtgagcaatccggcgtttcttctgctccatgcggttgtacttgtcctcctggcgaatagccttatccactaacttctggaaatcatgataatccccagtcatgagtgggtaagaaagctcatcattaagtccttccaagaacctctcctggcgctcttcatcagtgcgcacatcttctggagcataacgagccagacggttgaactcgtgcagatactcggtgaccgtgcgagatccttgggtgagcgacctgaattccttcttcttgagagacaccactcccgatggtatatgcgtcttccggaaagcagcggtgaattcaagccaagtgataggttcagcagtagtcctgttaaggcggaagtgatcccaccactcagaggcagggccatgcagctggtgtgatgcaaatgagaccttctcctgatcagtgcactgaagcaaatccaacttcttctctatggcatgcagccaatcgccagcttcaacaggattagtggtgctagagaaagtgggcggcctcacacgaagaaattctgctaacttgttctggggaggtgcatggttatttccctggttctgctggttctggagttgctgcatcatcatgttcataagctgtgcctgttgagccaggacttgggcaagtgtgggattctctccattgttgttgttgttattgttgatgttggggccattcccgttgctgcgagtgagcaccatctggcatgggcaggatcacaagaagagaaaccgtggaaaactacttaggacagagaattaacttttctactaacttaacttttattgatcttaactgagtttcattattacagaactgaagactctcacaccactaaactcaccaactacctaacactcgaaagcaaacaaacgcatgcacttacatcccaccactgatgtaaaccacatgcaggacccacacacacaaccaaacttaaaacaagcaaacgaacacaacgatctaggacaacggcttgacaaggcactctaggtcttccgggcatcggagttgattgaaggctcgttcggctcgtctcaatcatcttgagtagctccccactcgacctttgaatgggtgcgcttcgattcttctccttcatcatcacttacattgacgaccggaggatccgctagggctggggtaacttctttctccaccacacggacctttggtgccaattggtagcgagggacgaatagagctctcttcgttgcggtaagacgaatcctggccttctgcggtggtgcttctcccatcaacgcggctagttccttctccaaacgatccaccttgtcctctaacctgcaaatcttaccacgattccgatcgtcacgatcttgagctgctagcacaacctccgcgcgggtttcatccatagcccacagcatctcaaccaaatgccttatggtagcatcattctcaatcccctcagtctcaagatagctgccacggtcacttccctggggttggcgaggatggtagcgatactcagtgtcggccaactaatcactgtagcgatcgcggagctctcctatggcgatccttgccacctcctgacatgcatggatgtagtttcctcctccagcttcgaacatcactgatgggatatcttctctattactgttcaaggtgactttgactcggcacttctcttcttgacgatcatgaggaatctgggcatacaaaggggcagtcccaaatcctatggcaaaggacatcgtgcgcaactcctagacaaatccctcaacaccatacaagtactcaggcttgtagcgcggcatctaaagacaagtgaaaggaggaagttaagacatttatccaattaatagcacaagtttttggattaatttgaataaagttagaaaatcaaagtaaaaggtaagtaaataaagtaaaccaagcttgcaagatacgttgaaacagttggaaacaagatcacaaattttgcacttttgaacaacaggttccaaaagaaataaaagaaagttataaaatcaacatgcgaaatttattttattgcagcaaaataaaacaatgttataaacatttgctagtaaatgagccattagtacagtaatagatgtatagtactaacaacactggaataaattttgaatgagaaccactaaaagagattatgaagtgcatgtgccattagtttggtttaattaaaagagaaagggaggagaacagttctactttttcaatatttttagagggcttctatgggtgaccatttggcataacctagggtcaaggaggctctgataccaacttgtcacgcccggaatttctatccaaaattccaaacgcttacatgtgtgtgaaccctcgtccagaaatcagccgaggcacacaataacaaattgataatagagtataattattactctaattaataagcgaataaaatgtcattacagaggtagatagttcctctcaatcaataaagatctaagcagcggaaaaaaaagataaacggcgcagacgactccactccacaggcagcttgaccagggctacacctaatcctccacaccatcagcatcactgtagaactcctcctctgatgaatgattgcaaggtgagtatatgagatactcagcaagccacgcagcaaatatgcaagtgcacaggataacaaaggatggcatagtagggtttcatttgcataaacagcatttaatgaacatttcagaatttaataaaacagttaagtaataattaaacaatattaatccaacgctatacaacataccctgttgcataggcccaaccattctgaacaaccatcccggctgcacagttctatctccaaaccaggaatgtaccattccaaaccaggagctaatcaaattattaccagttatagcatctttttttatgatgggaaatgtgaaactaatcacgaaagacattgttagacccgcccataaccgcgggcacggctattcgaatagttttactctggccagagatgtaccactgtacccataagacacagccccacgacatgtcaccatgcgcctcaataccaccacggtacctcagaaaggagctgtgatagtacccctcacacaacacaatccaccacagcgcaccgttcctggatcataatcacccccttataaacaaggcatggactccccagcgacccccgtgagcttatctccgccacttctcagtctggtgccccgcaatgaaccatgctatacaaaaggtaaagccgttgcccacgctggcttgtggttggcacggttaatgtttcacaaccgaaattcgtgaaccggtccttaattgtcatgagcacgaccatcaaaaccatgtgctcacaacccaccattagcaagttttagttggcaatttaattaattaaccaatcacgattgaccatcgtgagctatcatcaagccatcattaaataatagtgaattataagttatcccaatagtgtgctcatgtttctaagcatggctaagcaatcgtatctaatatctagctgaaccaatatataaagcccaactagtcaagttataataacccaaggtatcaaggaataaaataatcaagaacaaaagggctataacaaaccataggttaattccacccaatgacattcgaaaataaatgcaatagttgaataaaaatgatagctttaaacgggatcaacatgctcaaagggttgtttgggatctgtgtgacttgccttgctggccttggaactcttcaaattcttctcctgcgaaaatgaactctccggaaacgtcggaatctaaacagaaaagagcaaaaacaccaaaacagcacataaacaagcatgaatagtaatgtggatatttttaacatgtagatctcaattttagaaaaatttagagacttgaaccaactaaatccgagctaagatgaattagttatgaatttttaaagattaaatcggattaaaacacttatatgggttttaattgaattatgacgcaataatgaattatttttgaaaaggaaaagggaattattgcgtcagcgactagggtttgcggtggaccgggtgcacggcgacggttcacgggaacggacggccgagatcgatcctaaccacaacggacggctaagatctaacggtctacgactggtctacgacggatggcaacgatgacgtcggcgatgacgtcatcaccggcggcggctcgggcgcgcaagctcgccggcgaacgacggcgcgatggcacgaacggagggcaccagcgcatagagagcgacgcggcgaactcaccggtgaccaaaacggcggcggaagatcaacggaaggcgacggcgtcgaggaagaagcggcggcgaccttcggcttgacgacgacggcggtgctctggcggtctacagcaacgatggaggggcggacgaggacggcgacgcgacggcgaccacgacggcggccttcccgagcgacagcgacgactggagcgacggcgacgcacggctggagcggtggcgacgacggcggcgtgaggtctcacgggctagggcgctacggacgacgagagacgaaggcaggggtggcgacgggtagcggcgggcttgggggtccttttataggggttggaaggtggcggcaaaggcccacggcgaccggcgacgagaaggaaagattagggttcggaggagagagatcgatccgaatcgaactcgaatccacgaatttccaaacgaaattagccgacgattccataagagaaaagatagaggggatcccagggatcatgtcccctctattaatttcaccagaaacggaaaggggcggctggatttggaaggagacggcggcgcagctcggctagggttcgggcggcggccggccggaggtagacgacaggcctgacaggtgggccccacctgttagcggcagcgagcgcgcgcgcgggcggctcggcttgacttgggccgacttgggccaaggaggagagagagagggttttggtccgactttcggcccaaagccaaaagagacttttaaaaccttttccaatttaaataattcatgaaatgcaattccatttattaaaaatacctccttggctcaaataaatcccagaaaactctaggaactatagaatcaagcaaagtatttaatgaaattttatctggccccattttatattgggatttattatttaaaattagatcttcttttcaaggcttttaaaattatttctaataattccaattaaacaacaatttatatattaacgatttttagggtgtgacatgtagtttgccccaagccccttgagatcattcacaatgacattgagcctcccatacatgtcattcacactcttatgaggcaacatggggaatgtctcatattggatcttgaggaaatgaagcttggcatccttgtactcgcttgtgacctcatggatctccgccaacttgttccaaatctcatatgcggttctcaaggttgctcactctatcgaactccttttggctcaaagagttgaacaaagcattcatggcttgggcattgagttggaggttgcggtgatcaatctcagtcaagggcgtgccggtgatagcaaagcctacatccacaatacttcaaatatggaagctcatagctttgaggtgagtagacattttaattttccaagtggagtagtttgtgccattgaacatgggagccttccctacatggttcacctcgttcgacatcttctctctaggcggtaaaacccaatcaagagagaccaagctctgataccacttgtaggatcgagatgtcgactagagggggttgaataggcgatttaaaactaaatgacacataatcaaaactaacctaagttgctaggcttggtgagggtcaactctaactaagcaactaggttatgttttgcaaacctagggtgatagtggctcaattatatctctaggaaagtaaatcacactcctatgtcaatgtttagcaatcctagggtgatatgatctcaagtttgtctctagaaatgtaaattgcacaaatgtaaatgcgacaatcaaatgagacaaggagacaagagatttttcaccgaggttcagaaactcgtcggtttcctactccccgttgaggcgagcccaactccaccgctcaaccacgaagccaccgcacgcccccttcgtcaaggggtgggcaaggcgggagccggcccacggagaggactacccaagcctcgatcactaaggtagttcttccttcactccgaaggtggtgaactccaaaccactcataaaccggcgccgggcctcctccacaatcttctcggagaggtcaccgggcaactcctccacaagccgtctaggaggcggcaacctccaagagtaacaagcaatgacccggcgtggagatgatcaatcaagtgccatactagctctacaaatggaagcaatgcacttgactcttggctaattaaccctctaacacactagatggatgaacacaaagctcaagtgggtgtgagagaggtgcaaggggtgtatgcaattgaattgggtgccaagagagtccccttgctgcttgagggggagtatttatactcccaccaaccaaaactagccgttgggggtgaaatcccccaactttgtgctctgccggtctaaccggaggtatgtggctggtcagaccgtgctactctgcgacggctagaaaactagccattgtagtgctgttagagggccccatcggcctggccggtcagactggcgttgagcaggcggtcagaccggcctcggctcggtcagaccgccatcgactcggtctgaccgaataaggctccgtcggctctgtatcggccaccccgagtagcaccatcccgacctccagcgggccggtctgaccgggcatgtgccgccggtcagaccgtccttatgggccgatcagaccaccgttgtgaggccggtcagactggccagggcacaccggtcagaccgccactatgtggccggtttgaccgcccctggtcaggccgagctcagtgaaagcaaaggtgagtatttgtgtgtgtgatgaaaatgtgagcacaagtgaaaatgcaatgacctaatgtggcaatttaatcatctctttgctaggtcattacccctcttaatagtacagcgaaactagaaaataaactagcaaatttgatcgccctacacctcgatcaattctaaattaaagcactagttttaccgtcttctttctctttcctttgcgccgtcaattttaatcgatcgatagtcatccatgcgcacacatgacgtggacctaacttaaaatatcatctcaatagcaatggttagtccacaattagcgcttgtcattaattaccaaaattaacaacgtgggcctagatgcttcacacgagtacttgatgtaaagctctcagaatcctctttccatcggatcaacctcattgtcaaattccatctgagtcatcggcaattgcagaaacaaggggctgcattgtctgtaatgggcctatggacctgtaacttcgtctgggacctcggcccaagtggggcccaagggggggctgcgccccaaacagagggaggacgcccttctgacctcctccatcccttaaatagctagtaaccccttcagggttagttgggttttgtttagatgaaagtttagccattgctacttccttgcagcgcgcgtgtcggctagaccgtccgtctgcttgtattcgaaaccccgaaaccccaacttatcatttgtattcaattcctcttggcaatatcagattgcttttatcttgttcttgcttgtttcttcgatttgcttgcaggaatagggttgatctgcactggcaagatcaacaacccacggagaggtgtatcgatcgctaaggcgcaacgcaacatcttttacggttgtagtcagatcgtcaacgtttctcccaaatcgtagttatctgaactcaccgaaagatcgggccaaactgtagccttgagtgctaagaggacctcagggttcatctcatcaggtggtatcagagctttcttgctcgttgagttttttttatctatccataaccgaaagctcgttgagttttttttatctatccataaccagaaaatagccagacaaaaaaaaaattgtgtcatttacctagccatattgtgccattgcactgttcttttcagtttttgctttgttgaattttgtgttgcatcgtcatgtcatgttgctggtcttagcgtctagttcgtttaaagtttcgagttctggtcacgttttgtaccacagtcgtcgcccccctccccccttgtcggaatcagttcgctgccacggttctatttttgtagtttttagaagtttttgtcggttagttttggagtcgcatcaaggttttgctcgagtttgtggtttgtatgtgaagcgagttgattcggccgcgcttgtgacctgagcgagaggacgaatcagttttggaagtatgcgtttgattggaannnnaaaatagttaggttggttcggctaaaaataagtttcccatttttccccaacaaatccggccgcatccttcctttcctcacccaccaccaccgcgggtccgcaaccaggccgagtccgagtatctcctctatgggttcatctataccgtgatctcccatacaacttggtaaaattttttttggagtatcagattagaattctgtttgcaaaaacggaacctatgggacgagagcattctatttttgtgtatttttaattttgggtttgcacttttacatttaagtccctgtaatttttatatttacatttgagtccctgtaatcttgcatccgggtccttgagttggtttttgaaaaaaaataaaaaagggaaaaaaaggcagaaaggtgaaaaaaaagaaaaaaaaaggcgcaacaaaaaaaaagaaaagaaaacgaaaggaaaaaaagagagaggaaggaagaagaaaaaaaaggaaaaaaagagctcttatctttgattttgttctcttatatcaaagtgatgcttgagtagttctcaaaaaaaaagtgatgcttgagcttattctagtgttatcttgtggtattgtttgtttctaggctcgcgtctctagttcgttctagcctaggaccagcacgatacttgactttgaacgattattcaactttgcattctctgatttaaccatttgccatacttgctacatatttaagcctacccagagctccacagatttgactgcagctatacagattgtgaacatgtgtgccaaagtgtcgatacatccaactccatcgagtgtttggttgagtcggtgtggacaccatattctagtttgcattggtaagaacttgtaagagctcgataaaaagcttgagtgtgtgtgatttgtgagcttccactacctagtagttgataggaacgtatatattcttgtatatgtttcttgtttgctactaactatggcagggttacacaaagagtttggagctgttcgtgctcaatgtggacattttcaccttcgacaacacatggcaagtgaccaacatgacgcaaataaggtacatgatcataatcttgcaagagtagagtctatttttgccatcttttgatggaaagtatgattctgctgcatacgttaattgggagctagcagtagaaaaacaatttgatgagtatgatttttctaatgctcaaatgattaaggctgctagtaataagtgtaccggttctgcatctttttgatggcatactgtgggaaataagcttgaaacttgggatgaatgcaaaatactattgagaaaaagatttgtgttttcatactatagacgtgctctccttgagaaatttcaacatctaaaacaaggtgacaaaactgttagggagtactttcatgattttaaaatttgatgggcatgttaatgtgacatataatcatataggccaattgttcatgcttgcttgcaatgttgagcgcaaaattttggagaacccaacagagcaacaagctatgcttgtgcctcctatcactgatgttttgcaggaagttcagaacagtccccaaaatgagaagaacgatatgtttgagatgtcacttccatcactcgcgaatgaggagaaggctgatgcacctacattatctaaagaggggataaaaggtaaattaaatggtgcagaaattactcaaggtgagtatgtttctgatgaattacacttttccactttccatgctaacctagagcaaactttagtggaacctacttctgaattgcctttgtcacaagttgatttacattatgttccttgtgataaagaagagttgtgcgatagcacttcacttatatccattccacaactagtgaatgaacatgctacttttaatcttgattctccatgtactgaatttaagcatgttattcacacgtccagtgagaatgatgaacttcaattgcaatcttctttaaatacattgggctatattctgtttgatgattcttgtgagctcaattgtttgaaggacaaaatatttgctcattctgatttgccatgtcctcgtaatgttatttttcacatctttggcaaatatagtgatagagaaatttatttggtgcacaaagtttacatttgttcagatatgcaaccctctgttgttgtgccaagaaaatgcaaactggagagtagtgttaggaccactaatgttacttcaagtttgttttgcttttgtccaaagacgcaggttggttctgaagaaggggagcgacgagatcgctcaatgttgctgccatatacagtaaagaatgcgccatatgaagcgttgcgtcaggatatgctatgtgaattacccatgttaaaaccgaggacattttcccgtgaagaaagggaggatgatgtgaccatgcctacacggatacaaccattgatcatgtcatataccc

SEQ ID NO: 70879 - DNA, 6456 bp, Oryza sativa
gggcggatatgatggctggatcgatggcgtggcgatcgcccgcccattagcccccccccctcccaaaaaaaaagtcctctcaaatgctttatctacttaaattatgagctactactaatattaacatgggactgtaatgtaaaataataaaactaatttattttttaccaaaagagaaagggtgtaccgaccagggcagcattggcccacgtttgtctctacaagcccaatgatatagcgaggaggatgacatttgaaccttttttggctttagttgtctattttaaatcataaaaataaagaataaaaacgacatcatcataaagtaaaagtagaagacatcaacatcaggaggcgaatgtaaaaaagatactagtttcggtgtaacttacatacatttattttgcatacttttctgctctttcagttctctctctatctctgtcttttgtcctctccaaataaacaggacctaaagcgacatgagccgtgcaataagcaaaaggagtagattacacatcacgccaccccggatttcccttcgaaaccaaccaaaacctcaccaaattaacttgataaaccggcagaaaaaaatgagaggaataggcatcggctggtcaagtaatgtttaatttgagccaccaaaaggtgcacttcctctctcagcaagagtcccgtgctgtctgatggctcgagaacctaagatcgtgaacctacgtactgcaaagagatgatatgattcgggaccaagttaatatcggttcacattttcatgcactcgggaatagattatcttttgccaccaaaaggtacttagatgacataaaggtaggcacactgattaagcaaaagttccggatcacattacattattgattgcctacgaactttttaagatgaagttattcatgcacagactgtgcatgaataactgtgcagcacagtcctctctcttcactgctcactgccccttaggcaggtaacactcctagtgacagcgagcgcgaaatgtgaatcgcttaaatagcctggaataatcaatggtgcgcccattgttattgctcaattagtcattaggcatatcaccaaccttttcttggatcaaattaagttagagttggttatctttgtctgggttttcttcagtcgttcagtgccgttctagtacaattatcaatcttgtgacgcacggtctgctgcttgattgagatccacatcagggagggctaacttttcctgaatcgctgatcagaagaaaatgaccttttccgcaactaccgccgaccacgggctctgatgatctttcgggtgtcctgtctgaagaaggtgcgcctaacaccctcgagacgacgatcatcgtgttgattatacttcttgaattaaactttgttcggtgacctgtttttgtagccccggtgtttattaataggccttggttactgcggttgttattcagtatattcacgcgcttctaattttactcctctaagcgaactgaaagttggttgattgataacccaagatgaactacaggcctatagaattcagccgtcatgattatgcttgctcatccgcttcttgctttaccacccagcaatggctaatgtcatcattagacgagagctctattagaattatgatcactcgtctgcacggtagagctcacccacgcttgcttgcttgcactgtatatgtggtcacgccccatgtaataatcctagtcacagagtgatatcgtaccatcacgcagacaagaacgtaacagttggcatatgctgctacaaaccaaaaattgcatcggcatctcttgggaagaaaacaagtaccagcactatataatcatcatcatgccagtaccgcatatttaggagcaacttgtatataaaaccagcaggaagcatacatgcagcgcagtagtgcacggtacggagtgctcgtttactcctaccaaccaggcaaccggagccggcagtcacggccttgaagacaaaggggacggggacatccccacggcctgggctaggtgcgcgcggtggcagcagaaaccaatgctgcacccggctcacctacctaccgagtaccgacctggcgattccccgtcccactcgccatcggccgcgtcacagtccaaagtccaaacccgtcgcgcggggcgctcacgccatgcatgcatcagcccaccccgcggctccgcgcgcgcgcggggtggcacgcgatttctcgatggccaccgcgagcaaatcgcggaaaaggtggcgaggcgacgcgccccgggttgggttgggtggggtgggttggtggtgcggtgcagcgggcggcagaggtggggacggacgggcgcccgggtccagccttcactggcgagcggtgaatggggtggggtggacaccgagccggttaataattttcgcgccatccgcccgaccacggtggacgcgagcaggaggggtgatgccgttgtggtggtggatgagatcggagcaccggcacggcgcgggaagcgacggcagcgaggcgaggagagcggtgcaagcaacacgggcagcggctccgaggatggggggcggccccgccatgtggcgtccgggaggggtctccacatcagttggctctgctctctgccctgcctcggtctgcaggttacagcgagaggcccaccgggagaggacccacggctcctcgcgctttttccctccttctggagccaaaaaaccccaaaagggaggcacatccctagctccccaagggccacagaccttaacacggcgtacatgttatattagggggcaaaacatgcataccagccctcggttatcctattctgcccgtggaaaaaaaaaacaaaaatggttatgtatattagctcctcggtttgccctattccgcttgtagagaaaaaagagagagagaaggtaaggcgacttaaattggtgtggcagataatattatcacgtcatgaactattggtaaagacacatattagctccttggttatctatttcgctcgcagagacaaggaaaggttcatccaaaacttgccgaaacaagaagttattgtcaagttagattggtgtgaccgggcaatattgtcatgccatgaatcccactctttatatattctgatcatagaaaaaaggagggttcatccaaaacttattgaaatgacaagttataatggtgtggcagaacaatattatcacgccatcagtagtcagagatgcatatcagcccattgatttgcctattctatgagtagaaaaaaaaggaagatacatccaaaacttactaaatgacaagttagaatggcatggcaagacaatattaccacaccatgagccgttggtgtgataacattatctgccacgttaaaatttttgtcatgccatcactttttactggtgtgacaatattgtcattgcacactagtttaagttgcgtggaaaaatgttcaaatttcataagcttttagggctttatttttaaattttaaaagattaaaaaacaatcttaaaaaatcaaggattcacattaatttgccacagccagttcagtttttgcaggagaaagttatttttccccgttctaaacagacctaaattgcaccctagtaagaagtaagaatttctaagtaccatgttgaacataaagaagtactagtactatagtactactacaatggttaagttcattatagcatgtgtttcaaaactccgaaatccaaatacattagtcgtcaacaattcgatttgagcaacttgtgtccttttaaacacaagcaacggttgtcataggttctgatctcttccacggttggacctaagatctaccgcttgatatagacgcagtttataattcaagattccattatgacctatacgtgtcaacgagacatcgactctcctctggtttttttttttttttttttttttttgagaacacgagacatcgactggactgtttgtatttggaaagaagaaaatctcgaagccgtaaaatgtaatatcagagttactggagggtctgagcgcaatcaacggaaagtttttgtgcgcatatgcttttctcttctctctctctctctttcttctgacttcttttgtgcttcttccaagcttccttccagtcctcgctctcgtcctccctccgtcactcgcagcgcagaccaaggaaggcttctcgcctctcgccttcgcctcgcttcgcttccaagtcccaatgccgacgcaacagcttacctcacgcggcgcgccacgcgcttgagaggggccgccaaccgcatggcggcgccgggcctggacgaggtcatggcgttcctcaccgaccacgggttcgcgggcgccgcctccgcgctccgcgacgacgtcctcgcccgcgccgcgtccgccgccggggacgccggctccgattccgatgccgcattagatccccagctcccgcccctccggttgccggcgtccacgtccggaggcggtggggcgccggcggcgccgcctgcaagccctggctccagctctgactcggcgtcgtcctctgccttcgtcagcatgcgctcctcgccctcaggtagttaggggatcagggcacaaggctgaatttttttttttcatcatctctcagcgttaaacccatatcttctcgttttccgaggtcgtcagttatgtcgcgcgaaatctcgatctgtgcgccgatgtttttggcggctatggttggctttgggtccaattcgaacctgctggatcaaagccagcatatctctgtgcatatgttcatggaggaaaattgtgatcttttgatctagtagggtgctggttaaaccccttcccctgggttttgtacaccaatgatactgcttgtcgttaaattctgatttctcagtatattctttttccaagaaggttggctttacgacgaccatctcttccatagcaagtcggagctggacgacgacaatggagaagacaaagaggaggacaagtttgttcttggtgtccacgatggctcagggaggatagagatgggagtgcttagtgccggtgatgaccaccgtcatgaacatgttggcaatgacggctgtgagggatgtgctgaggtgtacacatgttcatcaccgctctgcggatgctgtggtgagggactgaagaacggggggctagaggtggtgaaggattctagctccactgtctatgggaggtaccagatcattgatgacagacagagatacttgatgagtgtggcatggatgggtttcagttgaagcaccctgcggatgttgtgcttgagtgtcatttgccaagagattctggggaaggagatgagcgatcggagctgagtgtagtggagaaggagcttcaaatgctcagttcatttggtactagggttgatgcagatgcttttacaagtaagtacttctgaaatcttaaactttctgcttgatttcacccttcaatattagtactccactaaatacagtatttgtactaattttcaacattaaccctctttgctccgatgaagatattatgaatttatttattgaagtgggagaacagggttgaattacagcattaaagagtttggatactgttaggcaccgtttggatgccagaattgaattgtgtagttatcccaaaaaaaaaaagaattgaattgtgtttgtggaaatggtggtccaattcaaatttcaactataattggtgttgggatccaattcaacttgaattgtgtatgagtggtgcagacaatgctgaatgagagatgttttgttactgttgtaaactgaaatttgctgttaaatatgcacagagctaaaaaaaaatggtgcattttagtggtaacctcttccagaaacattactgctgttatacgattatgcttcacatgggttttctctgtatattagaagaattgaaaattttcttctgctcttcaatataatatgtaacttggttttggtaacactacagaaatgaaatgaatctggatttaaaaatgcacatttgaggagacattttttaacaaagaaaggccaaacctattttattatcagtcttgctgaactgttgtttgtttaccaacgtttgtgtgaatttgcaatttaattccagtcatcttcttatcctgtataaagatcatttgctgcttgcttcattaggtttactgtaaatgtttgttgtctttaggtcctggacttgtacacgatatcacagacaatgccaaactggatgatagcattgaaaagaatatgaaaaacagtagcgacaaatatctgaaggaaggttatagcatagagcctttccctgagagttctgttgatgatacctttgagtttggagatattggaccattgaatactgatgcgcaaaactcaactgctgctaaagctgaggaagaaaatccagagacaaatgttgatctcgctctcgctaatttccatcgagaatatgaggtatttgaact

SEQ ID NO: 70880 - DNA, 677 bp, Oryza sativa
aagtttaaaggatcatacctgaagcagcagcagcagcaactatagatattcaacagaatcaaagaataagcaaatctgtgccaaaaagaaggcatagaataggaaaaaagaaaatcagagtgaaaaatgcaaagaataaaaggcaaatatgagcagaaacaagcttattaattatgtaatcgccaaaggttggtgtatgcgagtatacaacctcgggtctccagatcggctcattgattttaccatagcttcatttttcattactcctaaccccagcagaagcatccttataatattaatccctggtgctactgcagccaggaaaggagcatagcttcctgagctgtataaagcatcaatatgtgagtaccaatatggtgatttatgttgaccagagaaaattagattttcttacctgaaaagaggccaaaagagcaagaataccataccgatagttatatgcacaagttttctattgagtttctgcaggcaaacaaatggaatttatcaatagaaagcatcatcgtattgaagcaaatctcaataagaaaaactactgttaatttgtcagctaattgcatggttcagtttatatgtctatgttatgttgagaacctagctgaatttcatctggtgtcaatgagataatgccagccatcagacatccatctgaaatt

SEQ ID NO: 70881 - DNA, 2652 bp, Oryza sativa
gtacttggcgctgtctccaatactgcatcgtatcttcggctttgggcattaaggtttgctttttattttgttatattgcatactttcatatctgtaggtgctcttcataaatttcatgtctttctttcgtcttatattagtttggcgcattctgagctatcaacagtcttctatgagaaactgctggtacttgcttgggggtaagtattggtttggtctttcagatttcaaccaacttcacttttaatttgtatagcaatgtttttttattcttacgagtgtcttggaatgcatcttttcgtctaatcatggatacctcatgaatatatggtatctaaagactcaaaagtggatagttgcttacttggggtatttatcatattgttcacaggtatgacaatcttgttgtgaagttagtggggcttgtaattttttcttttgctactgcctttatattgctggggatggaatcattgagcgccttccttcatgcacttcgtctacactgggttgagtttatgaacaagttctaccatggggatggctataaattcagacccttttcattcgctctgctagctgatgacgaagactgatgcatacaaaattcagcagataaagagattaagcttgtttcttgccatttttggagcacgtgagtggaattctttcgaccaagatgggtttccccaatacacagcattttgtcagaccgccgggcttcttccgaacgcatgtgtgcagtcctggttgagattgccagcgtggtgggaggagattttgtaagttcacggcaatactgtagagggcaggtttctcgtacagttcctccagtggagaagcagattatagatgctaacaacaaagatagaaatgtagatttgctatgtctacttttagctcttatactttgtccaagtgactgtcccagtatcccttaccacttgaaaatggaagttgcagtcgttttttttaatcattacgtgattaggttgtaacgaagggtgacaattattgaactacaatgtttgtcaattcaaataagaaaagctaaagcatatatggtttcccaagatgttacaaatattgatgaacaatatttatcaatcaatatataatttcgttatctcaactaattgataatactataagctcacgggaattcgccactgtcatcgcttgattgtcttggggcttcctggatgagagaatctacttttgccattgatttagtccaattcaacaatttgctgtttgtattgtcccttgtataatataacgccgagttatcaattgttttgcaatatgttattttgtcagttttttttcccaaaatacacatcaggttaacagttgatttgtcccatcagaagtttaaaaactatgttctttatatagcctctttaaaaaatatgaaattttgtgcatacttttcaagatttttttgcatttatccgttatatactatatagaatacatttttgcgttattttttttaatttaaaacatcttttatatcatacacaaattgtgtcattatcttttgtgtgagtaaattctcttatacgcaaaaattaacttttttttaaaaaaaatgacaataaaaaaaattaaaacttatatgcatgcttcatggttgtgtaagaaggctaaaagtcacttttttaaaaaaataatgggataaaataattgataatcttgttttctataagagtattttgggtatgtttttaaaaaatatacagtctaatgatatattgagaatgatgataaatcgataaattatagaaatagataatattaatagcaaattattaagatgatacaagattttttttagcttatacgatgggtgaagaaaaaaaaggacaaagatagtataccatgtatacttcttatgttaaacatgattctagaaaagtatttatatggtgaaaacagcaatgggaatctagaaagtgagacatggttgttaatactcaaatttagcatctacgtaaaaataggaaaaatatgaatgaatttggaaaggattggtttggtgtgcgatgtcgtctgatcgttgccatagggctggtcaaaccgatggtgtggggctggtctgaccagcggcatttggccggtcagaccgtttgagtccgaccccgactctaatttatcggttctagggtattctttctcgagctgagatttttcgagtactaattggtttatatacctagtaggatttggagagtcctatggaaggtaagaccaattgtctttataagagctatggttggttccattaagacaaacaatttactacaacacaattggctaattgaatcattctttcaatatcgtatctactttttgcctaatttcatctatgttcgtcgtcacgctgtaagccgtccgtcttcaccgcaagagtgcgggtcctctttgtagatatgtcatgaaaaccttccattccgctcatgagacgagtgtttatcctttttgtctaaattagctccactagtcggttttaatcttctaaacacatattgaccaggaggtttcttctagaggtgattagtgactctatatcaccgtaaagctttaggttgataccgatcatgtaggcggcatgaccaaaaactacgccaacaatggtaaccactaagt

SEQ ID NO: 70882 - DNA, 7140 bp, Oryza sativa
ttcacaaatcgaagcgacacgagatcgagtttgaacacccttactaatgtcacccaacacttggtcaattgggtgatccttggaaagagcggtgtgtattcttggaggcataggtggatcttgtgccttctcctcctccacttcaacttgagcttgacttggcgaagcggaagtagatggctcatcttgagtggaggtggatggcttgtcttccacttcaatagacttgacatctctaatagacatgttcttcatagctctcatcaagccttcatcacctacaacatccaaattctcgtgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaacaccatttcggtaaatataacacttgcaaccaaaaactcgaaaataggcgacatttggcttcctcccaacaattagctcatagaaagtctttttcaagagacgatgcaaataaagtctattggttgcatggcaagcggtgtttatggcttccgcccaaaaagaatcggaaacaccatattcatctagcatagttcttgccatctcaatcaatgtacgatttttcctttccactacaccattttgttgaggtgagtaggtagcggaaagttcgtgtttgatatgaagatcatcacaatagtcctcgatattggtattcttaaattcggaaccattgtcacttctaattttcacaagagtgcaactaaattcattttgggccctttttgcaaactttttgaaaaactcggcaacaatagacttatcatgcaaaaagaacacccaagtatagcgagaataatcatcaacaatcacaagacaatgactattaccaccaatgctcttataggttgttgggccaaacaaattcatatgcaagagctccaatggtctagatgtggacatgatactcttagtagaatgagaacctgcaacttgcttgccggcttgacaagcactacaaagcttatctttctcaaacttcagatctttcaagcccacaactagatcacgttttgaaagtttgctcaattgattcatgccaacatgagctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggctagaaacaataacttcttgtgggaagaaggcacatgacaagccaagatcacaaatttgagcaaccgaaagcaaattaaaatttagagatttaacaagagagacattttcatttgacaaatcattggagataacaattttacctaacccaattacctttcctttgctattgtctccaaatgtcactttctcttgttcattctctcctacttcaaatgtggtgaacatagccctatcaccggtcatgtgttgagtgtatccactatcaagcacccaatggctcccaccggtgcggtagttcacctacaaaagaagatcaagctcttttaggtacccaaacttgtttgggtccttggaggttagagaccaaagctttgggcacccaaatggcattctttttaccaccgagtataggggaacccacatatctagcaacaatactaccatcataagccttcctaagcatataatgagaatcgaacatgcatgtcttaggaggcttaccaccggggcaatcactcaccaaatgcccaacctcacaacacttggagcaatacttaccattgctcttgacaaaacgagtggcatggtgagaaggtttcttacccttctttggagtgaatccaagtccctccttgttaaggatgcaccgttgctcactcaaaatcttgtcaagagtgttcttacccttgaagcatctctccaaactcttgttgagcttagccacttgctccttaagctcattgttctcaacaataagtgaggcatcacaaatagaaacacaagagctagagctagagctagggctaggcatatccataagatcatcccaagaggtagaaatgctagatgatgcaatatgagcaatatggcaagtagcactatcatcaagcaaatcacaagatatgccaacatcaatgtgagctccatgttgagtagtggaaaggaggttgtcatgagcttccttaagcttctcatgagaaatggtgagtctctcatgagaggtctttaactcctcatacaagacctccaaagaaacatgatccttctttagggccttgaacttgacaatctccttctcactataagcatggagctcctcaaacatactcacaagctcatcataggaaacatcatcacaatcatcatcactctcactatcactaagggatgttaccttagaggagccctttgccatgagacaaagtggagcgaagagtgatggagcctccttgatgggaacaacggccatcttcttcttcttggagcttgcatcatcaccaccttcttcctcggacccggatgagacggagctctcctcatttgagtcccattccccgatgaaagcctcaatcttcttcccttccttcttaagcttcttcatgagcttgtagcctccagtcttcttcttggatgacttgtctccatcatcatccttggaagggcacttggaagcaaagtgtcccttctcaccacactcaaaacacctcaagttggagagagtcttgttgggtcttctatttcttctcctatttgagttggagccccttcctctctcctttctccttcccaagagatcattgaactttctagcaagaaggatcatctcttcctacaagtcctcattgacttcattcaccttgctcttgctcttgtcttcaactttggcttggagagcaacgcacttcttggagggtgaggcttcctccatctccttcttcaacttgtacatgtcattggtgttgatcttccccaagaggcttgcgggtgtcattcttgacatgtcggagttgatgagcatggtgacaagggtctcatacttctccggtagggctctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtaccctcatggatctccgccaacttgttccaaatctcatatgcggtctcaaggttgctcactctatcgaactcctcttggctcaaagagttgaacaaggcattcatggcttgggcattgagttggaggttacggtgatcactctccgtcaagggtgtgccggtgatatcaaagcctacatccacaatactccaaatatggaagctcatagctttgaggtgagtagacattttaattttccaagtggagtagtttgtgccattaaacatggaagccttccctacatggttcacctcgttcgacatcttctctctaggcggtgaagcccaatcaagagagaccaagctctgataccacttgcaggatcgagatgtcgactagaggggggctgaataggcgatttaaagaataaataacacctaatcaaatctaacctaagttgctaggcttggtgagggtgaactctaactaagcaactaatttatgttttgcaaacctagggtgatagtggctcaattatatctctaggaaagtaaattgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaagcctcgatcactcggggtagttcttacttcactccgaaggtggtgaactccaaaccactcacaaaccggcgccgggcctcctccacaatcttctcggagaggtcaccgggcaactcctccacaagccgtctaggagacggcaacctccaggagtaacaagcaatgacccggtgtggagatgatcaagtgccacactagctctacaatggaagcaaatgcacttgactcttggctaaacaaccctctaacacactagatggatgaacacaaagctcaagtgagtgtgagaaaggtgcaaggagtgtatgcaattgaattgggtgccaagagagcccccttgctgctggtggggaagtatttatactcccacccaccaaaactagccgttgggggcgaaatcccccaactctgtgctctgccggtctgaccggaggtatgtggccggtcagaccgtgctactctgcaacggctagaaaactagctgttgtagccctgtcagagggccccatctgcctggccggtcagaccggcatggggtggccggtcagaccggcctcggctcggtctgaccaaatatggctccgtcggctctgtatcggccatcccgagcagcaccatcccggcctccagggggccggtctgaccgcgcaaatgccgccggtcagaccggccttatgctccggtcagaccgccttcttgcggccggtcagaccggccagggcacgccggtcagaccgccactatgtggccggtctgaccgcccctggtcaggccgaacccagtgaatttgcaagtgaatgtgtgtgtgatgaaaaagagagcacaaatgaaaatgcaatgacctaatgtggcaattgtaatcatctctttgctaggtcattacccctcttaatagtacggcgaaactaaaaataaactagcaaatttgatcgccctacaccacgatcaattctaaattaaagcgctagttttaccgtcttctttccctttgctttgcgccgtcaattttaatccatcgataatcatccatgcgcacatatgatgtggacctaacttaaaatgtatagctcaaagacaacggttagtccacaattagcgcttgtcattaattaccaaaattaacaccgggagcctagatgcttcacggcgacgcggcgggcggtgcggcggtggctggcgaggcaacgggccgttcgtcttctttcttttttttttgttgagaatctgtgattcgtgtcacaccctaatctgataccgccgtacaacggcacctgacaggagcgtgtcgtagggaaaacaacgtgaaccgcttcctacgaaaccgcgatctcggtaccagtcccaggacatagtgctggtacccacggtgactcccagagtccagctgcccagcagcacaacaatctgcttccactcgggaagcctaatctatgatgcccgcagacatcccgaatcacacagattcgtttctgaccactcagatcgtccatctgccacataggctgattctggttacgattcccacaccacaacaacttttcacaaagcacaggcaaacaaatctacgcaacgggaaccacctcacatccacccatgaccgtgggcacggctgttcgaacagttagttaacctctgcagagggggtacactttacccacacgacacgaacttactccagacactggccggtgtcagaggttcgcgacaaagcctttcccaagccgacccagggatacctcatgccacatagaaggatcaaatcctcacataaacataggccattttaggcgttcacaattcaaactccaaccacctcgatcggtaattcagcaagcttctcgttcttgcattaccaggaacccggtttggctccaaccgaccccgccccggcgttcccaactattggcatgcgaggttttcctgaaccgactagttacttagccagggtgtcccatttcaccttgtggttgcactttgattatgttcgatgagtttcccacaggaatcggtccttatatgcgaatacgggacagtgccacataggcacaacccccgcatcgcgagttttcaaaattcattttgttttcaaacacaccgacaccacatgtcgggttttgaaggcttcacaaacctatttcccatgttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaataaaataataatgacttttcaattataggggcaattgatcaaagggtgacttgccttgctcaaggtcttcacgaagcttcacgaatcttcgggaaaacccgcgatcgacgaaaaaccgataaccgcaactatacgcaacaatcgaaaacctaaacaagagaccaaaagaaagatcctatttagactaattagtagtgccattaaatagatctcaattttatgaaaatactggaagtggaacggagtcaatcggagttgcgaattgggtgatatgaatttttagaagtttaattggagtttctggaataggagaaatggtttatgaaatttataatattctcaagaatattattgacagtcattgtcacgcgggaccaaaggaaatggtttatgggattttggaataaggaattgatttatgggacaaaggaaaaatgatttattaaatccctgaaaaagaaaaggatggagggatgttaattggacttgggccgagcgaagggacgcggcccgaagagatgcgcgggcgcggccgaggcgagcgggccggcgcgcgggagggaggcggcccaaggccgaacgaggcgcggcccacgcgacgcaagccggtggacgcggtccaccgtgccgggcgcaaggtgggacccacaaggcggcgacacggctcacgcgagcggggtgcacgcaaggcggcgcgttggatcggtggaccgggagacctttgaccggtctccgcggggccaggcgg

SEQ ID NO: 70883 - DNA, 20212 bp, Oryza sativa
  unsure (1)..(20212): unsure at all n locations
cacaagtttttggattaatttgaataaagttagaaaatcaaagtaaaaggtaagtaaataaagtaaaccaagcttgcaagatacgttgaaacagttggaaacaagatcacaaattttgcacttttgaacaacaggttccaaaagaaataaaagaaagttataaaatcaacatgcgaaatttattttattgcagcaaaataaaacaatgttataaacatttgctagtaaatgagccattagtacagtaatagatgtatagtactaacaacactggaataaattttgaatgagaaccactaaaagagattatgaagtgcatgtgccattagtttggtttaattaaaagagaaagggaggagaacagttctactttttcaatatttttagagggcttctatgggtgaccatttggcataacctagggtcaaggaggctctgataccaacttgtcacgcccggaatttctatccaaaattccaaacgcttacatgtgtgtgaaccctcgtccagaaatcagccgaggcacacaataacaaattgataatagagtataattattactctaattaataagcgaataaaatgtcattacagaggtagatagttcctctcaatcaataaagatctaagcagcggaaaaaaaagataaacggcgcagacgactccactccacaggcagcttgaccagggctacacctaatcctccacaccatcagcatcactgtagaactcctcctctgatgaatgattgcaaggtgagtatatgagatactcagcaagccacgcagcaaatatgcaagtgcacaggataacaaaggatggcatagtagggtttcatttgcataaacagcatttaatgaacatttcagaatttaataaaatagttaagtaataattaaacaatattaatccaacgctatacaacataccttgttgcataggcccaaccattctgaacaaccatcccggctgcacagttctatctccaaaccaggaatatgccattccaaaccaggagctaatcaaattattaccagttatagcatcttttattatgatgagaagtgtgagactaatcacgaaagacattgttagacccgcccataaccgcgggcacggctattcgaatagttttactctggccagaggtgtaccactgtacccacaagacacagccccacaacatgtcaccatgtgccttcataccaccacggtacctcggaaaggagctgtgacagtaccccttgcacaacacaatccaccacagcgcacctttcctggatcataatcacccccttataaacaaggcatggactccccagcgacccccgtgggcttatcttcgccacttctcagtctggtgctccgcaatgaaccatgctatacaaaaggtaaagccgttgcccacgctggcttgtggttggcacggttaatgtttcacaaccgaaactcgtgaaccggtccttaattgttatgagcacgactcccaaaaccatgtgctcacaacccaccattatcaagttttagttggcaagtaattaattcaccaatcacgattgaccatcgtgagctatcattaagccatcattaagtaatagtgaatcataagtaatcccaatagtgtgctaatgtttctaagcatggctaagcaatcatatctaatatcttgctgaaccaatatataaagcccaactagccaagttataataacccaaggtatctgtgtgacttgccttgctagccttggaactcttcaaattcttctcctgcgaaaacggactctccggaaacgtcggaatctaaacagaaaggagcaaaacaccaaaacagcacataaacaagcatgaacagtacatgtggatatttttaacatgtagatctcaattttagaaatatttagagacttgaaccaactaaatccaagctaagatgaattagttatgaatttttaaagattaaatcggattaaaacacttatatgggtattaattgaattatgacgcaataatgaattatttttgaaaaggaaaagggaattattgcatcagcggctagggttcgcggtgaaccgggtgcacggcggcggctgacgaaaacgaacagccgagatctttccatccaaaacgaacggccgagatcgaccgatccacagccggaccacggaagacgacgacgatgacgtcaccaccggcggtggctcgggcgcgcaaactcgccagcgaacgacggcgcgacgacgcgaacggaggacaccaacacgtagagggcgatgcggcgaactcaccggtgaccaaaacaacggcggaagatcaacggacggcgacggcgtcgaggaagaaacggcggcaaccttcggcttgacgacgacggcggtgctccggcgacctacggcgatggcggaggggtggacgagatcggcgacggcttggtgaccacgacggcgacctccccgagcaacgacgacgaccggaccgacggcggcgcacggctgaagctgcggcggcgacggcggcgctaggctacactatgctagggctctaccggcgacgagaggcgaaggcgagggtggcggcgggtagcggcaggcttgggggtccttttataggagcaaggaggcggcggcgaaggcccacggcgaccggcgacacgaaggaaagtctagggttcggaggagagagatcgatctgactcgaactcgaatccacggatttccaaacgattttagccgacgattccaaaagagaaaaggtagaggagatcccgaagatcatttcccctctattgatttcaccggagaaggaaaggcgcgagcgaatttggaaggagacggcggcgcggctcggctagggttcgggcggcggcagcgacgcgaggaagacgaagactgacaggtgggccccacctgtcagcgggcggacgcgcgcgcgagcggctgctgccgaactaggccgactgggccgagagagagagagagagggttttgggccgactttcggcccaaagccacaagaagacttttaaaatcctttttcaatttaaattattcatgaaatgcaatcccatttattaaaaatacttccttagctcgaataaatcccaaaaaaatctaggaattatagaattaagcaaagtatttaatgaaattttatctggccccattttatattggaatttattaattaaaattagatcttctcttctaggctttttaaaataaattctaataattccaattaaacaacaatttatatatttaggatttttagggtgtgacagccacctgctacattgctgacttcaaacggccgccaaatctgcatacgacctccgtttttggcccatgagtatttgatggaaacctctcggagtcctctttccatcggatttggcctcaccaccaaattccatccaagtcatccgcagatgaaaaaacaaggtactacgtcacctgtcatgggcctatgggcttgtaactttgtttggaaccccggcccaagtggggcccatgtggggtgcgccccaaccaggtggaggacgacctagggtcctcccacctccttaaatagttaggtaccccttgagggtttctcgggttttgttagattaaagtttagcctttgttacttgcttgcagcgcgcgtgtcggctagaccatccgtctgcttgttcttcggaaccccaacttatcttgtgtattcattcctatttgcaatatcagattgcttttatcttgttcttgcttgtttctttgatttgcttgcaggaatagggttgatttgcaccggcgagatcaacaacccatggagaggtgtatcgatcgctaaggcgcaacacaacaacgtcttgtacggttgtagtcgggtcgtcaacgtttctcccaaatcatagttatctcaactcaccgaaagatcgggccaaacaacagtcttgagtgtcgagtggaactcagggttcatcagatgacctgatatgctatttggtgccttttaagaacaagtgcagcttcttctctaggaagaagaatgatgagtatgtgccacagtgccagttaatttacttccaatcatccttttttttaaaaaaaaaataaacgtggcataatcattagtgctaaggcacgctttatgttggctgacaagcttacaactatatgatatctatgtgcaaatgtgtgatatgtaaatcgacttataaaagccgacagaaattgataagattgccctgcagccactgttaccatgcggattgcataactcgctggcttaagatcaacaaggtaaattatacttctttatatttgatgttgtacctccaaaatgcaaaagaagtttctgtattctgtgtatagatactaaatgcatatatgcgaacaagagtacctgtaacgtctgaatattactcaagaaattcgatacatagaatgtgatacattgtctgaactttgtctgacgggctgaatgttgattgctttgtatacaaacttgtcttgtctggtataggaagattatccttctggatctgattttatgtttcttttctttcaggcatgcccagtctgcaatgaggaggtatttgggtgaatcacaaatccaaaaattctaaataggcctaacatgtccatcgaatggaatatcggagtatttttctcatgaatttcataaggtatgttgtatccctctttggttcaaattcattcaatattatatttcagtgagtagtgacgaagtaacaatgaaacaaagttctaagaacttaggaatctgtttgtgccaagaaaactttttagccttgtagccaaattattttgtcatgcacacataattgcctacattttctcttaaatgccacttttcatgaataaggacatgattttaaaggtagattactctgttggttgtacaatttattctattaattgctaaaagaaaaaaaagactatgctgctatatttcccttgaaaatattgttgtagtgggattctcctacacttctaagcatacatcatgaaaagagagatagtgccaagtgagcaatgagttctttttaggagaaattagcaagttaatctgttctctaactttacaatgcaataatgcagatggcagatgttgaactctttatgttatatttcaggtagagaagaaaaatgttgtcctgaaattagaaagcgatagattgattatgtttgaccattctactcatttagccaagcttctattaccttttgttacagctgtcgaaaggggcttgcttaagaagcaatattaaccatgatggcatttgcaatagagagaaatttggaattcacactttcagagcaaaaattattctcctgtgacctctcacctatcacaagaaccccaaccactggatgaagcgggcatagtacatgtatatgcaatagtagcacccattaagaataggtatgttccagtgtctctcgtgttgctttattgtgtcgttaactccatcttggtaaatgataatctctgctactgttgatgttttgcactaaaattttctctttcatgtcaatttccattacagtaatactcattgtcatctagacacaccaattgatagatatctaggatggggattaaataggcctaacaaaaaaatacagcttgacatttaccactcaaaatttactccaaaccaaataatatagaacaacagtgtgcatgaagtactacattgcatcatgtaaatgacaaaccagcaaatgaaatgtttatcataatgttggtgagtagaaatgtgtcatggtacttgcattgttgaccaaaatgtgtagttgatatgtgcctgcatcatacagataataatatgacctctgaaacagaaggatagaaccctcttgcacataggaattgttatatcaagatggacccttttttggcggggaaagatggaccttattaactgatatgagtaaagtaagctactgaaacacatgaatatagcaaaatcacaactccaacaatctaaaaccgatttggactggaaagaaagaatgaaataacggtacaaaattcaatttccacgagaaagagaatatgaaacattaatttatttacatgatcaagctgaggcagggctatctctattctctatgatcagtcgcccaccactgttgttattggcaataaacagaaatatgtggttgtgcacaactcacagtgctgccctctccctgatgaagctacaaaccattaatttcccataaaatgcatatactacacatgccttcgttgaaaatgtacataacattcatagaaaataagacaacataaataacaccaggccaaaaagatacaattagcaaactaaattcgtgttcacttttatagttacttgttttattgtatagctacataaagaataaatcaattatttacaaattgcaacttgtatgagcgaaccacttatgcatgttaacagaattgcatgtataaagtattaaaaactgcctgataaaatgagaattagtgaataattaatttgccctcgtaagaaccacttatgcatatagcaaaccatattcaattatctcagggtcaaaaacacattttctgaatgcttttaatttttgttcagtgtactatgagctgagtaatgtagtagtagtttaggttttaagattgttgcatttctcaaggatcaattggatttgcttgattggattcccgtaagtacaattgatcagactagatatgcaaaattgataagagggaaattcatctaaaccttttgtaaaccttttggcgtgggaactgggaactaacttattcttttaggtagatactgcttttttagccaggattcaaatctggctaagaaacatggttggtgataggttacaaacatgttgtgtcagaggcatgttgtgcgtgttatgttaatcagtactagcttcttacatgcatttcagtgttcagttgagtgtttagttgcagagaacactctatttggttcaaattaaatagaatgttacagtgtctgtccagtagtaaaaatacattcctgttttttcaaggagaaagtaaaagaacttttaatcatgctcagagaccgagggatagtcatgcacaaaaattagttttagttagaactatgtgattccagacttaccatattcatgcatgacttttaagagattgtagctgtttgcataagatatttgtgatgcttctggatgaatttcataattgctccttatatgaaaacaatgatttacaaccagtggagcaaactactcaggagaaactaactagctaggggatgaaaacaatgatttacaaccagtggagcaaactactcaagagaaactaactaggggatgtccttcgcaggttattcaaaaagctatctgtggaaattgtactaatattttgctgaccataggggatattcttcgcaagctattcaagaagctatctgtggaaaatatactaatattttgctgacaagtagccattttacttagtgtttggtcagagatactagctatcccagcccacatccctaaaggacatcactacaaagtataaatttgttggaaacttggaaatggtaggttcataaccaacagcattctgcttgtaggtttagcgtcagtacttgggattttgcatttatatgcttttcctcaataggtttagcataatttagtgatccttcttgtgtacctcaccttttatattagatgaaatgcacatattttttattagtgtctatcattcaaccgtgtaaacaacagataataaaaattatgtacaggcggcgcgccattggcgcgccccagcatctagtaagattaaaagatggaggaatttttttgaagttgtcgtttgtgtaagctaatggataaagggaggaatatggattagacttttgtaggattagactttgttgacttaggcttggaatgaccaatgggtacaagaaggccccaaagcttgcgctccaatttgtgcctttcagtgcttctcaaagatcaagatctaagcgctgaaaatgccatcatcagcccatcacatttatctctcaacagtttgtgaacgcagctcagcatgtttacagttcaatttgacggtgtgttacggtttgacattttagtaggttttcaactttggactctgcctaagtattgcgtgccaaaagctctgctgtggaaatagattgcagtagaggcttaatctatgtgatggtgatgcatgggccaaaatatcatattgcgagagaggcaatccattttgtcacaagagtctctctcaaaaggtccaggttgtccacaagattacatttgacatgaatttatatcagcgataaattttagtggagaagaaatgcagagcatgtatgaagcctacattctgccgatcgaattctataacaggagaatttattactaaataacaaccttatttagatagatacttcaacagatttattgaagaggaggccaagtcttggatcgatggtccaatatattcgttgacagtcagcttagatgccactcccaagtagagccatcaggaaactcttgtagtcaccagatgtatcgttgccgatggctttctccagggcaaccgaggccctcttctggaacgcgtccttgatgcccttgaggtccttctccgcgtgcagcacgatcacacgggtcaggctgtcctcgttagtccctgacttgtgcatcgcgttccttagcacctgcatgcatgcgtacatacgtgcacaatttgcagacgcgaaattcagttcagcttcagtttatctatctcgatgcttcgctactactccagctagctagctcatcctcaccttcacgaagtacttgttcgcatcagagatgcaccttaacgcggttcgcagcgcgtgcgagtagcctgttggatcagctccatgctgcagtgcctggtgatcaaaacgcggagcatgcagctgcgttaaccatcaggcatattatatatttggacagaggaagctcaagtaaaccttggtgatactagtgccgcgctcatctctgaaccagctgaatgtggcgttgagctgcgctctgcttcttgtaccgactatccgaatgagttcgccgtgatctgtgtcaccattcgttacagtctcatggagaatctttgcctccgatttagccaatgcatcgttcacctcgtccccgtcgtacctgtaggtgctcactagagcaagcagaagctgaagcagacgaggatacgtagtagattaattagctcgaagcaacagggacgatgaaacacataacagagatattctgtactagcgagagtacgcacactgcgaagatttccagtggcgcgagcggccacgtcttcttctagggagcacttgtagaggacatggtaggttcgttttaccgctagaagctccgaggacgagttcgtgcacgcgatctcaacgatgacagcgtagtcctcgtggatgcatttcgtcgcggtgttcaccatcacggcctgcctctcaacagggtcaagtacccagtggtacatcgctctctgcagttaaatatagttagaagggggaaagaagaatcacatacttaactagctttggtttaactaatttgagttcttgtggtgtgtttatgaagatttgcagcactcttacctccaaatcaccagaaagttcagactgaagacgctggatgaggttttcgttgtagttctcttcataggtcagtctgatctgcttcctctgagttgcgtcccggtgagctaatacgcctattactgcctgctcatcagtgccccagcctgcaccataaaaatagttcactggatcaacaaagtttttccgatggaacaatgcaaagagaaaacagtgctagtgttgaataacttttcgtttctggaaggctggaactaataacttgttcagtctttacaatcgagacaaaaagggcatttaattttttgccatttttaagatgtggcagttaagaatttatcactcgttgtctataacatatgggttctcgtgtatctacgacatgtgggcacaatttgaagacccttttatatgcaaataatgaacttttgtcaccaaatatttgaacctagttttccagtaaatttcagtcacatttgtacccgtttgattttataacctatggtggtagataatccatgttttctgcacaaacttattgagcaatttgaacgggtttgggcttctgtttgttaccccccgatttgtggacttctgcgctagctatgtcggccttattttgtagctttctggtatggtcttccatcttaataagtgggcttcattcgacttaagaaattttacgtgtttttggaaggaataccaagcctgaacaaaacaaaataagtaccttcacgaaaacacactaggccatacacatgaggaaaaccaggtgatttctgtgctttgttgtggaaatcgctaagtactattttcgttttaagttagacgttttgactttggtcaaagtcaaactgtttcaagtttgactaaatttataaataaatatagtaatatttatattactaaactagtttcatcaaatcaataattgaatacattttcataaaaaaattgtcttgggttgaaaatgttactatttttttctaaaaacttggtgaaacctaaagcagtttgacttcaaaatgttttataacctgaaatggagggagtaaattttaatatattttttagataatcgagttaggagtaaaaaaaaatgatacccacactttaatgtgaaacatttttttatttatttttaaatatattacaaaaagatagatctatggaaatattatgggtgatgtcatgatgattggatatgcttgcatgttaatttatataattaaatatattgtagatgatattgcatgcatacatgagattaaatatataattatagctagtgggtgataatgtggcatggttttatgttaagctttagacttagcgggttgtaaatttatagaaattatagatgaacaaacaattacaaaagagtattacaactaacagggtacaatagttggtacaaagaaatatgataaatattatttaaaaattttctataccatagagtaaaaagttgcagtatgtataatttacaccgcaaaatataacaaacgtataagcaatttgaattgattatatttctattaagagcgtgatccatgtattaaaagaaaacggctataattcatttatccggacacaaaaatccttttgcctttgttaatttcctcagtataattgtaacgggtgaagatatgaacagcattgtaccactgatgtaaatctgcaatatttagcttctctagcatgtttggtttgttcgaaagtctacaaatgaaaaatttttgcaaaaaaaaaaaggtagcgaagaaatttcaattgtaactgatgataaatatcatgtgcgatttgtgagatagaaaaaattagcatgttctatacttaatagatgagaatacaggcaggataaaagaaatttgattaagatttaacatcgcattgattgggatgtgattacatgcaaaactttagctatattcacgataaaaatgaacaaacaactgaaaaaacagaacaactaacaaagtaatggtagaaacattaagacaacgaaatattactaaaaagttaaaaaaaattcaactgtatgatatacactgaaaaaagaaaacataatctgcgggattatattttttttcacattataatatatataaatatataaaaccacccttttaactatgattttccttgataattacattggtttattttaaaactaggggattgtccccgcagttttgcacggagcttgatatttcatgtatagagttagattaatatgcaactgaaattttatctctatagttatcataatgtaagtatatttggattttatatacatatcttaacttctatttcaatagatataattgtattttgtatacaactatatcaaccaatctgtaccgttgagaatttctagattgtagagcgaacgtggtgcatgcttttaaggttgtctttaatactacctatgttttttaatatatgatgtcgttgactttttaatcaatgtttgaccattcgttttattcaaatttttgtgcaaatattaaaaaaatttaaatcatccttaaaaagcatttgatcataaatcaagtcataataaaataaataatatatgtatatatatatttaataagacgaatagtcaaatgtatctcaaaaggtcaacagcgtcatacattaaacaacatggaggatagatagattttataaacatatgggatgtaacagatcaaaataacaactgcggccgtatgaaaaaagaagaaaataaaaaggaagaacattgtatccaaaagggcacactttggacccaaccgctgttgctgtgtttcctcgattagccggcttctagttcctcaatgtgcacatctagtccgtgtaaatgcactagtcagaccactatctatcatcttcttcctccagccgatagatctaccacaactagcggtgcaaacacaatggtgtgttgtgcaggaacatgacctcggatttctctaaagagacaaaacacatgcaaaaaatataatctagatctacggatttgggggtgaaattttttttaacgcacaaatgaattgcacgttaatatattagttgtttgggggggtgttgaaaaatgagcacctaaaattgcaacaaaaactaaatatcgtcaaaagggccaagggcccctggtgaacaacgggaagacgtcgttggcgagtcgcgagcccatctgcaggaggattaatggagaaacttgagagatccatcgtagaaaactacaaatcgagctcctggtatggagcctctcttttcttctcgaaatcatccacataggagttaggcgttattcgatacagtgaacaacagtagcacagaaacccacgaaagaaactctaaccaaatgcattaccatatttgacttaaaatttgacttaaaatttgctacattttagatgactgaaatctagcaaataccttgaacctaatgcattaccatatagctataaactagctagaacaacgagagatggaatactacagattataaccttggaaagccttcaggagtgcatcagcatcttcagcaggagaaggggtaactggaggaactactatcgttgccatcactcaccttattctttctccaggtatatattatttggtttcgtcgagctttatgtggtatttatagatttgtcgtggcaacgccttattcaaccacatggaatttaatgagaataagaacctcccataaaacctaatggcaatttaacgttactgtacgaactatatattttgcctggtttaaccatgcaagtaacggaagttacactacagcattgtcttcactgttcccagatagtacaggtcttgttgtgtagatattatggtctggccagccggtacaacactgaacaaattaaggcaattaacacgaataagtatcaacgattttgctttagatgtgtggacacatgcatttctctagatatcttagtcaaattcgcaatgttttttccccacaaaaaaaaaacaaccgcaagtgttatatataagcttttgagagatttgtacgatatataggccaactggatttagcgttcggaccccattcaatttatgtaggcctggattaattataggacaattttgctatatatttgtcgataaattttcttccaaaaatttgacggatgtaattacactacaatcgtagtgtaatgacactgcaacttgtatgcaattacactgtaactataatataacttgtatgtaactttcaaaaatctctccgtaacttgttatttgggtaaaatgaaggttgtgggaacaaattctttcacatatgtgtgtgttatgatttgttttcttcctcaccaaaacaaatcttgtaatagatctaacgattcaaaattacataaaacttacatataagttacgctgtagttacatagaagttacagtgtaattatatatgagttacaatgtaattacactacgattgtattataattacatctgtcaaatttttagaagaaaatttgtcgacaaatatataggtggtccgctgaagctagtagtttgttgacgcacgggcctgtatatgcaaatggggtacataaattgcattgttggcctgctgccaatatggtttcaaatgacactagttagttgcctatatatgcgttgtaatgagaaaaaaattatacactcttgttgcaacattattttagcacacacaatacttatgtcccatcttaatggttttcacatgttagtaacataaacggcaaaaaaattaataaaaatgaaatagaacaatacatcattatttcgggttatcaagttcgcttcatctctaagagaaaaaggaaacagcttccactttagagtttcatgtgtcatgacgatggataggcatgaacacactagctcaaagtcccgaagatggaagtatatgttttcaccaatactcctggagaagatttgctctcgaatcaaggcaataaagctaggaccaattttgtaaccatccgaaaggattggttttgaagaacatgatggctcacaaagatcaacccgaggagcagaaaggaataaaagaagaaggaataaaaataaagatacgaggatgacctagactcggataaattagcaaccgttccccggcaacggcgccagaaatgtttattggtatttcttatgaccacagataaatccacaagcgcacggaataccgctgtagcatttcaccttcgggtaaccccaaaagggtattgagctcagggaacgtgtgtaatctatctaaggctaagattatccaaggacaacaactaatggtaggctagctaggctagacaggactttctatgtgttttaattatctaagctaagtgaaggtaattttctgctggtctactagcgtggttccggctatagctctatgatgtacccgaacgtggaggattactaggatgagattcagagctgtcaccacctgccgtctacctctgacaaatctgtaggatacagaacaaacaaaaggtaatctctaacctagacaccacgcctaagttattaattattactctaatacttgcgcaggaacttccttctttatcaagagtcctagtactagagcacttagtatgaatactaaacaatgaacccgcaaagatggaaacctatctcacttagactaagtaattaaatagcacaagaaaggatctcgaatacttaatttatagaagaaatttctccgaaccttgagcagagcataccgatagctccgatactcctccagaattcctcctagaaagctacactcatcaaggcagaagtcagagagagcgccaaacttttgggcactcctctagagcttctcctcactctctacctatttctaatgtacaaaagatacaatagagcctcttgtaattcagctcaaagttgtgtgttggtgaagtgagatgagctcctccttttatagcctccatatgatggttacagctatgtgaaatgtccaatttgccctccaaccatcattgtgaagtcatcaggaacgtacacgtggaaggcaaggatgaggggcgcctatggtggttcgaccgaaccctgggccccacctcctagcctctcctttggcagggacactgactggttggccctgatggcggttatgacagttatgacccattccgtggcagtatcacctgacttgtgggccctccaatccgtgtacttgcgtctgattggccggaggtgtgtttccttgtatgccgggtgtgttttctccttaaaatacttgcatacacatatttcaccaacactagtggaattgattagtaataatccctaccactaagttggataccacattttatttcattgtatgcaagtattgacggtcagatattatgatttaaggaccgtcaacagtaacctcattccttcgttccaacaaaatctaaagaactcacaactccaatgaggatcaaacttatcaccttgacaatattcttcatcctgatcaccttgataatatctatcatctcggtgatgtctaaaattctgaaattcctctgaacttgtttgtcatgtctcttctggtacttgttaatcaatctaatgctatcaatcatggcatacaccatatttacaggaaaaaggatgtccatcaatcttcatcgacctttttccatcatcaaacttgattcttccttgttcgatggcggattggatttgctgcctgaacaccttgcacccattagtatgatgagatcctgtattgtgccacttgcaaaacttcctcttcttcagctcttcagccgatggtagaacatgacctactagcaactggatttgcttttcttgcaacagtaaatcaaagattttgttggctttattgatatcaaagtcatattcctcttccttgtttatatacttaacccattgacacatagttgtcttcttgatcatggaccactctgccaaactgatctctaggtcttcctagttgtcttcttgatcttggaccacttagccaaactgatctctaggtctcctcctcagaatcataaacatatctatagacgtagttaaccttcttgaccttcttggcctcctgaaaacgttgctcatgagccgataccttctgagccagatgtgctaagctctcaaagtcttgtgatgaaaatttctctcttatcgacccaatcaatcactggaaagccaaatcgactagctgtgaatcggtgttgacggtcgttatcgatcagttgcgaccgtcaatatagccaaaatttaggagaactagtgatgcttgcaatgcatatatctgttaaaataataatattccactagtattaggtacagtaaccttttgcagagaatgacaataaagtggaggagaatcgacatcaactcagacgataaaccaatcggacagtgtcgagaaccagacttatgtatgaatgggccaagaactcagaaataacacaacacattgggccaaaattacaagtctacgaaggaggactacgaaggaggccgctagccaaagatgggctgggttgagccaacccatggttcggggggttcggctgaacctcccgtggcgccgatggatgcaaggtttggatggacggctgggattgatccccaatgacggtaggagggtattaccgaccattccaaccgtcgcaaccgtcattacctacctataaaaggagctcctcttctcacttcactcacacacctcaagcaatagctctcccatttctctcaattttagtttagtagtatctagctggtggaataggaatagagtagaaatcaggagtccggaagtcttcggaagagttcgggtatggctctagcagctttcctttcttcttttgtaagctttgtacttttattaaaataatcttctatatacatttacaatattgaaatactttccgagaatattagtacctactttacactatgttcatgttatactgaatatacggctagcttatctgggagatgctttggtgcgggtataatgtttgcttatgcaattactctatgtcatgacgatgatattagagtagtatctggtagtttagacgtggtgtctagattacgggatatcattatttggggttatatattgcggatgagaggtggccgcttatggtgatagctcagtacgggtattcctccgcgccggtatataatcctaagttaatttcctggggagggtattcctccgtatttagccccggttgtatagtcatgacgggctgtcgtaagaaactcagcagtcaggggtggttactcgaagtaacaggagcgcatcggaaagagggtattagctagtatatcagttaacaagaatgtatgtgtactatgtatattagaagtataggaatagattatctgtctcttttctatccacttagcttagatgatttatcatgagaatgagtagttcatgcttgtgtgtcactctacgctttgattatcttaacccctgtttagaatacgattatcacaagtaatatataaattattagtcaagctctctctacatgatcttcccacgggataaaataaatacgatacccttagaatactctcgggtgaaatgctataatggtatatccatgcgcttgcggatgaactctgtaaccataatataccagaagtatttctgcgccattgctgggaattatatttttagtaatgtcgttaagaaataccaacaagcatttctggcaccgttgccggggaagattcataatagagataacttgaactaatactttttatttacctctgtataatcattttcctttgcaagctaaccttggttgttttcactatttgttgtggaaacagggtagtgaatgactggtttcaacctgtcggaaaactttaaagaaaatccagaagctttcttccggagtgtcaggccgcgagtcgttgctccgaagaaaagtttaccgatagaaaaactagcaataccagtgcccccgaccttcaagactatggctagcagaactcttcgtgagttcgctgctccctctgctgacaatgtggccactaggctgcaggtcaacataggagacgtggatttcgacttgaagtccagccttattacgatggcacagggtagcccgttctgtggaaagcctaatgaggatgcctatgcacatctgcaatagttcctggagatctgtagcacgtacaccatcaagggcgtcaatctcgatgccgtcaggctgagactgttcctgttctccctcctcgggagagcgaagcagtggttctacaccaaccgtgttgctgtcaacacctgggacaaatgctctacggcattcctctcaaaattcttcccgatgggcaaaatcaatgccctgcgtggacgaatttcaagtttccagcaaacaagggacgagtccattcctgaagcatgggaacgactgcaagagtatggttggaaagtataaagttctctgctcctgttgagtgcacttctctgattactcggatagcaaaagggctaggggtcattagcgaccaaattgcttttatctcagccgctcgtccgcgtattgataaagcttatctagtgcaagggcatattctgaaacgtggagtagatggatctttggtatactttttccccggttgtacaaatggaatcccgttgccaaatgcggggtatcatttgtacaactgccatgaactaaccattcccgtgcagaccatagaggaatctcgtgcaggtggaacatacagagagacgcgcaacatgacaaggaatgaacgagaaagttcatcatcctcgacacccgtgcagatgtatgaggcaggatgggcaccaactggggatgcacccggttggacccaagctccacgccatagcatcggagtctcaacttgggcaagcgccagtgaggatcggtggcatgcgcctcatgacatccaatggggggacaattaacctcccaggtcaagtggtgtgcctccatctccaagtgaatggcgctcgagttcttcccgttgggacttgagtgaaatcattaggagaatggacacccttgatatacagataggggaaatccagtacaacctcacggaacacgtagctcaaacacaagaatggcaacaatctgctgatgctcaattcgccaacatcaacgacatgatgcagcaatagcacgataaccttcaggtgtactttcgttttcaggggttcaatccttatcaaggacgctgagcgaaagccaagcttgggggggggnagncatcgctcccccccactgaggtaacttgtatcacattgcatatttctcttatcaaattacatatttgctttccaattgcatcttataaaaataaaaacaacataaaaatgtgcaaaatagaaaataccaaaaagataggataggtttgagtcatgctaggtaagacaagctagttctccttgttgaaatgatgaatagttgctctgttttatatctctgatatatgggttcttggtaagtgctctctcaaaggttaaatataagtagccaacaattatctgggaacctgaggtaaatgagctgcacttgctgatctgagt

SEQ ID NO: 70884 - DNA, 4224 bp, Oryza sativa
tccgccgtcgccgccgagctccggtccgccgccgtcgtcgcctcggaccacctcccacctcggcgccgctccttcggcttcgccgcatcctcgccgacctcgtccacctctccgtttcggtcgccgaccgccggagcaccatcgaccccgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatggccgccgccggcgactataggggcgcgggtgcgccgcctcccgccggccgcaccgacgtggccgcctccgggcgcgcctagcggctgctgcgtggggcccggctgtcagccgcccgcgccctcgggtgcggctgacgcgtggggcccacggcgccggccggtgtgagccgggtgcacccggtccaccgtggaccgtggggctgccgcgtgggccccactcccgtggacccagtccgcgcgcccctcccctcggctgacgcaataaaccctttttaaaattaaaatttaaatgaagaaattcgcaaatattcatttaaagagcatataaacttcaaatggccatatcttagccatttgaactcggaattggaccgttcaagtctctaatttttccttaagaagtcaagaacctatttttgtgctttctttcagctggttatacggattttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcactattgctttatttaaattcccgcgttatcactgttttatctagccatgcctatttacctttgttatgaccttattattgttaatgttattatttgcttgttcaccctagcataaacaaaacccctactagtggacactctactcatggtaccactagtaggattttaggtagatgcttcgctggttaattaggcaacattaggtggttttacaactctagactgtgggattttctcatcacctggacactatggaatggttggattattgtggaattggattcacaccgccccctctattcaaaatccccaaaatggttttaggctggactcggggtgcatggttttgatagtagcacctcggccatttaaggaccgttcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcacggtagtcgagatgtcatggcacagggccggtgtcctgctgctaggggctcagtcctgcctacctgtcccgggggttctggccgtaggtggggttgggtcggtactcttgtctatggctaggatgggttggaaactatgtcacgtcttccgtccgtataccgtggtggtatgtggcacgtggctacacgtgaggaagatgtgtcttgtgggtaaagatgtacacctctgatcaaagtataatctattcgaatagccgcgccctcggttatgggcaagccgagcaatgtacccaagttagtgttttaattcttaaaacctgcttaacaactaaaaggtggaacggatggcctgggttggcttgggacgagctgggacccagggtcgggttgccagttcggtctgaatcatcgtaggccttgggttaaggcaggctcgtgtgggttcacggccttgattaataatattatatagctctggaaacgtgtttacaaaatagctttgagcaactaagtgtcttttaatgctgtttactgcaaaccctaaccctttatatcataacccccttgtactcctttacatttatcctgcacttgtgggtgtgtcttgttgagtacagtggttgtactcagtcttgctcaatttttccaaacccagaagaggagtccctggaagatgaaggctttggtgtctagctcgtgcctgccgtcaagcgcctgtggtcgttgccctagtcttccgctgtttctcgtttgtctttgtgtgtgctgggccttcgctgcccatgtaataaattagctatttatgcttccgcttgataaactctgaaatgtatcaacttttggtgtaccttgcctcctgggacaaggaataatacacgcacgtaaggaacgcccgttgagttaattccggtcgtgacatgacttctcaccggctgaaagatataacctgaaaggtatccccttctgtggaggaattaaaactggaggagaactaagatattctttaatgttgtccaaagctttctgttgctctgccccccaggtgaattcttgatcggctttcaatctcaacaatggtgtgaaaggctctatcctgccagataaattagagatgaacccttctaatgaaatttgtcttgctgatcaacttctgcaacttcttcttatccttcggaggttgaatcttcttgattgcattgatactcctttgagttatctcaatccccctttcatgaacaagaaatcccaaaaactggccagccaatacgctaaaagcacactttgtcagatttatcttcaggccatattttctagttctctcaaaaacctacctcaaatcggctatgtggttttctattccctttgacttaacaaccacatcatcaatataaacttcaactaaccagccgattagatcgtggaaaatgtaattcatagccctctgatatgtagctccagcacttttcaagccgaaagtcatcacaacccactcgaacaagccgattgcaccaggacatctgaaagctatcttatgaatatcttcttctgccataaaaatctgattgtaacctgcattgccatccataaaacttaatatcttatgtcctgaagcagcatcagctaactgatcggcaaccggcattgggtactcatcttttggagtagctttgttaaagtccctaaaatcaatgcacaccctgactttgccatttttcttgattactggaactatattggaaaccagcatatcggcatggaggaataaaaccagcatcatataaacgtgtaacctcagccttgactgcctcgagcatatcggctttgcatctccttggcggctactggtatggtctaacccctggtttaataggaagccgatgttcgacgatcgatcggctgagccctggcatctcataatactcccaagcgaagcaatctctatattcttttaaaagctctatcaacttggttctaaattcaggagataaattcttactgatgaatgtcggccttggtgtatcgcctggacctatatcaatttcttccaaatcattggccgacatgaaaccttgtccttgcttgtcatcgagatcatctaccgtgtcctaggtgtagacgtttgaaccctccagacgccctcaaaataataattcgggctctccatcttcaattggctgtacatcacaatcggacacttttagaaaatctccatcccaaacttttccagataggcaatcaataccatccatctcccaaagagctaaatcggcactggcaacgttaactgacctgtcggctggcacgatcttaatcttgtcgccctgccattgaatcaagcattggtgcatggttgagggaatacaacaattagcatgaatccaatctctcccaagcaacaagctataggaacccttcctatcgatgacaaaaaatgttgtagggacggttttgctgccgactgtcagttccacattcaaaactccttttgtttctgatggattgccaccaaagtctttgagaaccatatttgtcttgatgagatcctccgaattccggcccaactttctgaatgtagcatatggcatcaaattcacaacggccccaccatcgaccattatcttagacaacggcatcccattgacatagccattaatatacaatggtttaagatgccgattctctttcccctctggtttctaaaaaacagcttattctggtgacaaaaccaatttagcagaggcttcctcaacttcatcaacatcgact

SEQ ID NO: 70885 - DNA, 19901 bp, Oryza sativa
cagtatataacatatattaatctatagctggttgaccatggtctatttcatggcaattcctagcagattctggttcatgtgtaagtagttcattatatctaaaagaaaaagtgaaaacagttatgatttgtcctataggtggcccaaaaactcactcaatcttttatggtttcttgagaaggaaatagttgatcctatatatcaactatgagtgtactcaaggtggtcgaaattacacaaattatccgctgaaaaccctaattttgaccgggccatgaacctgtgacctttggtttataaaagttgtgctgaactcctcagccaatgaacgatgtgactggttgaccaattgtattttcaggtgtacttaggtggtattctcatgttcccatttttatgttgccaagcaaatacttagtattagctgctggaaattcacaaacaaatgctaccattgagggtttgctaaattgttcttgcatcttctcatccaaatccagggctgatgaattagagacagcgctgatggagatggttaagcaggataataggcgggaattaagcgcaaaggttagcattgaactactgttttctatggcagttgcattttttattccatcacctgttattatttagctctattttgttgcctctactgttgaattcatattgctgcgatcttgtgttttaacccaaaaattgtgaaataatatctcctttccttttgataaccaatttatcaactaggaaactcatatatatcattggtccacctcactgaatggacatttattgttttcctggaggcttggggcatggttgttctcatacttgcatttccatttttataggtcgagcaattggaacagaagttatctgatctaaggcaagctctattagacaagcaggaacaggagcaagcaatgcttcaggtgtagtagctaccaatatgttgctctgaataaaccttgtcactactacatcatgccttttactactggtttatctagttataaactaactaggtaatgcatgtaggtcctgatgcgtgtagagcaagaacagaaagtcactgaggatgcgcgcatattcgctgagcaagatgctgctgctcagaaatatgctgcacatgtgctccaggttagtttaatttcatcgattatctatgtactgtatttttttctgttctaatgcttatgtcatgttgaaacatgaaatggtcattcttttcttgattgcacctggaggacagcactgtttctaataatttcctctgcaatggattagccaactagatatgtttgtgtaactatatgcttcattagtctatacattatttgaactctgtaatgcttttattcatggaatggactccattttgctgtcattttttttgacatataatctagcaaatacatgcctgttcaatataatgattctcttgttataacatttgactttgtatgcaggaaaagtatgaggaagctatggcttcactagcacaaatggagaacagagcagtcatggcagaaactatgctggaagcaacactgcagtatcaatcaagccagcaaaaggcacaattgccatccccttcaccttctccaaggtattatggtattatagcattctacacacactggcatggaaagttggaaactgataaattaatttattgaatgcaataatatatcctttctttttatggtatggaagtgttggtatgctattacataaatgcaataatattcaatactggcaaaatgttctgtgaaaaattccagtcatttgctttataccaattgtccctgtgtgtaacctttttatttttaggacaccaacaagggatgcatcacctggccaagtgaaccaagattcatcacaggagtttcaacctagaagaataagtttgcttgctccgttttcccttggctggcgtgacaagaacaaggtaatttttattggaaagtggattactggattcctttcctgtgtagtgacaataaatctctttctagtctaaaaaaactcatagtccagcatgaggaccattgcaattatttatatagcagactgcaaagatggtgaaatattttgatgtcttttacctttatgattgtgatcaagcagtgtgatccatgaaatgtccttctatgctaattgttactaatggtcgttatattccgaacaataatccacatcatagttaaatttagtttaccatatcacttaaacttcttatctattgatttgcatcaacttgaccattatccagatatcatagttaaatttagttgctgatttaaactatagtaccaaggtaggctagagttttcccctttttttttgggaactgacttcacttgctattgtttcttaacaaacatgttgaatgtaacctggtttgtgacttatatctggaaataacattacttgtttacaaaccctctcaggcataatattgatcgacgcatttctctcgtcttagaagtatatggctttaaacaatgagatatgaattgctatgccctttattatttcgtgatatcaatcttttttttgacacgttgtgatatcaatctggcgccgttgattctttacagggcaaacagaatatctccgacgagtcaacaaacggcaatcttaatagcaatactgagcaaatggttgacacacccaagaaggatgatgaaaagcaaggagactctccacaggagggtgaacaaagagtggatacacccagaagagatagtgagcacagattagacacgccggagaccacaataaagttggaagaacagttggaagaaataaagttggattgataatcacaagcccacccatcggcgaatttttaccaatatggttaactactgccgtggtattaaagggtagttcaagccacaatctacggccaatataaaagtatgtgttgtatttattctttttatttattttctcctactcccttttccttcttaattttgtctttgttttgcaaccattttttcctaggtttatagatttaatctttttagccacgggttgatgggagagaataaattgtgtttattcattcaatcaggatgagttgtaagttatcgataggcacatgaaaaatgtatgaaatgaatgaatctaccagcaatttatgaaagagaacgtcactattggcatcaacatcaccgagaattactgttgctgttgcattttctggttgcctttcttatttgctacttcgtactcctgtattttttacatactgacacgtgacatgtaaaaaagactttacatttttcccatttaatacggagtatttgaaaggcgaggtcgtccacaagcatggacgttagtactttatccagtatggtcatgtgtggtgatgcagatgcaagttttagtgctactgtgctgtatatggctgtggaagctggaagcatggaatgaccttggcaattttcagcagatggtccagatattactatggagccaggatcaaaatgatcttttgataacaggaaaatatagagacttgctattggtcagttcattgaaaataaggaaaacattttaatggccaggatcgcttcaagattctctcctcactcctgcgttcggaagacagtcttcccaacccatggtgcgcacacagaaaacggagctgtccattagcacgtgattaattaagtatttgctattttttttcaaaaataaattaatatgattttttaagcaactttcgtataatttttttttaaaaaaaacacactgtttagcagtttgaaaagcatgtgcacagaaaacgagggggagaggataggaactggcaatgccgaacacagtctcgtggtgccacttgtgtactgcggaccggaatgaaataacgagaagcccaccggtcactcctttcctctcgttaacaacatcctcaagaagtttaagcaggagaatggaggaggaagacgacgacatttttacccaaaaaatttgtagaatgccttgaaggggtacatagtggcatatatcaaataagaaaaattataataacatgtttacaaattgatgaatagtaatgatatattttaaaaccgtgaaaattataatggcatggacccaattaacctaatattgtttgccatagaaagatgattttgtttactgatccgattgaatgatagcaacgcggccgcggctttaggtgcggggctcacgcactgcacgtgcacggtggtggtttgagtggcatagtgcagccatcagcacatcagtgtcccttccccacagcagaggccaccgcaaaaggagccccaccaatcaccaccatctatcgatgcaccaaccgctcctcctaaaacacgcccaattttgccatgtgatccatgctttcccccacccccatctgctcccgcatgtgggccaacaaaatgtaaagtagccctacgaatctataagtatcacgtgacacggtctggagtgcaataatttggagtcctctctctaacagcttctgtcacagacagatgggtcagtgagtgactttacgtttctcctaccgttcatgtaatcatgtttagcacttagtactctgatgctaaacaaattttcttagattcttcgatcctcagctgtagtgcctaacagcgcaattcaattaattaactcaaaatctaatgagcacttagtgtaattaattaattcaaaatctagtgagcacttagatcttgtttgttttttcaactccagactttagttttcttatttttcattagtacgttttttaaattgttaatgatgcattttaaaaaattctatataaatgttgtttttaaaaaaatcaaataaattatctttttaagtttataatagttaatatttaattaatcatgtgctaataaactttcttctttcgcatgcaccgaatatctttcttcaaactcatctaacgaacgaaacccaagcatctagcatctctgcctacatatcaataaactaattgtcaatttgccatgaggtttaaacttcttaagtggtctaatcaccacggggttaaccaaacctaatcatggaggctttaaagatgacccctttcccccccaaaagaaagcggcaaaatggtgaggagtgagacttgtgacaaagttgtgagttgtgactcagctcacactctcaacagaagcgcaaacaaacacatgactaaaaacaaaagtgaaattattgcgggaccccaactgacagaacatgtgagtaatcaaggataaatgaaaaacgcgcaaaccaacgccacatggctaaaaacttccgctataaatcagtggtgccttgcacttgcacactccatctccaactctccaagccagcccagcagcactctccttctccaggctccagcaaacacacaaaccacggaaccaccaccaccaccagcagcagcaacagcagcagctcagaggagaggagaagagcaagttaaaacaacttacaagcaatggagtacagctatccctgcaacagctgcagctgcaacaaggagaagaggcctccgctgaagagggggcagctcaagctgcagatcgccaaggccctgggcagcctcgtggtgcccggaaagaacagggatcacagcttcaggagatgagcgtcgtggtgccccggaggcaagaactgggagccacagctcaacacttgagcagcagcgcctgcaaactgatggaagttctggtgtactacggtggtgggcataggaattgtgcatagttgttggtgtgtagttttcccccctttccgccccgtagcgtatggcttgagacttcgagagtatctcgcttcctcggcaattgctttgttcttgagtgaagaaatagttagggagagactcggaggtgtgttcctggcagtctcatgtctggtttggtaatgtactgatgtgcagcataattttgatggtaatgagagtgttattagtacttccttacactgttactagtacgtcgagatgcagctgcattcgtatacgtacccaaagtctccgtctccagcctccaggggctccatgttccgtagccatcggtctaaagcccctccgctccgccaccgcttccgctatcagcccatctgccgagcgctaactgccatgatagatcgccagatccttcgagttacccggtccccgctggccgctgcgccttccctgacgaaggcaccgcgccggcgggttgccttcattctccgattcgctggttcgctgcacggatttgctggtgtgctggttcgtgcgtgcgcgccgctgccatgaccacggtccatgaatccacggggaccacggggtacgcggacgcaagtagcacgtgacagcctcacaaccgattgccatcaggcggtgatgtgcacggcaccgtgcgacgagtcgggattgggaagacccacatgtcagttagcgcagtactgcagggcattttataattggaaccaatgaatgaaccgcggagtgaagtgatacgaccgggtgtcgctacgctagcgggtgatcccataagtcgtcccaacgtcgccctccacgccatcgctagtttggccgtttgccctcgtccgtggtatctctaccggacactggatactcctctgcattttttaggcatccataatctgagacactcttagagtaaagtactcgcccttacaatacagggtagctcaataagtgtcccaacccaaaaaaacatatttctctcttcttcctctctttcctattctacccctctcttccccctcctctctctatttctccatcgcacgcacgcgagagcgcaccgagtcaccgtcgccgctctctctcccaccgctctctccctctctctctctctctcgtggaaggtagcggcggtgaccccggaggcagcagatccggtgccgccgaagccggatctagccccccggcagatggagcagcaccggccacgccacatcgaggtggcggacggcaaactcgaggcggcagacgacgagcgcgcggcgagctcgaggcggacgaggcggcggccggacgaagcttcgtcggcgagggcgacgagagtagcctactccgccgcggatctgtcgcctccgccacccccgccgcggatctgacatcccggcgccgtcctaggtcgtcgccgcctcttgactctccctctctttctccagccgcgcctccctctccttctcgccactgccgccggcgccacgcctctctccttctctctcccatcgccggcggccgtgactgagtgcgatgaggagctccatcggtgtcgccgaggagctcgaggagaggggagaggggtggaagaggaaatcctcgctcttggggcgtcgcctcaagcacccgtacccacgcaacgggttccttccaccggcgcctgggcgaaaaggagctgggggagcgggggggggggagggggcacatctcccagctaagggacgcgctctcaccaggggacggcgccgatggaaaaggggacggccgtcgctaggggcacgggctgaagcaccgcattggtgatagccttatctacagtcaaaagttactttgccacagcagaataataacaacaataagaagaaagcgtgtttcaataatggcgctaatctatggattagttacagtattaatcccgcggacgaatcactatgctggatcggtacgagatttatcatagatctccactgcgcgagaaaattccctcaaatccggtccagatttgcttaatgcaacactcagccagtcaattgtgctgggtgactggatcattccagaactaaacaaaaccatagcacactgacctcccggctgttcttatcagggaggataaccagcttctctgaacagtgaacgcacaagcacaaggagctaatgatatgatgagatggatgattatattagacagaaaaaaagtgtcacttaatcattggacatcatacacgttagctagctaactcatagtatgtccgtatcacatcgccacataggaataccactcagactatgtagcacgatgctagggaacttgcagttaataaaacgataactaatcttgggaatgatgtgcgcaattattaggatccgcaagttaggcgtaagtaaccaagtgtgatatactctactccctccgttacagaatatagcaacctaatatcggatgggacgtattctagtactacgaatctgacggagggagtaccagttaggctcagaaacagtgtgccgtacctgacgccttctgctgttgctgttgctttcaatagttttcagcccctcagtgctcaggtaaatatgtgatttcgatcggattaagaacagctagtcctaactacgactgcaattttagggttacaagtatctgcaaccattcattttgatgatcaaccatccgcatttatagctatactgatcaaaccaagaaccataaacaatattttattctacaacacttttgttatagtgctctgactaattggtgtcgtttgattcagatcaaatgtactctaaggatagtcccaacccatagtgtccataaacagtatctatgtgccatgtcaataagacatcataatagaaactacactttacaacccatggtttcttaaagtgggccattaataaatacatcatctctcttctctaccaatcatatttgttcttcatttattatgaagacattattctctcccaatgcaaaacttgacagtgtctagtgcataggttctcgtgttgaagccagttttttgcatgagacccagtttcttcctctcttcactctctcttaattaatatagtgccacataagcttaaatttatacatggcaatatagttaatacaatagacatcattctaggtggagggttggaactgccctaagcagctatgcctacataagttgcagttagtactacaactgctgttgctgatccaaatcctttgagtttatcagttaggtctagcggcggacacatgaatttaagactggtcattcacttaataattgcagacgcccttcttacaagtacttggtagtcaggactatggaatttatagaaattggttaatggtctagaagtagtgtgagccaagagcatggaggaatggatttattgaggaaaaccgagtaaagtatgaagcgtatactccctccgttctaaaatatagggcataactactttttaaaggtgtttcataatataaggcgtgcatgcatgcatggcaattaattagcatctattctctcctaaattattattttttaaaccatacactcataagatgtttaattctattgggtgcatgtattgtattagttggattgattcaaacaaagagatgatggtaattgtttcttggtttttgagttaaaagtggttatgtcttatattttggaatggaggaagtatatatatgtatgtatatatgacacgggtcacatggccagtgatggtggtggtgggctggtggcatgaaaatcaccaccactactatcttttagaagtattctctccacctaaaaaaattcaacctaaaaagtgacgtgacctctcctagtataataaatctggacatactagaaggggccacaccctatcctaggttcagtttttattttacggagggaatagtatagattataaacttaaaaagtatatatatttgatatttttataacaacttctatctagaaagtttttgcacaaaacacaccgtttagcagtgtaaaatatgtggtaataaaaccgataaaaaaatctgcatcttaaaagtatttttgcgaacatattttgactgacatcaaaatattcagactgacccagtctgaaataaatcaggaggtcagatccaaaacagtttcccaaactcaccgatgagaatggagaaccaactttttttttcggcgtctccgcttggcagtatcgatgacgcggcatcgatcgatcgtgacgtcctctcggtgatgtcatgcatgcccttcggttcttctctcatgatcggctgatcggctcagctcagctgctgctgctcctcgctccagctttcggttcttctctcatgatcggctgatcgcctttcggttattccctaatgatcgcgcttctatcccatactagaacagaatcgatgattatatcctaagcagaatggattatgagcagaatgtgcagcttagattcgtacacatccagttgggagctacgaacatgttctgttcagtgttcacttgtgatgcagcctattccctaactctttaagaaaaccaaactagaattgagggcctatttgaatcgcaggattgagaaaacgtaagattttgatagtaacgtaagtgtaaaacagagcattgcaaaacgcaggaaaaacacaggaattaccgtttgattgaacctcagaaaaaacgcaggaattggatgagagagactcaaaggaaagttaccaagagattaagctcttgctaaatttcctccaaaatctctataggattgtccattccatacgaatttcaaaggattcgatagaattcaatcatttgtttcaaagggtttcatagaaaatttttctataggattgaaattctacaaaattcctatatttttcctctaaattaaaaggccctgaataggatgtaacctaatacaacgaatttagaggagcttatgttgctctcgatagatgtgcgtgcatgcacgagtcagcagtgcgtcaaccgcgggtggccgggcccggtccgtcgctgaatgctgatgccgtcaagctagcggcagccggcggccagtcgtagctgcgcgacgacgacgacgaacccggacgcgcgcggtcgccgctacgatccgcccaaatctacgggaatctcgggcaaattaaagcggatcggggccaccgagaacaaccgcctcgcgcgcgcaccccaccggcctttccaccgtcctgcactccacagtattccacttccactggcctcttccggactcggcttgactgcagcaggttggttagcttcgcctctccaccctctccgacaagatacggtccaagtcagcccggtactcctagtgcagtcttttgcatcaccatcctcggctgtttggcacggtgggggcatcaccgaatcgatggaatgcacccattctgcttgcacgtcgtactatgccaccttggttcgctgttcaccatctccctatttatacgcggttgttgccggatcagtctcaccaacaccaacactacaaaagtacaaagcacgaagaactacattgtctgctctgctcacttgctcagtggtcgatcgaagcgggagagagtgtgtgcatcatcgatggcaacgagcagccacgctccggtgaagcgctgcctgagcaaggcgccgtcggggaacccgctgccacggaggggccaggtcaaggagagcatgggaaagcaaatcgtggcggccgcggcagccgtggccaccgcggcggcgcttgcctgcgagaagacgggcggcggtggcgctggctctggcgacaagaaaggcagtggcaggccggcccccgtggtcggcgccaagaagaaatgaccagcgagctcactaattaaagcatagtgcacggcagagtgaaagcagagtgcatgtttggttaaaaaaaaaaagcagcatagtgcatgttgcacgtacttgctccgtccaaaaaaaaaaaaaaaaaactcaacctcatacgtgttagtgtccgatagtacttaccatgatgcgaattacgtgcatggccctttttcggtgcaccagagggacctgcagctatcatgctcggtttctctgtgtagcgtgtgtcgtctacgaggcttttaaatcttccttgttttgtttggtgtcagtatgtagtagtagtaattgatatgggttttacaggggtttgtatgtagaatcttggatcttgtcacatgcatgcagactgcatacgtttggtgtttctacttcttatcttacataaaaaaaatctcgcggtactacctcaaacttgtttgagtactgattataagccgtaacagtttattaatagttaaaaattaatttataagtaaaatttttatggtaaattttggtacatgatactcaaattttgtataatttgctgataaacatcgagaaaacgtgtcacagcttaaaaacattagtaaaaaactgataatttgatagaagacactttcggcttaattggattgataatttctttaaaaagacgagaatgaccctaataccacgcccttcaaacatgacattaaagtaaaagattagaaattatgcaaatctaaatttaccgtcaccctaaatacaccactagcatacattatactccatctttgctacagtcttagctcaaaagcttttgaccttagggtattcttctctttttgaagaatttctctccccaattgagtccaaaatgttctctagcaaattaccagttttttaaagtgtcttttggccgtgacacatttttacgatgtctaccaacaaattacacaaattttgactttcccgtagcaaattttgccaatttttatatatgtttgtagaaatttaaaaataaacactgaaaaataaactacaatgaaaaaacatcaaaatcaactctaaaatttaatttttggttatgtttataagctgaatgattaacgatgggactgtgattgagctattatgaacgaacaaagattctttattaagatatctatattttgtcatcgataaacgattgattataaaaattgttgaagccatcgataaattatgtgagtatgacaaatcgtggttagccttccattaaccccatgcaacaagtacattttgcctctacacgctaagctagggtagagtgcatttgacagaaagctgacaacgatggcataatgaaagaaaaagcattttgaaatgaaattttgtagaactcgcatttatcaaagaaatttgaacaataaaaaaatctcctttttcaaggacataaattttctctttaaataattacttcaaaaatataaaacggtatgcttagatttgtcttgaaaattaattttgcaatctcataaactaattatattttttatagcattgaaaggtcattttttttttgtaatatcgaaagttacccattcattttgatagcacagttaccttccgtttcctttttaactcttcggtcaatttcctgtcgctttgttgtcaaaagtttcctctctctcgagatcgaatagtaggttgcaccgtagcaacatcgtcctgccgtcctgctgctatcggaagaagggacggcacggcgcgtgctctgccgctgccccatcgtctggagaatttttccttcttcttttttaacctttttaatttttaattttaaaaataaacccttccacaatcttttttttaaaatctaaattatttgatcacaccaattcatctggtatggtaaaacaacattaacacacaacctataacagacacaattgtattgttttgccatgctaataagagcggtatggtcaactaatgttgccacgccaatgagatcggcatggtcaaataatgttgtcataccagcgagatcggtatggtagtattgttcgtcgcgtgttgacgtaccaaatttggttgttaacatcgcgccagttcggctagcatgagtaaaagattcagatattgaaaataagtttgagaagtgtttatttaaaagtaaaaaatttaaaaaggttaaaaaaaataaaaaacattctcgcctggatcgccactcacccttgcagccttgctcgaccgattgcttgctgcgacggccagtttcatcagctctttggtggtgtggttccgtctccagcaacctcacatccatagccggtaccattaatcccatcaatccccaatcctgctaacaggagtcatcccataagggcactcacaatacgtcactaaattttgaggagccaaaactgccacgtagactaaaaacttcataagcaacaaccttcgctcagtgcatgtggtctatttagtgggtcccacgaataccaactttatcactttactagcttttcctttatcctcctctctcactccttttccccaccccatagcgccgagtcgggccgagctcctccgctgccgacggcaggggtgccgcgcttggcgctcgccggcgcaccaccctcccccccccctcgccgaaacaacggcgaggtcagcacgcggaagcgggcggcggaggattcggcggcgggggagctcggcgttggctagcgagggcgccgtcgcttcaccacctccgcgggcgagctcctctcgtcgccgccggatgggatggcgaactcggtgtggatctggctcggatttggcgcccctactcctctccctctccggcgagcttcttcactctctctctcctgctctgtggcatgtgtttttctctaacaatttgctgaggttctcggagccaaaactagccacgcgaagctggtaaaaacgcgcgcctcacctccttctctcctccacgtatgcattgggccgacgtggatagagattgccacacgctacctcaccgcactgtgaatggtctaaaaaactaacctggtactagatgtgacacatactagtactataaatctagacatataaatgttcagattcatcgtaatagaatatgtcatatccgattctacattcgttttttatagacaaaagggagtacagcacaagaacctcaccggcagaacgcaaccaaggcgggcagggctccacgcctccacaactctatctcgcggcgttgtgattccttacgaatgcaaatatttccggtgaatcaagaagccatcatttccttctttcttgtcgtgcacatgtacagccagattagattatactccaattagtttcctatagagagagtatcaaattatcttttggttgttgcctcggcggctcggcgtatttttttcgaaaggctgagccaataccagccaaccttgacttcaaacagagaacgttgacataagggaggtaacatcatgatgctactaaagtgaaaacgtaactttcagtgctataaaatcaggatcaattttgcctcgactagatatgcacatttaagattgctctatgtgatttatccaaggatgattcaacagatcggcagcaaaggggcaaactaacagaaggacgattcaacagataggcagcaacaaacctcgcaaaggggcaaactaaaagaatttcatcaaaggataaagactaacctgatgaacttatggcaatgtttcacatcaaaaatcggttatagtgtgcacgaggccaaaaagtagtcatgttattcacaagtagcaacgtaactcccgcaaagataatataaagggcagatgcgtcaaaaaatcaattgtcatgtcataacagcactgagcatcattcactaatcatggatagatgatcagtctggttgaaacaaattgcacttgcatctatgctccaccttccaccttttttgtttctaaagcaagtaggcaatttaaggcgcaaaaatggtgttctacttctcaatggccttccagtccagagtgttactgctcaagatgatgttccctcgccaggttctcgaatctgaatggaagttcttgacaggcttgcttcaagctcgtttaactcatcaatgtccaggtcatcatcaatatttatatcttcatcatcggactcttccacctccttgccattagaagttgatgaacttggcccctcatcctggtttttattgctctgcaacatggaaataaaaatatatgtaacacattcattgaattgccacagagcagcctgcacttatctactatctgccaaaatccctttcaagcggaaaatataaaggaacaaaattattttggggggttgaaggaaccaaagttgttaggattaggatcataggtagggtcgcttttctccaagcaaaatcggaccataggattgggatcctatgagatgtcttttgtttcaatttgaatttaatattggtattcagttatatgtagttatattggtattcaatttgcatgatactacaatccgcatcgcgataccaagtttactgaaaacaatgagttgaactgaacataacaacgtgacatggatacatgatatgtgtatttcatgttgaccattctatccaggcatacctattcaacttcaacgcatacaggtgtttcaggcacaataaatacattcaaataagctaagaaaataatctcactacgaagtgtcacgccaacaaataaacctaagtacattcatggaagaagaaaaaatcagtttggcataagattcagattacttctttattggaagtttgtcctattcatttaatttctcaggaggcgatcgagcatagatacagttaccgccttctgtaaaagtgcctaaaaagatgtttcatttttccatagacttgatttcagatatgtgaaggacaacagcccaacatatgttctgattgggtatctacaacccacttgtgattcaggcatgtcaatagtcttgaaaataacaaagggaatacaaaaggagtgctccccaaataattttaagttcaaggtgtatctgccaaaactgatagttccattatataactttagaatctttgggggagggtatctgggccttttctgctccctcaaacaattagtactttcaatctttagttgtaacattaatcaaacaatttgttaggagcaaatattatagcacatgaatgaaaatttaccggttcttcattagcctctgattcttcctgtctttcatatacatcatatgcttcagcatcatcaacgaacacacttgaatcagccatgaacagctcacggccactggacacaatagcaaatactatcacagtaagtacctcaagcctcgagagctcaaaacgataaactaataggagcaaatactacctcatgcgatcattcttagccctctctgccctcaaggcagccagaccagcttctctttcttctgccttcttccttttccattccatgaataaatctgtggtcataggagttgttgtttttacctttttacgctgttagatggacatggcaacagatcgtcataatagtgaacaagtggaaagaagacaacaaaattcaatattccagacagaacaattttgactgttgatcgtaattctacctgatcttcaatctcatcttcgatagcaatcttttcactctcttcctccaataaggccttcatttgggacttcagtacatagccaggtggaagtgcatgcctgtagtggcaatctttgcccccatttgggcaaacccaaaaccaaccgtactgtttcttctccacggcatcaagaaagtacttgcaaacctacaagacaaaagaattaccaaatcaacatcatgtttgaagacaacatctttcagcttgcaaaacaaaaggagttcttatggtttcactgctacataaattcatcttccaggagagagagagagagagagagagagtaaagaaggcaatacaagttacaaatgcaacagatacagcataaagaaacagaaaactgattttgtaaatcgtagcagcaatgcaatgaagacaataaatatgacttgttagaacagatgcaaatgcatcagagcataatcatagcttgttaatttactatattttcaaactgtgcatcatcaaacttccctcactgccaatatattggcattcaataggttaggctagcattttgtaaggaatgaaataatcaacaaacatttattagactagaatcttaatggcttctataacttataggtgaaagctattacttaaaaatgatgttgcatcatgcacattgcgaaactatgtacatagccaaattgccacacagaatcctagtaagtaaagagcaatggtggaatgacagtaagactacttaggctgtgttcggcagcttactttcccaactcatctccctcattttccgtgcgcacacttttcaaactgttaaacgatgtgtttttttacaaaaatatttctatacgaaagttgctttaaaaaatcatattattccattttttaaaaaaaactaataattaattatgcactaatgagtcactccgttttccgtgcgtgggagattagttcccaaatgcaaggaacaaacgcagcaattcatcataccatatcatgagctgcaactaagaaagagtcccaccatgccaattcatcacaccatatcatgttaaccactgttgcaacatgacatatgtcagattttcctctagttgttccaggtgcattcagaactaaaatcaacacaggtggcttgctaacgatatgaccaagaggacaccctaataactgctgtatgcaacatatattcagaggataaaatgatgctaaccataagatggtctgtgtaaattgtaaaacataactgtttcatggtcagatttgagtatccaattatcatgcattagaagacacaacacaagaagcaaaagcaaatatagaagcagtgaagcactgcctagcacaaatatttacaaaaaagaagcaaaatactagaacctttaattcattcataacaagttggaaaatgacatgccacacattcacacaatggggatgacttaaaatgattggatcacaggcaatatgttgagtagggcatacaatatcagtaggtttattctgctggtactctgctccttttgacgcaacaaccttctcaagagtctcctggtcccagtcttccatggtttctgccatgaaaaagcatatgagaatcttcacagatgaactgacgaattatggacaaatagtacaaaaatagcaattaaaacccatatcagtgtattttacctgcatcacgcttgtcagtgtaaatatcaatcttttcaccctttctttggacattaaggtcatgtgagaacttgcacttaaaacccttctggcactggccaaccttaaagaattcacacactatggacttgggatcgacacctgcataataaaatgtatgtcatcatcatcgtaaccagcatatgagttgcaacatcttacaaaaataccaagctgtgctcatcctagtgaagctatgcttcctctacgtacagcttgttttagccccaatgtgctcacaatgtacagctttgaacaaatcaatcaaaccttagcagcattagcatcaatcagcaccaatacaattagaaacactaccataccacaactgttatcctatcgaatagagattatatggacatatactccttttttccatattgacctgatgagattcacccaatacagcacatcaatcacatacaaactcactgattcacattaagtacatgagcataacaaatacaactcagtgcgcctaaatctatttgctcaaccctaaatcgagggagacatacacacataaagactgggtgatgacaaggtggagaggaggccataccaactgggaccttgggctggctgacggcgaccttgaatagatcattgagttccttctcgcgcgccttctcctcctccttcttcttctgcgcatccacatccacagcaaacagaaaaaaaaaacaacgaacatcagagaagcaaagcaatcgaaaaatagggtaagaagagcttcgatctgagcatcctgcgtgccttggcggcggtcttggtcgggtcgggcttgggctggacggcctgatgcagggactggacgtacttctggacgttcttgctcttgttcttgttcttgagcccgaacgtcttgtcctccacgaccttctgcttcttggccaggtccgccttcgatggcgctgccttcttcggcggcatcctcccttcttcttcttcttcttcttcttcttcttcttcttctt

SEQ ID NO: 70886 - DNA, 18797 bp, Oryza sativa
ggccgtgaagcaaatgagtaaggcggttgtcgggacttctagaaagtaaaaaaaacaaaccccatattcaatttttaaaatctcaatgacaataaaaaggagaagcagcgggcgaggtgtataagagtataattgcagagccgccgacggttgacgggacttctagaaaataaaaatgaatttcaacgatagttatgttcgatttttagaatcacaatgacaataaagagttagcggcggacgggctgtagaggggcatagtggcatcgtttgatgggacttctaaaaattataaaaaataaaactacaagtccatttttttaaggtttggaacttctaaaaagtaaaaaaaaaacaatgataatcatgttcgattttaaaaatctcaatgacaataaagaagggaggcagcgggcgagccgtagaggagtataatggcaaagccgctgatggtttggtgggacttctagaaaataaaaaatgaacccaaacgataattgtgttcgatttttaaaatttcaatgacaacaaagagaagagacagtggacgggccgtagaggagtataatggcaacgtttgacgggacatctagaaattattaaaagaaacccaacgtgataataaactctaaaaactacaaaatccaatttttaaaggttccaaaaaaatgaatagaaattgtggtagatcaagcaagcaaataaagaaggagatgacataaggggtagtaactggtgtgacttttaaaaactacgtaattagaaacacgagaatgataaggtttggtctttcaaagtcttaggacaatgagatagctaaatagctatttaataaattttaagtaaaatcatactaaaaaaatatatgattttgtttgggtgctagacgcgcaattgcgcgggccacccagcttgttctactaatatttggctttatattggtattaaaccaaacatagagtagctaactttgtcctaccaaaaaaattggtagcgccaaaatttacctagattataggccctggatgcacatctcttcacgcctcgctcgtcgttcgtattccgcttcgttcttcctcttgggaatagccgaacatacaggcaagtcatattagcattggcaaaagtttacaaaagtgcaacttagacacaaacagcacgcatggcagcccgtttgccacgataatgatttcatgcatgccacatgcattgcctgcctgcgcctacgtccagatcttacaaattctggacagggagaaatttgggtggtagtgagtgttccagaaactgtagtcgttagcaccaaaacaacggtaaagatccagaaccaagaataatgaaggcaagccaatcctactttttctcaaaaccagataaatccgtttccctccagcaaatggaggcaactgaaaagaggtcaaaacaggcggttgcccctggttaagtccgtctccattacgagaagacacaacaacagcaaacggcaaaggataggatgaactcttcgtatttttatattccattcttaaaaaacaattctgtaacactccagtaaaaagcataactttggggtaacattttacagtgtaaaggaaaaacagcatgcattacgtataccacatatttatccacgtcgggacaactcactgagcaagctatctaagcttggcagaaaatcagaagctcctatgtactgcaaatgtgcgcaattacttgactggaacaaactaactttaatttgcgcgtcaaaccacttggtagttataagtaaccaatcgattcctctgagaaaactttggtgggctaccttccctcagcggacggatggcggtcacctgaaacaagaatttgcaacgcaagaacataaattcaactagaaaaacaccaaatatagaaagttggactgactaagccaaagaggaacggcatgctatgttcctgactgttttctccgggctaacagtgtcataatgcaatcagttcaaaaaaacattcgaaagcccataaataaatttcagcattagaactgctataaattttcaatgattattctatagggaaaaaaactgctaatttttcaggattagaactgctgttccttaaaagtcagttttagaataacattctactatagaatggtggagaactggagatatccagagttagatatcgctgaacttttgtatctttaaatgcatgtataccattttcctaaaaaaccaggaaaggacacccccactacttggtgtaaaatgctaagtgggtggccatgcaaccttcccagagcaaattaggcgtcaagtggctaaaagacttgatgcatggaaaggagtttaatctacagaccatgggtcgagattctcagatctgatcgcacaaggggtagtgttctaaagaaagttggatgaggttgggaaggtcaaacaacaaacatacaaagttttcagcagaaagttcattgactaagaatcattattaattcaaaacagaatacacacaaccatcaccatgaaagatgccatgaaagcttcatgaacaatggtagctgtaaagtcaactaatttcaactcagcgaaaggctagtaaaaatgatgtgatacagcaaaatgcccatgaaaaattcaatcctccaagatattttgaagtgcctgattgtgtcaaattgctctgtatgcatgtaagtatggtccgctcaataatcaggcaactatggtaaagaaggaaaatcagaaagtatgcatgtatgacacagtgggatataataaccaaccttcaaatcactaaatgtatttgatgcagaaaacccaacagatatcgggaagaatgttgatggatcagctgcagggacagtgaactccaaagaaccacttcaaatgaaaaaataaagttagcatggacaccgtggagggaaaactgtgcgatactagaaaagaggataatgttgagaaaacatatacttcttgtacctgcggtttgattgatcaacaagaataatggaccactccaacactgaatttcttgagtcatacctggatgtaaagacaagaaatgaataaatgaatgaaagtaatgaagctatgcagctaaagatcagcttggcaggtgatcagaagaaacttccataaaaaaatcattttcaaacaaaaacatgagccacatcacaaattattctaaagctctaattatactataatgcaatgtataacacgagaaagcaaagccaggctagatatttatttgcatttactatttgttaacataaacaccaagacttttgtcaacgtgcagttaatgtccaatactccaaatagttctttggcagcaaaaagtatttgttaacgagctccacctttcactagtaacctaaactttaaatgctcaatgaaaacttttgcacgatcttttctttccatttaggtgcaatgttaaacttcaaaattaacagttaatagcattagagcagtcccaacccatagtgtccataaacagtgtctatgatgtcatatcaataagacatcacaatagaaactacactccacaacccatgatttcttaaagtgggccattaataaatgtatcatctctcttctctaccaatcatatttattcttcatctattatgaaaacactattctgtcccaatgcaaaacttgatagtgtctagtgcataggttctcatgttgaagctgtgtcttgcatgagacctagtttcttcctctctttactctctcttaattaatatagtgccacataagctaaaagtcctatatggcaatgtagttaatgccatagacaccatcctaggtggagggttgggactgcccttatgcatggtaccagacaattaagacaagacatgggccaagaaacattacctccattctccgtctatctgcctaacacctggagcctccctaagtgcggggagagggatagagatgacaacattgtgcaaatcaaacatctctgaagcttcatattcaatgttcacataggtttcatttccggacaccgaaggccaacagttcactgcaattggcaaaaccaggttatacatgtgcaacttagcaaacaactttaagcaaacagttctttttacctgccaatggaagagatgactcattcaactcctggattctccatttcaccaacggtgtttcattttgaccactggggaaaggcctgtttggatcttttgcccccacaatttgttgactgttgaataactctttgttgatattggggtgtgtcttgaagttaaggccaggtacatcttggttctcaatctgtcgagcacaccaaatatttgaagatttagtaactcctgattaaaactaaatttagataataccattagtcaaaagagttttgcaggtaagtgattcaggtaaatattaacttgccgatgtcaggaaatccctgagttctatagcaacttgtataatctaattaggaacaaacaagaatttaacaattaatttgtgatgaatgcaattgttcagaccaaaagagcttggttctcaaaggtctgatttatggaaagcggtgcagaacaacaattctcaaagaagcttggttctcatggcctacgaattatctgaagatattcaaaacagtagtaatttcaacaaatattcagaaatggggtttgagttgtataaagctgtgcaattagttaatagatgcaagcagaagcttcatgcaaattctcattaaaaacaaactaatagattgtgttgattccaaacaagggcataatcagactaaaagatccagacaccatatatagaaaataacctgtaactgaataaaaccatcagtgtcattcagaatttggagagccagggttccttgaatatcaaaattgctaactcccccatcccttttaacagtgacattgagcttctcttcaattgtcactgtgataggatcgcttggtgggatatatgatgaccttgattgagttgcacttggttgagtgtcctccaaaatgacttctccttcagctttcaaagactcaaggaactggtttgtcttctgtgctttgcttaatttcataccaccaggaactttagtagaagcagatgcaggagcaggagcagatgggcggcctgtacatatgccagccgtcaagataaaacagcatctagatagtcataacaccaccaaccaaaattaaccatcctatatccactagccacaccattaccctagagaatcgactttactcaagtcaaaagaggtctcaataaattgagttaaaatacatgtggaattgtggatgcaggtatttctttcttgaaccactagccatttcgttggtacttttgttgtggcagaacccatcactactttcgaacaaatcaacaaactattgcacaattaagtgattttatttatgagctacggtgttagatgaacaatgtgtaagatgcacatttgccctgcaatttggcaaatagttatgtgtattactttctggcatgtcacaactgacaaacttaaaaagcacattagtacaagtacaatattgtttgtctcacataagaaagaaaggttgtctaactcagtatcaagatcctgggtagaacctaatccaaatcataggagcacggaaatataatttaaaataactggttgaaatcctatcttatgctgcatggatgattctctccctaaatcattaggtgtatgtatgaacaggctaaaagaactgccataaaatatttactactagttttggttaccaatgctcaggaaaatttattgttacaggaatattacaagtctagtcagcttccttgataggactccaaaaggaaatgctaaataatatttccatttccacatgtaaggcatttgtttgagtacaaacctttggccttgtgggtgaacgagtccatatcaccaaatataggatcgccccctggaccaccacctctaatgcccatgtcactgaagctgtttggagttctcaaggatccaaatcctcccttgtcaggcttccctctatcagtctgcatatttcaacagattttaccaacttatataaagatgaaaaataaagctatgcagttactggttcactacgccttcaacattaatttttagcatatatttcctatgtgttcgtagatacagtttgcaacatttaagatctaaggttccatgtgatactgagatgtaactacactgaaccagataactacatgctctatatttgagtataggtagcacaaaccttgcttttctcaatctcagtgactttcctcctcatgacatccttagtttcatttattttgctttgcataaccagcttgtgcagcttttcttcatggctctccatttcacagtattgtttaacttgtgcaacagttacgttctctttgtttccaagagaaatggcttcaataaaggcaaacagaagctcgaatgctgccttacagacaccctcttcatccaaagagggagcatattcaggtatctttgtagacgttcaaggaaatcactgcattgaattggtatgcacaaaaggcaaatactaactatgtcgtcagcaacaagaaatagggtttatcaggttagtggtgactactctgttgatctttgttccaaagtgaagttgttctgcagttacacttaatactgcccttttctccttgccaaaaagaatataagttcgaatttttcattgtgataaaactattgaatgcggagctacagccttttttttaatctttctgaaatagctacatttttttaaagaaataatttagcgtttgagaatagaaatatagcacaactgatggtaggatacaagcttggagagtagccttaaagtatccagatcttcaagaatgttactttgcttatttgtgatgagaagcaaatacagtgcttcaattggttgatagacataacgaacattttcagtctcaacataagtatgttgctttccacttccgaccagcttcggaaatgctgcaagcagcccatcgatccttatccgggacatgtcaacaaattgtctcgaaacaagagctgaaatcaaaaaatgacaaatttcttgttcataacattataagtgtagacataaacagactacaaaatgcaaaaattctaaagaccaaaacttgtgcatataaaagccattttagtgttgttacttggatagaattggtgtacttgcgtataagaaaaggatgttaattgctattgttagcaaaattgtattgccccttttttgggctgcaagagctaatataagaggacatcccattagagaattgtgaatccaacaagtcaattgttcgagaaagttgtgaatccaataaataaatcaataacaaaagatactgtgaattggaaattttcaacaaactcaccttttccagacttcgatataatagaagctgcaagaaccacctgtatgtgtataaaagaaacaatcactcttcttaatagagcaaaaaaatgcaacagtttaaaatgaaacaaggataatgctcattcctttgctgtgatgcccttactaaatgtcctttcctgaatcaatttacaacacagtaacattgcaaatgagcaattcgaataaaccagccataccattttgaatggcctttttagttccagggattaccaaatccaagttgacaagatatagaactgcaagacggaaagtaatgagttccaaagcaatcgatccatgcgagacaactgaacaaaataaatttgtcaacactgcagatgcataaccacagaaaacataaataatgagtttgtcaataagtacaatgtttcttatgcttttgcgtcacatgtccaacaggatttaacaaactttattaatgaccagagaatactgccgctgttgtgatgcataaactaaataaaaaccagcacacttgaattgcatcaaaagttcaagatccaattgaggccaatcaaagttactaaaacacaataacaaggaaaaactgcatgaagttaagtgaccatcgtgaacacagatgaaatcagacatatttgggaatattggttattaggaatttatatagcataaattgctgatgatggataggcatcaatcagcataccactagacgttactacatccgatgtatgaaaaaaatacaaactttcatagatttataacaaccatgttaaaaaaaatcacataatacaaacccacgtaacagaaaaaatatgatatcaatgcctaattgaaacaacgtaaggctcaagctagttttcctaattaagcaacgtccaactagtgcagaaattctaagcataacgtgcgtatatccagagatccagactcacaaagtactgaatcacaggaagaaaatctcacaaccaaactgcttggcatgcaacactcctcgcaaaaacgcacactatcggacgatcctcatactgcacacgtaaaccgaccatccagacaaacggaacgccccggtggcgcacaaactaaattttctaagcaattaagagacgctacgaagaactcgtgcaaaccccaccggcactcccaacacgagcctggactccaacccgagagattccgacaggcaaacgcacccagcgaaatgaatcaacaaggccagcgccctgcggatccggcctccgggtggcgcgaccgaccaggcggctccgtcactgcggcgcgtcgatggcggaaggcacgagtcccgatcagatcctcgcgccccgcaccgcaggcagcacccgcgcgcgggcggagaaaaccaacccgaatcaaaccctagggctcccagggagaatccggaatggagagaaggcgaacgcgacggggagaagggaggaggtcgggtgcgcgcgtacctcagatccgcgagggaagggaggagccgagccgaggacgacgacgcaggcaacagtgagctcgctcgctcgcctcgctcgctcgcgcggtcgcgggtcgggccatttatcggtgggtggtgaactggttgggccgtacaagcacgggctaattgggcccaaaggcctagcaaataggctgattgagcccagggcctagttctgtggaagttaggcccaatattgggcattgagctatatctatgggcagagtttatgctatgtttttgttttgttagagagcatcagcatccaatgctcttgctagttattttgtgtcaaaaagaaaagtatcattggtttatgctggtttcagaaggggaagggaattccaatcctgcaaccaaaatgaagaaaaactgagagcaagtacaatagcaagctacaagcttgcttacttttttttttcttctcaaatatggagaagagagacgagaaaaagagagagcatgcttttatgcaagagtcaatcttgcaggcgatccaaaagaggtgaatgaaatagaggaactgaagaaagagaggggaggataaaaattggagacagctttgtagacaaactattgtactcctagatgttagctgcagtatactacgtgtaagagcttatagacaatagttaactctgctattaaacttacttggagaagaatggtgctttcagcgaagcaaaagacttttctttcgacaaatgattagtaagtgccttgtgcatgtttctagtttaagtcggccaccgatactactaccaaccaaataatcggcgtacctgaatacattgatatgggtatggagatgttcaggtaccaaaaccagcagaatctaccaagaacgatagacaagtactagtgtcctatataggacaagcatctagctgaactgttacgacgtgtgtaagcaatgcgtctgtcggctgagttatttggagtactagccaagcaagcatgattgcaagagcatgcgcatgcggcgtgctgatcgttgggaatacagcattctgaaatcctgatcgtttgcccttgtcgtttgttaacagtgttaccaaagcattgtgccttttgtcgtttcacagagacagccaatacagtagataagataactggcattactctgcattacctggatttctcttcttctttgaatgcaagttagaaatactgtcctgttctttctttttctgcacaatgagtccctcttaattaatttgcctgctgcaactcacagattcccagtccaccatggagtataatcttgtaataatgctaggtactagtacatgtacaaaccccaaacaaaattgtcagttggcgcaaactcacagtccacaagtacagtgcaattaagatcttatgttctctggatacaaataaaaggtggtagcaagcattcatcatccatacgacatatatatttggcactatcacattcagcaatcgcatttttggtatatgagtatgcatcaagtgaagatgtcaatgttacataatctcgctgcactgctagcagcactatcacattcaacaatcgcatttttggtatatgggcatgcatcaagtgaagatgtcaatgttacataatctcgctgcactgctagcatgtaaacctttttagcataaactcttaagtcactgaaaaaagaactggaatcacagttccatagtttccatagccaactgggtcagcacatcgggcacacatatttcataaccagaaaaacccatgtcttacaattaataggtcaacccatagttcatggagtattgtacattggaagagaagcacacacaatattagaacacaccaccatttttttccaccgcttcattttctttttcttactcttcacacacaacaatcatcaggaaaaaaactgcctgtaaacagttagaattgtctcaaatcaaccctgacaaatcatacattttcacggagggttcaacctcgactctcgagaatgcaatctaaattagaaaatacacaaaggaagaaaagcaacctaacaataataagctctgataatatgactgaattatgaaaccggaacatccttcagtgaggcaggatccaccttaggagggtctgaatgacgcctccctctttccatcagcttatctgcatgctcaccatttggtttgtctgcgactgggaaggataagcgcttctttattgaagaatggaccaggggtactctctcaggaacctcaaacctgtcagtcaatagactgcggtaccgagacttcgcccttgcagactctgtggactgcatgtagctggggagagctggtgtgcttgttaggctcgcatcatcccgaacagaggcaccacctgtgctctgcctccttgggcgttcagagcgtatgcttgtgatgctcctcaagtcatcctccttatatagccagctatcccgtggacttgctggtctgatctttccggtaactgaggggacccttgacgggggagttgatggcgattgccgacttggtggacggcttgacttgtttggtgttgcaggtctctggattgagattgcgcggggtacataagtacgagaagcgctagtgctgggattctttgttgaataatggtccttaggatccttatctgatatcactcggctctcccaaggccttgatgtcatccagcgttccatccagctccatccccagttaggattcccttgatccgtgaaggtaggtgttatagttcggccagaattcttccactgcaggagtcaaaacagagaaggggctttttttagtaacgagatatacaattacatctatcgagatatcacttaaagctacaataggtaagaataaggaggaaaataacaagaaaagtgagtaattcaaagaggaaacttgcctggtgagaaaatgcataggcaagagctctttcccgccttagcgcagcttcttgtttcatcattaggctggtctcaacctgctccttggactgatggctatgatcccaatcttcatcaatctgtcaatgaaataaaatagcatagtattgttagaaacctgctatatatcagaatcagctcattctattatagcagaacttttaaggttacataaaactctactatcatgcaacagtaatttttgctatggtttatgtttcttctattccataaataaaagtatagaatatggaatggctcaagtaggctccataagtgatttatgcttgtagactgtaaagaagaaaaaataccgataaaagaatctataggatcttggaaggattacggagtgcttaccttcattttctcaagttccctctgatgctttaattgtagctgcctttgaagagcctgtttttcctcctccatcttcacccttctagagtatatttgagtttgaactctggtcatggtttgtgtgcaatgcaaggtgtgcgcagtttgtcgtttgacggcgtttccatcaaccagcgacttcaatctaactagccctctaagtgctcgcagcgctcttcttgcctgaaataatattagttctgtaaaataagtagccacttaatgtcacataaataaaacagaacttaacaaagatttaaagctcatcaagtcccaatggaagtatcttgtcttgcttcactttgatttttatagctattatatcaacaccaacatattgtgatgtgtaacaacactggagtctggaaacatcaaacgtcagactaatgtatgtttcattttgaccagcagaacacaatattgacggtgttaccaaaatggacaaagcagaaaatgatgcatctgacagcaattttctaccaaccaaattagatatcttacaaacacttaatattagcaggctgttagctaaagtgcatgctcaggaatgaaaaataaatgcccaagacagtgacccgcacaaataacaagatataatcattttttgggtgtattcttagtgaaaagacgtaaacatgggtgacaaggacgaacacaattatactacaagtgcagttggttaccagataacccctgaaggcagtctgaatcttgatagcggcaagctcatcctttgaactaacaggcgatttcggcacagccgtggtggctgttgtgaggcggaccacctcagcagcggcctgggcagcgacggcagcagcttctgcagcaacagcagaggcaagtgcaacagagtacgcatgcttgttctgttcactgtcagtttcaacagccttgacatctttgatctcctcaggctgtggctggatagggtgtgttggcggtggcggtggcggctgtggaggcggtgctgtagaggtaggcactgccactgttgaggtccaaggatcagacttcttagactttccaaatggccatttcctcctggatctcgacttgtccgccttctcgatcttcatggtaatcaaaagatatatattgaagcaaggagaatttttatgacaagtatagcgatttattgaggaagcagataagttttggcataccttagcttccctcccatctggatcggatgagctgaagactttcttgacagcactgaaccaatttcctttcttacccatttttttggtgttcctttattgtgtcttcagctaaagcctgaaagcatcagagcagacaccaaaggttcaggacacgaatggctgtaaaagatcagctgaaatcatataaccaccagtaaaatctatggttttctgcagaattaaaaagttcgacatggtcgcgcacagaaaagagggtttttagtaagatgtgttaaagatcagaagttctgccagtattatgatactgcctcaaacccaaccggtcaagtatccccactcgtaaaatcaaagatttaattttaccagaaaatcagcatggccaccaaaaattgacaaaaaaggagcacgcaaaagccttaaaccgatcagagtaaaaaaagaagcaaggaaccgaactccatggtttggagctagacgattaacgtcagtcgccaaactccaccacaacttactacctttctcacaaaaaagggcaaaactttgaccactaaattatcctagttccgcgtgttctccttcctcgctcgatcaatctggcagcggcaaaacctctcaaaccaaaaggatcaaacaccaacccagactgacaaaatcccccacccccgaaacaaaccctcgccacctgcggccaaatcccatcacaaatgcgcagcgaaattaaccctggattcacctggagcggagccacggaaagcgcgcagccaggaagaacgccaaaaccgggggacgcaacgcaaaaccccaaaagaaagatgccgttttttacagtgagaaaaggcgagagagctttcacctcaaagcaaccaaccaccgaaagccgctcaccttcctcgcccaactgaagccgccaagaaacctaactcgagccgccccgcccctgcctccctcccaagccaccgcccaccgtccctccccctgcttctactacgggtcagatcaaatcaacgaccccagccatcttaagcggaagagacggaaaagaaaaaagaaatctcaacactcacagaggcggaaatggtggataacccaacctgtttttttttcttctctcctttttttttttttactttcctcgccccgtcgaaaggcgccgccgctttggcttttatcggcagcacgcagaattgattcgctctcgcggtcgcggccaccaccaccccggacgacgacgaccccgccctcctcctcctcctcctcaccaccaccagccgttacgtgggcccccccgcgcccccctctgaccgcgtggggaccaccgcgagcagcagcagcagcagcagcaccgggccccacgacgacgacgagccgttcgttccctcctcttcctctagtacgattctacgaactcctcctctctctctctctctccgtcgccgcggtcaccggctcaccgcaccgtgacagcggagaggcgtgtcgctgtcgcctcttatggaggcggaaggcgagcgaatccccccagctgctgctggtccatgacaggtgggccccacctcgccgtgggcgggacgggacgggacggcgcggtggtggcccacacgtcagcggcgggttttttttttccgttgcttgtacgacccgggacggcgccgtgcgggccgtgcatgcctaaccggtggcaggtacgagtacgactacaccggctcgtacacaagccgtgacacgacacctgtagacctgacctcccccaagtatacgtggtccacatgtaaaatatagataggagtctagtcctttgggtctgttacgtgggggggcggggctggtagtataccctacttgccgttaatgccgtgttaaatgaggcgtttaagcctttgattaagtgcgagtgtacccgtagatgcaaaaacgtttgtggtcttgcagagctggaaaaaaggcgatgctcggcggtttttacagagcagggacaaagctgatgagcaaccgcaaactgctctcgtcgtttgtaggagtaactttttgcaggtttttgccacccatgttccggtcgaagggggagcggtataaaacaagctgcaaatgggtggcgatggcacatcaatattcaatcatgcgattaaaatagcgttggtgtcagtgacagtgcaaagccgccaacgagatgagatccgttacttggatcgagttctttcggggttttttttttcttttttactcctctactcctactattcctgtgtctgtgtgcatgccagcctttgtgcggtgtcttggatcttgggtggggagcggccatggcctatttggcctcggttcttggtgcccttgcacgtgccgagtgccagtttgggcagccgtctccggccgccttttcaccccggcgcgccgctgccttttcacccgtacgcgagcgaaaggctctgcctttgcctgcaacctgcagctttgttgattgccacagtgagattgagggcgcgatggattgatagtgccatctgtaaactctcaccgcgccgccgcggtgaaaggttcatgagaacgtgctgatcaccgagcgccgaggcgagagctttttctgtccagtcaaataccgtatgttcagctgtgctcacatgtcatcttgaacactgctactattatgtttttgtgtttgtgtagtcacatgcactaacccaggtggctaatcattgggggtagaatggtagattatggcctctccgcgtagaatcttggccatacatactttccaccttgcactttgcagcggagtgagtagtacattaatctgctactactagttgtatatttgtatgtattcattgatatatgtacaatgtacttatcacgacactgaggtactgcgtggtggtttgatcctttcattattgtgagactacacatctctaatcaccaagacaccaatgctctcatgattgcttgttgatgcatggtcagtgacttggtacgggtgccgggcgtcgcttttccgatcagaaattattgtaccgtggtaagacctttagatgggactaaaacttttaactccctatcacatcggatgtttggatataaattataaatattaaacgtggactattaataaaacccatctataatcttggactaattcgcgagacgaatctattgagtctaattaatctatgattagcctatgtgatgctacagtaaatattctctaattatggattaattaggcttaaaaaatttatctcgcaaattagctttcatttatataattagtttggtaaatagtatatatttaatactttaaattagtgtctaaatatagagactaaaattaagtcataacatccaaacaccacctaagaatgaactgcgcagacttgaagtgggtgagcaaccgaacgtcgcacgatcgtaagtgcaatcgattttgtaacaacaaaagaataaaagagatggtagtagtagtattgattattgaagagacgagggttggttgtccatgactccacgggcaaggccacagggatcctctgtacgatcaactatacacagagagctacagtgtttgtgccatagaactctttggaccgttggatcagactttgcatgattgggactgggtctactgggagcctgggatgctacagtatgctttatgcagtagcatggctggaaaaatgtactctagactatacggctagacacacaatgccaagagacttctgaacaatagtttatacgcaaaggcaactcaatagtattaggcccctttagggcccctttgatttgtaggaaaaatgtaggaattttggaggatttcaatcctatggaaaaaaaatcttatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacggccattcctgtgtttttcctgtgttttgcaatcctctgttttacaattgtattcctgtcagaatcctgtgtttttcctattcctctgttttttcattcctacgattcaaaggggcccttaatatgtagaaaaagtataagaattttggaggattttaatcctataaaaacttcttgtgaagacctttaaaacattggattgaatcatatcatatcttttgaaatttctatagaatgaatgatcctatagaaattttggaggaaaattagtaagatattcaacatcttgaaaaatttcctttaaatatatctttctcatctgattttggtgtatttcctgcggtcaacattgtcattcctatgttttacagtgttttgtatttgcattcctgttaaggacccctttaaaacgcatgattgagaaaacacaggaataggaaaaacgtaggaatataatgtcatacttattggattcctatgatactttgaaacacaggaaagtcaccaaccgtcgttttattagcacacagaaaaaacacaggaatttttagacacacgaagaaaaataaacatgatgtgagatctcatgcttattttcctccaaaattactcaaacaatgtctattccatagtaatttcaaaagaattggtaggaaataatcctttatttctaaggactctgtagaattatttttcatagaataaaatcctacgttttttctattttttttcattcatgtgattcaaatgggtcctagcgtgcgatattacacgcaaacttttttttagaacttaccacacactaacgaaataatgccagctcttttcagcacagaaatatagttgattagtcaatgatcttaaggaaaaagatgggtttttatgggtttgatgtgcttaaccgttcacctttgcttagtaagatatcagcttacttaattttccgatgtattttttgttatacaaatttatgctgggatatcagcttacttaatttatgctgggatatacaaatttgttaacacagaaaaaacggatgaatttaagtagactagaaaaaagcagttaaaatgcactatcattttagtgtttcgtgcattaccatttaccagcatccgattatttagtaaagggagatatatttactacttcatgaaatacactttactacgctgggatgagagtgagacactaccatcacccttagcactgattatcagtttggagaagttcccagcttctccccggaaaacggagggattaattaatcatcacatgattaaatggttattaactaaaatagcttaaaatgattaatgtaatttttaaagcaacttttatgtagactttttttcaaaaaatacaccgtttatcagtttgaaaaacctgcgcgtaaaatacgaaagatgaagttgggaactcacacc

SEQ ID NO: 70887 - DNA, 3965 bp, Oryza sativa
cacaaaggcagcaatcttcttcccattcttcacaagctgcacacgagcacacttacggatggcagagttgggctgcttggcctcaataccactgcaatagagccatcaaatttctcacattagcataaactcacaaggcaaagggtgacaaaaccatattatagtttctacatacatcttctccagaacgatgcccttggcatgagatgacccagcaaagggtttcttccactcattacccaagtggctcttcttgtaggccttgtctgcccatctctggttcctgcggtgggtcttgagcttgcgcccagctcccataccacgtgtcttcctgcattttgaagaattcatggtcaatgcaactatattaaaacaatattatgatctacaattcgatggttgacatataacatagtgctagaaaagaacgcgtgcacaatgtaaagggatgaaatgaataattgaaaggggtatgccatccagattcagactattagcaagcataagaaacagtgttctttgatgaacataatatgtaataaatttgccatcagaagtcgatagttgtttgcaaagtcaggcttaagatttgacagctaaacaaatggcgattcctttaaacaataaaaatgataacagtgtatgctaccatgcataacctcccagatccaagtaaattgatccaagaaattctgattaaacagcagcaacggattgatatcgcttatgaatatgtttagtgctgacggtttataatctgatcagcactggaccgtcaataagcttagttccatcacacgcaaatttaccaatttacaagtattgcgcatacaaaactcaagtggtatattcaagcatccagctacgagggaactcgactaagccattccagatcgctaaacctatacagacgaaatccatcgcaggagagtgacggggagcttaccccatgttggcggaagggcagcgaagatctccgaggaggcgaggcggcggcggcggcggcggcgaggggagcacgagctgggagcggcggcggcggcaatagaggagagggatagggggaagggcagcgaagctatttatttgcggtggcgttgctgtctagggtttgctaatgggccttcctgcttcaagatccgtgctggatggacgacggcccagatgttgagaagtggatcgcgggagtttctgggcctcacatttttcgcttttgcttatacttatcagttaaaatttaaatttcgaagtttattttttagtatttgtttttaaattgctaagaacacgtatataaatattttatacacaaattatttttcatttaagaattatgagtcctttttttgtagcattagttgtgcacgttaaatatttaaatgcctaattactagtcgctttgtttcaactacgactatctctcgtatataatattactagatgactacccgccgtgtgctgcggaaaattaagttgcataatatgtacaaataagacgtaatttgattatcaaaactaaaataatttgatataattttgagactaaaaataattgatattgcatatttttaagagagaagaaagaagagacaatttaaaccatagatctatcatccaaaggctataaattattggggtgatgtggcttaatgagagaagagagaagtagcattatctacacttagtggggatgaactaggattcttggtttgtatctaagtgcatctaattttgaacgtagttatcgttattttttgcttgttaaaactgtttgcatgcctttcattaaactatagttgtgaaaagttttgacgaaaatcaatgcaatgtggaactggcgcctaactttagatcaagcattaaggcgcatgatccttatagttctatcagaggtgtggttccttattgtacagggatgcgcacctatgctccctataatagaaatatttgttagtggtcaatttagttcgaacaagaaagtgagtgtcagtgatatgggcccagggtaccccccatacaaagggaggaagccgcctcaaacccacgtgccgccccccccccccctccgggagggggggtgttgaagtggtggctgtttccgagttgggaccccctcctcgctctgattcgtgattcgtgtgtgcgccctgggcaggcgttcccagcgcccaactactgtgtttaatgaggtcctgtcggccgtggcacgctgtatttaatgtggcgagcatgcacactgacaggccactagcagcaggaatgacggatgtgacggcggacaggcataggacagggcgctgtctgcacatgcctactgctagcaggggacatggcctacgtctaccctgtcccgtcgccattgatgaggttttttttcctctcacttggactcggtccagcttttctctgcacaggtccgttcaagagatctctaccccttggtggggctggacgcccaaaagtcgtcgatagttaagaaggaatgacatgggcatccacccgtactgctcagcatgatgggatggggcccatgtcgtggtaaggtgcgcatggcttcacacgtcgggaggacgagagacacattaattacctatagagaatgttttcctttcccttgaagctaagtcttgggccttttgtggtaaccccttaagatataaaaggagatccatgcctgaggggaaggagaggccgaagaaaagaaagcacttgtattctcctagcataatcaaccacacataggagtagggtattacatttccacaacgcccggaacctgtataaaccgattccgtccccattgcccccgaggggcccgaatcctctctgaatcgccttcccttcatttctcaaaccttcacccgtattcctggtctgaaccataaaggggacccccacagtccttgcttgaggagtttaccctccaacagtgagcaaatgaacttatggttttgaactttagtgggagaaaccaaccactgtaccaactctaggatttttgtcttttaacagagccattagtcttttgagtagagttatgggtttcatttaccagccacctcttagtccacacccaacttgaaaagtgttatcgatacataagtcgcctttgccatcataatattttcattttttctcctttttctaccaaaccatcaaacttttattacattcaaatacaaatagtttgctgaaaaaaatacactatattcctggaaaagcaatacaaataatctgttttaccaaatcaaaagcatcttgtttttgttagtggagtgtggagaagagaccatgggcataaccaaaccaaaaaaccaaaacaaaaccgtttgtcacaaaaaaaaaacaattaccagacgccacaaaggccacggcctacagccttttcagcccacgacccaaagacattagccggaggcccagccaagttcccctatcaccatccaactcgtttccccacgaaaccagtccaccaccatctctagaactttccatctcgcctccgcctccgcctccgcctccccccacctcctaagctccaaacccaagaaaccctcctcctccgccgcccgccgcccaatccgacccgccggagcgcgaagggagaaacagggcagccagaagaagaagaagaagaagaagaagaagaagaagaagaagaagaagggaggatgccgccgaagaaggcagcgccatcgaaggcggacctggccaagaagcagaaggtcgtggaggacaagacgttcgggctcaagaacaagaacaagagcaagaacgtccagaagtacgtccagtccctgcatcaggccgtccagcccaagcccgacccgaccaagaccgccgccaaggcacgcaggatgctcagatcgaagctcttcttaccctatttttcgattgctttgcttctctgatgttcgttgttttttttttctgtttgctgtggatgtggatgcgcagaagaagaa

SEQ ID NO: 70888 - DNA, 17917 bp, Oryza sativa
tgacacacgggatctgcttctgtcgacccgtggaccgtctctgtgtacccggtccaccgtggtcccttaggttggcatgtggagtccgcatgtcaacagcgcagccttcctgtcttttccaggctagcgcttacacatgttttatagttgtaaaacctaattataataatccgcaaatctccatataacagcattaaacttcggatgaccatgccttggtcatacgaaccccgaatcgacccgttcaagtctcctaatgtttgttataacataaagaaccctgtgctttctttttatgtattgttattacttctttataggcttgtagctttgcttgtgtgcttcgcgtagcttctgtcgttctggaggttctcgaagcgtggttcgcggtcgtcgccgaaggttcggaaggccattctctctgagcaaggcaagtcacatcatccttgagcatattgaatcccagtttataaaattattttgatttaaattaatgcattatcactttatttaaattcccgcgttatcactgttttatttagccatgcctatttacctttgttatgaccttattattattgctatcgttattattaccttgttcacccttggaaaatgaaaccccaactagtgggtactctattcatggttccactagtatgaatttagggagatgcttcgctgattaattagacaacattaggtggttttataactttagactttgggaattctcatatcacttggatactatggaatggttggcttatgttggaattggacacacacctccccctctattcaaaacccccaaaatggttttaggctgggctcgaggtgcgtggttgggttttgttagtcgtacctcgggtactataaggattaagctcgggcctctattgcaaagcactaccgtacttccacatgtccagtgggtaaggcttagtttgtggctcagactggttataaacaaaagtacacggatggaggtggacgaagtcgggggtcgatggacatctctaggacaaatgaaggctacacgagctgtggcccggtagtcgagatgtcatggcacagggctggtgttctgctgctaggggctcaatcctgcctgcctgtcccggtggttccggccgtaggcggggctgggtcggtactcttgtttatggctaggatgggttgggaactatgtcacgtcttccgtccgtatgccgtggtggtatgtagcacgtggttacacgtgaggaagatgtgtcttgtgggtaaagatgtacacctctgatcagagtataatctattcgaatagccgcgccatcggttatgggcaagcctagcaatgtacccaagttagtgttttaattcttaaaacctgcttaacaactaaaatgtggaatggttggcctgggttggcttgggacgagctgagacccagggtcgggttgccagttcggtctgaatcatcgtaggccttgggttaaggcaggttcgtgagggttcacggtcttgattaataatactgtgtagctctgggatcgtctttttaaaatggctttgggcaactaagtgacttttaaatgctgtttactgcaaaacttaacccctatattattaccccttgtacccccttgcattaatcatgcatctgccggtgttgcttgctgagtactgtggttatactcattcttgctctatctctcccccctttagtaagagaagctttggagaagaagtcttaggtggagtcctggcttataccctagttgagcgcctgtgaagatggagccgtaggcccgctagtccgctgctgtttattttttgttgtcaggcctgaagtgcctttgtaataatgtaaatattatcgatataataaagatgtgccttttgtatcatgtttgtttggtgtaccccggcttttcctgggacggggattaatacactagcgttcgggaaaatgcaaattttctcggtcgcgacatttattttccgcacttaacaattgcgaaattacccgagtagtaaattctaattcgtgaaactttgttccattaatgacgaactcatgtcactcatatgcatgtttgggaagtgcctaggccgactcccggtgcttgtgggctatgactagtcgggcagagtgtttaaatgtaaggagtcatctgctcggggaaatcaaaattgacaaaaggagaaatacgtatttataaatattttaaaaatacttgaattttcttcgagtattatatttacatcagatactactcatcctatatttttgttctacaggatccagatccagatatgcataaaagggattcatggctttaagcttatctcttacgcttcaggaattgatcagtcagaacatcaccaccggcttgccgtcatcgccgccgactggtgtcctcgcctttacggttgggtggtcaccccgccgttgctgggcatcgttgtcttcaccgaccggctgcttcatctgccgccgactggtgtctctgcctatacggttggttggtcacaccaccattgttaggcatatacgtcttcaccaccggcttgccttcgccgccgacgactggtgtctccgcctgcacggctggcctattatgccgccgttgttgggcgtctacgtctccaccaccggcttgccttcgtcgctgacgacaagtgtctccgcctgcacggctggcgtattatgccgtcgttgttgggcgtctacgtcttcaccaccggcttgcctttgccgtcgacgactggtgtctccgcctgcacggctggcttattatgccgccgttgatgggcgtcttcatctcaaccaccggcttgccttccccgccgacgactggtgtctccgcctgcacggctagcgtattatgccgtcgttgttgagcgtctacgtcttcaccaccggcttgtctttgccgccgatgactcgtgtcttcacctacacggctggcctattatgccgccgttgttgggcatctacgtcttcacgaccggcttgccttcgctgccgccgactggtgtctccgcctacacggctggcctattctgccgccgttgttgggcgtcttcgtcttcatcgaccggcttgccttcgccgccgccgactggtgtctccgcctacacggctggcctattatgccgccgttgttgggcgtcttcgtcttcaccgaccggcttgccttcgccgccgccgactggtgtcttcgcctacacggctggcctattatgccgtcgttattgggcgtctatgtcgtcaccgccagctgccttcgctgtcgacgactggtatctccgcctgcaccgctggcctattatgacgccgttgttggatgcctacatcttcaccgaccggccacctcgtatgatgccagctggcgctatcgtcttcacggctggccatgtcgccgccaccgctaataggcatcagcatcttcaacgcgtatgacgccagctggcgctatcatcttcacttccatggctgcatgattctgccagtgttgattggccttatcgtcttcaccgctggtcatctcgtctgctcctgactagtgccgtcgcctctacggctggtttatactgctaccactactgatagacgtcatcgtcttcattgctggccgccttgtcagacgccgactggcttattcgcctccacagctacgtgtcttcgtcaacattgactggagtcatcgtcattaccagtttgcctttgccgccgcccatggtgtcccgactctatgttcagttgtttctcaactaaccaaagagtcgggggctacataaatacaagactcaaaattcgacagatattatgtcaacatgaaggaatcaattaaccagccaatgagtcattatcttcatcttcgcttaagagcaagctttttacttcatcaactccaattatttcaccggcaattttggcttctccgtcatcgccacgatctacttcaaatttctcaaatatcaagtttgagatataatttacatgtccgggagttcagagttattaaccaatcagctcagtttcgacgagttggacaacaacatctactttcctccaagtagagcatgtgcaacaactataacaccaagttctactgacatctttataaatcaaggatcgttgcatcagtcttcgttatgcacacgctcgcatcaaggaaattactcgagcttcgatatcttctcaacagtttgatggattattatcattgacatcatcatcagcacctctacttcatcggctttgacatctctgccgttgctaatggatgactacgtcttcgcctccggttgcttccgtcattgccgacttgttatttcgccttcacaattgacctactatgcaaacgctgatgagcgtcttcgtcattatcatcggttgctatgctgctattgactggatcatcgacatcgtcatcttcatcaacatcctgtcaagcctcttcaacatagcctactctgctgctgtttgatgggcaacttcgtcatcatagtcgatcatctatgattgctgcttatcatcattactgtcggttgcatttgtcgtcgccgactattttcttcatcttcatgattggtggatttcgtcatcgcctttgatgcgtgtctacatcttcaccgtcggcttgctttcgtcaccaccgaccggtatcctcgccttcacggatggctaattatgtcaccactaatgggcgccttcatctccattgctggctgacctgactgctgccgactggtttcttcgcctccacggctatgcgacttcatcacctttgattggtgtcactgtttttactaccactgacatcttccatcacctctgatgagcaatatcatcgtcatgttggtcatttcatctccatgccgactgcatcagctacaatcaatggacaattgtgactacgacggaaagataagctacatgcataggggctcatcaactcaagcgcgaggattatatcttcaatttggactttttccagatacattcagcttgaatttatggtcatgagtcgatttcttatgctcaacgactggattattcattattccccgtaagggctatcaaccgaatacttgcgccagtcgggattcaatttttatatctattttggagtatcccataagggataatcactcagatcagaagctattgatatgagctacacttggtctgtatcacccggaagatttattactcgggagcatgttacatgcgtcatcctttaaagggagtcgaagacatatttttttggcctaggtctaatatgtctgcagcccatattttcaggtgtggcctgtcacgttcttttagggacttaggcactttttgcttaggccaaagtgcgtgtgatcaagtgcccaataccttaaaatccttttataccgcagtcactcaactttttacgagttggtacaatgtatcttaaaaggtgtcaaacagtaaagctttatatagctgccccgttgacttttttatataagtcaaagtgttgtttgggtttttaagcaattgattgaatacaatatcgttactttttgccacgtaagtgtgcatttttattgaccaatattatggcttaggctgattatatatcttggtcattttctaggtggttggtaaatcttttatgagtttatttactcggatgttagtacatatgccatatatttccaggtgtgtaccatgtctcttttagggacttaagcacatctgttaaagcagtgtgcgcatggtgtatgcccaatactttgaaatttctttattcacagcattcaagcttttttatagctgttttgctatgtgaattttcaatgatgtagtcaactttaggttgctcgcatctatgtttacaaagcagtcggtatatcacttggttcatgttatttggtggattcactccatatatgctatatattgatatcaagtcacttggttgactataattatcgagaaccactcagttggttcgattatttattccttgactatatgcttggtttgtttaactaaccacatagtcggaggctacacctattaggtgcatctagtcaatgcacctaagtttacatttcattattttcagccctccccagtcttcaaatttgataaaagtactcggaagaccatggcaaagatgattgaagcactcggctttagagtaatctggttcgagagaagattatcttttcgactgtgaaggtctcaggggctactgtggagataatgggtaccccatacccacactgcatggttatctgactagttataggagataactaatatctatgaaatatgtaacggatcatgacttgggtattacgtttccttgtgtattatggaacggcctaaagtcctggtttgataatattgtaaagtagatttaggaaaccgataccgtattggttaaggtttctatcttgtaatcctgccccccatcctatataaggtgggcaggaggccctctagggggcatgagacaactagatcgtcagatctataatacacccggcggattcaaatccccaaacaggagtagggtattacctctcatcgagaggacctgaacctgtctaaatccttgtctctgcatccatccacttttaggtctcgtgcgctacccccttttattattgccgaattcatgtttcgacatacatcatgcctctgcctaattgctattaaatcggacaatttcatctcatgaataccactgtagaaataactgtgaaactacttctccaaatcggcccaactattgacagagttgtacggcaaaaaagaaaaccaagtaaaagccgatccgaataaagacaaaggaaataacctaactctcaaggcatcaacagctgatgcttctccacattgagctaagaatcgggtgacatgttcataagtggaaacattatcttgccctgaaaattttgagaaatctggcaccttgtacctagcaggaaatgcaactctttcgaaccactcaggatacggatgcatatacaagttcccagtgtcctttggcttgagcccgaactgttccctcatcacatctgcaatcatatcggcccaaggtctctgctgaggtaccccttgtgtatgctgctgtatcggctcgaactgattgaattgaggagcatactgaggctgagttgaccccccttggtggacatgaggtgatggaggctggtaattataattcaagtaacccccgtggtaattttgggtattcggttgaatatttgttaacgaccaaatttggtaacctaaagtatcgaagatgaagatcagatcgaagcggaatccaagaccaagattgtttcggcaacagagtaaggatcgactgaagtccaaatcggctacaatcgggatcggcagagtccgagttggacaaggttagccgatcaagccgaatccgacaattgtatctattaattaggatatttcatggaatttccttagagatatgtttgggcaaaagtctgctgcaaagacttatagtatcttagagtttgttagagacaagagtcgtgtccgacatggacatattttgtaatcttgggtataaatagaccccaagccccatgtaatcaaactaacacacgttcaatacaatcttggcacatcgccacccttttactttcactttgtttcgacgagttcttgctttcggattgagctgcattggtttcgatcttcaactagaggtaaaacttagtatggcggcttgtgttctcgggattagtgcttccatctttatgataccctaatcttgtctatgtaattcgtcgagttattatatattctatataatccacgacaatatcgttatttaacctacaatgggctaacatctatcatcggaaggaagccgattaggttaaatagcaacgttggcttcgattgtataggatatccaccaccctatgaaacatccagcggcttgattgtctagatattattcttcttttcatacttagtgctgtatcagttaagtttgatctactaagtcgtgcttagaatattaatctctagcctgctttctagttgcccattagagtagtatcggagtttcagccgatcttacctgatttaactacttttacgttacatgattgattaacatgttaaatccgccctttacattaagatcttgttgtaattagatatgttaggcttctgtttgacgtattttacttgctttaatatcttaatatagagtggtatcggagtattagccgatacatgctagatctatctgatcggctatgttataaacatatataatccggttgttaatatatatttcgatctaagtgatttatactgtctcggcaaggcaaccgatttatcccaatcacttgatttaaatttatatcgatataaggattatatgttgttaacaactgtagccgatcgagtaaatttagttctttattacttattcacgattatcgatcgatccatatatgacatcggttcaaagataaatgatatgtcatcggcaattagccgatcggctatcatttatggatttaaccgcggtttccctgtctttatttcttgttgattgcaggatcaaatcaactggcacgatcacgaacctaaaggcaagcttttggacctgcactggagttaagcagatctcccaggcctcgtgtttttacatcaacacgcttttggcacgcccggtgggacagagtttttagcaacattctctcatggctgagaaaccaccaccatcaccgtcttcggctggtaaaggatttcctcctaagactgataatcaaaagtttggtgcatctaaagttaatgagggaaatattgttcccatcaatttaggtaaactgacaccggaacaaaagacagagctcgaacagatgatgcagcaaacacaacaccagttcttaaactcgttcatggagacccgtaagggaacagttgttcagaagtacaaaatcaaattagtaactgatgttcctgggatagattcttctaaggatggagaagtgcaacaagccccggctggtacagctgaaacgggaaaccaaggcattccagagggctcaggagataaaggtgacggcacctagggggtacaagttgaggatcttggtccagatggcaattcgacacaattacagttcaataatttcaaagattggattgactatgctgtgcaacatgctttgatcaaccaatctggagtgttagtcaatactttatcaaatatggtgaagtcaatggttgatggttcgatagctgagtatcaagccacagtaccagtttatttagcaggaggtgttttcccaaactattggcctttgattacagataatcagccagctacttctaatgtaccaccagttcagccgactgcgccgatattagctcctgcatttgctgcaccagcatcggcaccagggcaattgatcaatcctcggttgttggtgagagagcagccgcaacacgctggtcagaatgttaatcggctgacccaagaataggtcactgctatgtttttaccaactcagcctaccgttgatccagcacagcaccaaccgattcagcagacgccatcgaggcaacaggttatccagccgattcaacagacaccaccaaggcaacaggctattcagccgattcagcagcaaggttcgctgaatgcatcggctgggttgatgacgcctggtaatcagccaaggcagcatgtcatgactcaagttgtccctgagaatttggttcataatgtgcaaccagatcaatcagtgatacctcaagtcgttcctgaacatttggtatgcaacatacagccgaactttcagaattatcaagggggcaatttgaattaccaatatcagccaccatcgccacaagtttagtatcagcaagggggtcagctcagcctcaattcgctccttagatcaatcaattcaagcccatgccgcaacaagtgcaaggagtacctcagccaagaccatgggttgatatgattgcagatgtaatgagagagcagtttgggcttaagccgaaggatgctggaaatttgtatcggcatccataccatgagtggtttgagagagttcaattgcctaatcgatacaaagttccggatttttcaaagttcttgggggcaggacagtgtttcaacctatgaacacgtcagccgattattagctcaatgtggcgaggcatcggctactgacgccctgagggttagattgtttcctttgtctttatctggatcggctttcacatgattttcttctttgccatacaattcgatcaacagttgggccgatttggagaagtaattccatagttacttttatagtggggttcatgagatgaaattgtctgatttgacaacaatcaagcaaaggcacgatgaatgtcacagcctgaatttcgtttcaggatttataaattatttaataaattattaatagaatttatattaaatgtttattaatttacaagtgaagttaaatgtgggaaataaaatttccttaatttaaaacatggatggatttaatttgtattaaattctccatgattaattatactctctgaaattttctcggaattttcggagctcaattcctaatgttaataatacaaagaacagtttagcaattatttaaataataaattaatcattaaatgatctggatattattatattaaatactttgagtgtccaagtatgttcaagatttttcttggaattatttgagcattgaaagtatttttaacaattgaaagatcatctcattggttaatttatttggaaaagtaataaaaatcctcctcctcagcctgggccgaattcagctcattccctcccttcctctcagcccggccgagagtctgttttacctccccctcgctacagtactccatcttcctcctccagccgactgtctcccgtgccgtgcacagtgccgccgattcccttccaaaatccggccacctcattgctcctctcaatctcctcttccttttccccaagaaatccccaaatgtttctatggaaatcctttccaatttcgcggttcaacctttcctttttccagcgaagatctaaactttcccgagtttagatcccggcctcccatggctatataaaggaccccctagtcgtcctctccctatcccctcaagtcccgtccgccgtcgtcgccggaatcgctctccccgcgctctccctctctctccacctccggccgccgctccagccgccattcgccgtcgccccggccgtcgccggtcagcaccgccacctccctcggcttcgcagtgaagatctctaccccggccacccgttcttttgcgccgaaccccgccggaagtcgccgtcaccgtgaaggccgaaccgttgccatgttttgatctccggcgaagctttgccgtcgactccgtggtcgccggacctcgccgtatccactgtcggcatcgcagcagtgaggagaagcccggcagccatctccccgaagccgaaatccatcggagcaccgtcgtcaccgtgaagccgatctgttccatcttcagtcgcgccgttcgtcgtcgtccgtcgtcgccctcggtcgccgtcgactccattgggttcgcaggagcaaggtgaagcccggccatcggtttttcttcgccgaagatcgctgaaacgtcgccgccgtggacagtacctcgccgcccttcgaagctcgtcgtcggccatcttccgtcgctgtccgtcgttgcgtaagtgttggtaagaatcgccgtcgccttctctacctcacggtgccctccgtttgcattattgtgccatggttcgccggcaaccgccactcctatgccgttcacctatgaggttttccctagggccttaatccgatctaacctaatccgctgtctgtctagcgtagtagtcgtctccgtgtgttgccgccgggtagccatcatcatctctccctctccgatcattttggttcggtgagacttctatccatgttccctcggtttagtttttaatctctcgtttttgtcatcgagtagccgtcgccgtgccacgcttagctgctgccctagcgtcgccgctgcgctagccgcctagccgtcgctgtgccgtcatcctaaccctagccgcgtgtctccgccaagtcgccgctgcctagccgagccaagtcgccctagtgccgccgtgtcgcagctatgtgccgctttaacccagccgccgctttagccgttgctcggtagcgaagttgtctagccataggtgcatccctaaattcctatcggcctatcgtttgccgtaccggggctttaccgtgaatcgtgtctagcctaccggtttagtcgcagctgttgttgagtcgttcactcgttcgttcaaatgaggtgttccccgtgcttcgttcgttcgtccgtgtggagctgttcagagccgccagtttcgttcaccggtttcggttgatcatttcggtgatcccgtgtcacgtagaattgacttgttgagtcgatatctcgtgaggctcgcttgccagatcaatctaagccatccgatcttggtcaactctcggtcaagattaatcttagccgtccaaaattgatataaatccgttctctcttttcaatgacatattattcctttttaatatatgtcatctaccaaatatgatctaatctttttccggaggatgttttaatcttctgtctcagctataaatcatttgtaaattgtttaatcaatttggaatagtcttttctttaataggtttaattggaattaaatcttgtaaaattcgtaactaattcatacgaaatcggaatgagaccattcaagtctctaaatttatctaaaatcataatctacatgtttgtttactttatatgaattgtttatttggtttttattagtctttttcctcgttttgcgtgatagcttgtcgtttccgtcgttgcgaaggttcgtgagtgcgtcggaagtgttcaagaagactaattgaagaccgattattgcaaggcaagtcacacagatcccaaacacaattcctttgagtatgttgatcctatatttaaattctttatttatttcaactgtgcatttattttcgaacgtcatcgggtggtgtgaacttattcctttgttatggccaatttgcattgattaccttatttcttgattacctcaggttataatttgactagttggatttatatattggttcagctagatgttagacataattgcttagccatgcttagagacattagctcatataaatgggataacgtatgattcaccattatttaatgatggcttaatgatagctcacgatggtcaatcgtgattggttaattaattacttgccaattaaaacttgataatggtgggttgtgagcacatggttttgatggtcgtgctcatgacaattaaggaccggttcacgagtttcggttgtgaaacattgtcacgtcccaaaacgactctaaaatacatcctctaaattatgcctagaataattaaaatccgtgtgaaagcctccaaaaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaagtcccccttccctcccttgggccggcccggcccatctctcttccccccctctctctctcctctccccacggcccactcggcccctccccgcgcgcgcgtcgctgacgggcgggcccgcccgccaccctcgctgacgggtggggcccacccgtcatccccgtcctcccgccgctcccgccgctccgcccgcgccaagcgccgccgccgccgccaaatccgccgcatcccgccgtccccgcgtgcaataaagtgggggaaatcactccccgtgatcccctctccctttccccccattttcccctctctctcttgcgttcaaacgggcggatttgcccccgcaaatctcgccggcgccatcgatggcggccgaccccccgcgccggtttccttcccttccggccgctctctcccccttccaaccctatttaaaccctccccgcacctcctccgtccgtttccgcctctcgccgcccatcctcctcgccggattcgagctcgcgacgtcgctctctctctctccgccatcgccgccgagctccggtccgccgccgtcgtcgccccggaccgcctccgacctcggcgccgcctccttcgggttcgccgcatcctcgccaacctcgtccacctctccgtttcggtcgccaaccgccagaacgccgtcgaccccgtcgactcgagccacgccaccgcctccctccgctccggccgcctcctccgtcgccaccattgccccggggtgagccatggaccgtcgcctcctttcccccttccctcccctctctcggccgctgctccgccgcgccggtggtcgccggcggcggccatcggggcgcgggcgcgccgtctcccgccgaccgtgccggcacggccaccctcgggcgcgccgagtggctgccgcgtggggcccggccgtcagccgcccgcgcccttgggtgcggctgacgcgtgggacccacggcgccggccggtgtgagcccgggtgcacccggtccaccgtggaccgtgaggctgccgcgtgggccccactctcgtggacccggtccgcgcgccccctcccctcggctgacgcaataaaccctttttaaattaaattttaaatgaagaaattcgcaaatattcatttaaagagcatataaacttcaaatggccgtaacttggccatttgaactcggaattggaccgttcatgtctctaatttttccttaagaagtcaagaacccatttttgtgctttgttcctgctttttatatggagtttattatagtaaaagccttttcttttccattggtcgtgtagacgctgcagcttcggaagatccgctcttcgtggaggttgaagccgacgtttggaaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggaatattctcaacacctggacactatgggatggttggattattatggaattggattcacacctccccctctattcaaaaccctcaaaatggttttagggtgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgctgccgggggtcgatggacatctctagggcaaatgaagcctacacgagctgcggccgggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtatatcgtggtggtatgtggcacgtggttacacgtgaggaagatgtgtcttgtgggtaaagatgtacacctctaatcaaagaataatctattcgaatagtcgcgccctcggttatgggcaagccgagcaatgtacccaagttagtgttttaattcttaaaacctgcttaacaactaaaatgtggaatggttggcctgggttcgcttgggacgagctgggacccagggtcgggttgccagttcggtctgaatcatcgtaggccttgggttaaggcaggttcgtgtgggttcacggccttgattaataatattgtatagctctagaatcgtgtttacaaaatagctttgagcaactaagtgtcttttaatgctgtttactgcaaaccctaaccctttatattattacccccttgtactcccctgcatttattctgcacttatgggtgtgtcttgttgagtacggtggttgtactcagtcttgctcaatttttcccaaacccagaagaggagcccctagaagatgaaggctttggtgtctagctcgtgcctgccatcaagcgcctgtggtcgtcgccctagtcttccgctgtttttcgtttgtcttcttgtgtgctgggtcttcgccgcccatgtaataaattaattaattatgcttccgcttgttaaactctgaattgtatcaacttttggtgtaccttgcctcctgggacaaggaataatgcacgcacgtaaggaacgcccattgggttatttccggtcgtgacaaacattaaccgtgccaaccacaagccagcgtgggcaacggctttaccttttgtatagtatggttcattgcggagcaccagactgagaagtggccgagataagcccacgggggtcgctggggagtccatgccttgttttctaagggggtgattatgatccaggaacggtgcactgtggtgaattgtgttgtgcgaggggtactgtcacagctcctttccgaggtaccgtgatggtattgaggcgcatggtgacaagtcgtggggctgtgtcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatagtacattcctggtttggagataggtctgtgcagccgggtatggttgttcaggatggttgggcctgatcagcatgggtgatgctgttcagtgttgattaatattgatgattaattactctactgttttgcaattcttaaatgtttgctaaatgctgcttttgcaaatgagccctatattatgccatcctttggtatccttgtgcagttgcatatttgctgtgtggcttgctgagtatgtcatatgctcaccttgcaataatcaatcaaactcagttgaagacaagttgcgaaggagaagacgtttggcttatccccatttgagctgcctgtgggagtggagtcggagcttcgctagattttattttccgctgcagttttcttcatggtgaggacaaagtgcctcttaagtaagtatttatcgttttagttaatttgatgaatctgtatattaaattgtcagtttgtgtacctcggttgattcctggacaaggattttatgcacaaataagttcggaaattactagtgaatttctgggcgtgacaatgaacctgtgcaagattatattcagaggttcaagaagatgacgaacaggtgctacagcttgagtttgaccgatgttctgctagccgatttagccttttagggtctgatagcttcgatcagggagaagttctcatctcatgactttgatactttattacatcttgcacaaaaagtgactttacatgaacagaggtttgcggaagccaggaagaacttcaaaaagattaatcatgtctgtccttatatctatgggtccaacgatgatgatgatattgactccgaagtagcagcagccgagtgggttagaagtaagaaggttataccgtgccaatgggtgaaaaa

SEQ ID NO: 70889 - DNA, 12393 bp, Oryza sativa
gcccccgcaaatctgcgccggcgccattgatggcgaccagacctcccgcgcccgtttccttcctccccggccactctctcccccttccaaccctatttaaaccctccccgcacctcctccgttcgtttccgcctctcgccgcccttcctcctcgccggattcgagctcgcgacgtcgctctctctctccgtcatcgccgccgagctccggtccgccgccgtcgtcgccccggaccgcctcccacctcggcgccgcctccttcggcttcgccgcatcctcgccgacctcgtccacctctccgtttcggtcaccgaccgccggagcaccgccgtccccgtcgacccgagctgcgccaccgcctccctccgctccggccacctcctccgtcgccgccgtcgccccggggtgagccgtggaccgtcgcatcctttcccccttccctcccctctctcagccgccgctccgccacgccgatggtcgctggcagcgaccatcggggcgtgggcgcgccgcctcccgccgaccgcgtgtcacgtcctgataaattcatcccgaaataaaaatcattttctaaaaggaataatagaattaattaaaattcgaaaagaaattgacaaacactaaaatacgtgccagaaaaattcgaatgtggtccgaagaattttttgttaaattctacttggtctaaaaggagccctcaaattttacttgaattttcagagcaccgaaaatatttattaaacaacaacaacaattatcagagtttactcaaaagaaaaactaaaaataaatcctccttcctcctttgggctaagcccagcccaaagtctccctctcctcccctctctttccctcctctcccgggccttctcctcctcctcctggcccacctcttccctccccctccggcccaactccctcccctcccctctctctcccgggccttccctccctccactcctcctgggccggccgccggcccaagccgcgcccaagccaggccgagccgagccagccgtgcacatgcgcgccgcgcgtgcgctgaccgcgcgcccgacctcgtggggcccacgcgccgatcgtctccttcctcccgcctggctcctctctctcccgtgaaaccctagctcgctccctcctccaaatccgcctcattcaaaccggggattccaaaattaagtggggggttttaatccccattgattcctcttcaattccccccaatttcccccttgaatgccgcccccaatcgccgggaacgaacacgccaactccggccaccttccatggccgccggccgtgtttcccgtcgccgttccgccctctcccgtgcccggctccctcccccatcctataaaatggaatccccatcctccgttctatcgttttagcctcatcccgagcctccccgtggtcgtatcacctctccccgccgtcgcccttctcttttccccgcaccggccgcctccagccgcctctccctcctcgcccgagcgccatccggccgtgccgtcgcctcctccagcgtcgcagccacctcctctccaccggcctgccctccgtttcacgcggtgaccgccggaggcgcgttcccgccgttgtccagtggcattgccaccactgtaccacctccagccgcccctgccgcgccgctcaggtgcgtgccggccgcgccgtctcctccttcggcgtcgccgcgtcgacctccaccccggcctgctctctgattcgtccggagaccgccgtcgccgcgccggcctctccatcctcttcgtcgccggcgtcctttcggccgccccttcctcctccccggctcgtcggctcgctgcgccaccaccacccccggcattgcagcggcaaggtcgccctcggcctcgcctcccctttgtccaaacccctccgcgatccatcgtcgtcgtctccgttcgttctcgtcgtcgacgtcccgtcgatcgcccggctcgtcgtctggctgcgctgccaccgtcgtgggcatcgctgcagcgtgtcccacgccgtcctcacctccgtgcagctgctgccggctgccctcgtcgcctccctgtcggtcgtcgtcttcctccttcctcctcattgtggcgttcgtccctccgtcaagccgatcgcgttcgccgcccgcgtttcgtcaagtgtgcagcagccccgtcatggtcctcgtcctcggctccgcgtcgtcaagccttgtgccagccgcgtctcgccttcgtccaaggatcgccgctgaagtcgtcccctcgccgttcgtctccgtcgttcccggccgtctccgccgtgcccgttcgtcgttgtcgttccctcgcctcgtcgcgtggtggtaaggatctctccttcgctgccccgtcctcgtcctttcggtgtcgtccgtgcccgttgtgcggttgtcgaccccggtacccgtgtgccggtgtcgatagtcgttcgctggtgcgtgtggtgaccgtgttagtgtgcccgctcggtagccgcgtggtttcgacgtgtgcaggccgtgtggtgtctagtggaatccgtttgtcggccactcgcctcggttgacacacgggatccgcttccgtcgacccgtggaccgtctctgtgtacccggtctgccgtggtcccttaggttgacatgtggggtccgcatgtcaacagcgcagccttcctgtcttttccaggctagcgcttgcacatgttttatagttgcaaagcttaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtccttccggaggttctcgaagcgtggtttgcgatcatcgccgaaggttcggaaggccattctctctgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccgaccaatataaggactaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaattaaaatgtggaatggttggcctgggttggcttgggacgagctgggacccagggtcgggttgccaattcggtctgaatcatcgtaggccttgtgttaaggcaggttcgtgtgggttcacggccttgattaataatactgtgtaactctaggatcgtctttataaaatggctttgggcaactaagtgacttttaaatgctgttttctgcaaaacttaacccctatatcattaccccttgtacccccttgcattaatcatgcatccgccggtgtggcttgttgagtactgtggttgtactcattcttgctctatctttctcccccctccagtaagagaagcttttgagaagaggtcttaggtggagtcctggcttataccccagttgagcgcctgtgaagatggagccataggcccgctagtccgctgctgtttatttttgattgtcaggccttaagtgcctttgtaataacgtaaatattatcgaccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctttggtcgtcgccctagtcttcgctgtttttcgtttgttttcttgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttatttccggtcgtgacacagccggaggagaggacgacgctgcgacgtcgacggaggagacagcgacgtcggtcggtgctcgggcacggcggaaggggctgccggaggtggtgcagtggcagcaacgccactgtttaccggcgaggacgcgtctccgatggtttccccacgaaacagaggcgacgtcggggaagaggatgcacctgcgaggccgagggtggcgacggcgcaaccggacggtgcacggtcgtggtgggaggtgcggctggaggtcggccggcaccggagagagagaaggagaaggcggggagaggcggggcggccacgggagagcgcgggagggggctaaaacaggagaacggaccgagggggttccattttagagatgaggggagggagccgaccatggcggaggtcggaacggaggtgggaatggcggccggcggccatggaaagcggcagggtttggcgcgtccgttctcggcgattgggggcacgaatcaagggggaaaacaggggaaatcaaagagaaatcaatggggattaaaaccccctaataatttggaaagagccggcttgaatggggtggatttggaggaggaatctgcgctagggtgttatgagttgtgtttgctgtagcttgtcagctgttgccgttccctgtattgagtgtaacagtgtgttggggcctggcttgttgtgggctgtggactgggtgtgtgtgtgtgcttttgacgtgccgtgctgggctggcggtcgcgtcgagtgcgtgtgccttgtacccgttaaaagggaaactccctgccgatgagcaagtatcgatgagaagaaatcaaatacaatcgaactacctctctctctctctctctctctctctcaggtcatccccttcctctctaattcaatccaaatcccctagcgaattctggattagcttggcgtgacgccggtggagtctaggagttcgtcacaatctgattccgctggcgatgaagaaggggccaaatctcacggagaggatggttgctgtgaaggcagagctcgtcgatctgaatcagcgagttggggagctcgcaagcaacctcaacgacctcctggggtcactgaccaagctggagacgtggattccatcggtggacacggggatccaagctctgaacaaggccgtggaaggaattgccgcaagggtgacggttctggagaactcacctgcagcggcatcggggatgacgaccccaacgcccatcgggcacggcgaaaccgagaatcaccagggagacgaatccaaagccctcgcggctcaggatcgattcctggtcaagggtaagtcccgattccctaactctcccatcacttttgatataggagagtcttcagttcagaatcaatccagcaatagattccatggtcctaggcttccaaagtctgatttcccaaagtttgatggtgacaatcctaagctctggaagaagaactctgaaaagtattttgaaatgtatcaagtgtcttatgaaaattgggcaaaattttctaccctccactttgtaggaaatgctgccttgcggctccaaacaaatgaggccctccatagtgttgaaacttggcctgaactctgtatagcagtgcatagcaaatttggccaggacaaatatcaggaacatttagaagagttagaagggcttaggctaattgttggtgttgaggagtattataccaagtttgaggaattaatgcatagggacagtttataatcaggcctatgatgaaacctattttgtcacaaagtttgttgggggtctaaaaactgaaatcaaagcagctatcaagctgcataggcccaggactgttgatacggctttatctcttgccaaaacgcaggaggaacttgtcttggagttgaagaagggtactcaaaagctggggtacaaacagaattacaagtcagcggcaagggaatattggggcatgctcctgatgatgctggaaaaactgaagagaaaccaaaatgggaggacagatttgagtccttgaaggcttccaggagagctaaaggagaatgtttcaaatgtggagaaaagtggggacctggccataaatgctaaaaatctgttcagttgcatgtcttggaggaattacttgaagttcttcaaattcaagagaatcaggaagctgggcaagattgtgaatcagaaggcagtaatgaagagttttcaattttggggatatggtttatttgaaattacaaccatatgttcagatgtcagttgctaacgtagttgtcagaaattgtgtttaaggtactttggtccatacaagattttggagcgcattggagaggtggcatacaaattagacttgcccccacaaaatcaagttcatccagtagtccatgtgtctcttctcaagaaggcaattcgtcctgatgtccaagttcaagccgatcttccagcaaattgcatggcagaagatgcagcagttattcctgaagaaattttgcaccgccaactcatcaagcgaggtaaatcagctgtgcccaatggattagtccgttggactggtttgcctgccgctcttgctaaatgggagaatctacgacagctgcaatttcgtttcccatcttctccggcttggggacaagcctcttcttaagcgggggaaattgttatgagttgtgtttgctgtagcttgtcagttgttgccattccctgtattgagtgtaacagtgtgtttgggcctggcttgttgtgggccttggactggattgtgtgtgtgtgttttcgacgtgccgtgctgggctggcggtcgcgtcgagtgcgtgtgccttgtacccgttaaaagggaaactccctgccgatgagcaggtatcgatgagaagaaatcaaatacaatcgaactacctctctctctctctctcttagttcatccccttcctctctaattcaatccaaatcccctagcgaattccggattagcttggcgtgacgccggcggagtctaggagttcgtcacatagatttcacgggtgagagaggaggccgagcgggaggaaggaaacgatcgggtgggtgggacccaccggtcaggcgcatgacgggcgctagagggaggcggccgctcggcttgggccggggcaggcccaggcgggaggaggagaggagggagtgggccggccgggaaggagggaatgaaggaaaagagagggagggaggagagactttgggtcagccttggcccaaaggaggaaggaggattatttttagtttttctttttaataaactttgtttattgttgttgttgcttaataattatttccagcgttctgaaaattcaagtaaaatttgagagcactttttagaccaaggagaatttaacaaaaattctccgggccacattcgaatttttcttgtacgtattttagtgtttgccaatttctttttgaattttaattaattctattatttcttttagagaatgatttttatttcgggatgaatttatcaggacgtgacaaatccacccccttacaggcatctcgtccccgagattcgagaggcttaggaagaagataggttggtcggtcttctcttcttgcctgacttcttccgttgcgtcttgtataccaaacttgtccagcaaaccttccccattcggaactgtttggcttgatctcctgttgcagattgaatcttctcttcacttgacttatccctggttgcacctctagctgacttcgactgggttgcggcacttgaagatggggcttcagttcgagaacttctcatagttcatatcttgggtgtcaatctcatgcaagttacccacttcacgttatgcgtcgatatcagcttgtcattactagaataccatgcttgtcatttacttctaacttgccaccaactgcctcatattagctttcctggtctccgagtgctagctacttctgctattcgatgcaagggtcgataactttgcctttgaattatgtttctcaatagaaccaacttatcccacttgacatgctttgacgtcttcccaaatggctttactgctagacttgttattgtttgatcgttatcctgccaaatctgaagcttcgttgttagatgtgattttaatctgacctctgtagactatcttcgaacatatcacttggttcataactgagaatagctcccacgaacagacaactcggattcactttctttacattcagtttacttcccactattctcttcatgttttcatcatttagcattcaacgtattcctttacaccttcgaccttgatgagttccttcccattggatcatctcccaagacatggcattacctggtaaccggtgcctgcacttttcactccgtatagcatctgataccgacttgaagatttcactccttgccttcacagaaacacttttacctagttcatcttgcttactcacgatttttttttcttaatgacaaggtgactgttgcagggcgattactgtcaggagtcttccttgtgtaatgcagagcatgtttttggttatcctttatcaatcaccattcagcctacttctgttcctgctagaaaacatctttgccgatctcttttatcgatcaccttttgacctttctcaaccaagtactcttcactctgagagttgtggatgcttctggtggcaatgtggtccttgggcttgctgcctttcagagaaaccttgaagtagttcgtcaaaagctatactgactgtcgttgccttttatcagaaaaagacacatctgaaactcttagtccaacaaatgtctctttggttgatcacttgattttcttttctacaactaggttatttgattcagaatagagtaggagctcacggaaatgagaccctaggtctcctttatcagtaaacaattacgcacataatcacatatccgcatcttccaaaagaatcctcatagatcttgtctgtattacacatttctcccttgttacatgaatactaagcactgcctaacaaaatggaaaggtgcttagcatcgatacattgtttctactatgggttatgattaacacgaggcctcacaggtatggcgtttgctccagtgaccacaaggcgagtgacttgtcttcttcttgcataatgcccggagtgatggcgcaggttacgcttcggttgtggacaatctctagagaaatgacctggttctttgcagttgtaacaaatcaacttcttctttactgagctgtccgtctgggaacgatcattctgacttggagttggaattggtggttggaaatccttgctaacattggcatcagtggtaccatagttgctatcaccattggattctttctcagagtcacaattgctagggttgtcattctgggtgccttcattgatactatcgtcgacatcttggtgaatgttgttgacattgcacgcttgattcgagtggtcactaatggggcaagaaccatggttggtggtggtatcatcatcattagtattgctaatgttgttgtctgcattgtatccatcttcttggggcaggaactcttgatgcgcaacagaagatccggtgatctgaagtggctcagttcgctgtctttggttaccacatggaattactgggatgttgacaatccttctcttgcagttcttcatctgattatgctcactttcgagttgtatggctttgtccagaagtttctcaaaatcttcataatcctctaggagtagttgcactgcaagctcatcttttaacccctggagaaacttctcttgtttatcttcatccgtttccacatcttctggtgcatagtgagccaaacgatggaactcgtgcaggtactctatgacggtcaaatattcttgctttaggtagcggaactctcattttcttagtgtgatcattcctgcgggaacatgtgatctcttgaatacagctaaaaactcgtcccaagtgatggtatgtccttctggccgtgatacttcgtagctatcccaccattctgaatctagcccaaccaactgatgagttgcgaagacaacccgctcctggtctgtgcactgaatcaaccccagattcttctcgactgtgcgcaaccaatcattggcttccataggatcgacggcaatggcaaaggttggaggcccagttttgagaaattctgataacttgcactgttgctggactataggtacttgaacgttggttgcccatgctgggttgttccgattctgtaatagttgaaatgctgttgccaacatgttggtttggttaaccacaatttggattagctatggtaaggtttcgttgatgcttttctcattcccattggcttgggttcttgagtcatcggatccatcattcccatagcctttgttaccagtgttatccatctgtcacaaggtagaggttgagagaggaagcatacaaggaaagaatagaccagaactagggataggaccttataggaactaactctttttgttgatgtgttgtttgtttcacttattctgcaagttgattaagcaaacaacctagcatggttacatcacaacccaccgatgcaaaccacgcgctacacacacaagcaaaggaacacacaactatcgactctaccctagagggtggcttaggttctgcgactggttcccaagatcttcactcctgcttcatagctggctccactgctttctccacttcgctagcggatcctgcagtcttccggagcttccgcaaacaattgacgacatcttcttcgcaaagctggccatctagtactagttgaaattcgaagaaggaagaaaagagaaaacattttgcaaatggcataggggaaaggaggaaaagggaactttcgcaaatagtttcatttataaaatatgtccttaggttttatccacttggcttatcctacagtcgagatggctctgataccagcttgtcgcgccgggaaaaattgccttttcccgagcgctagtgtattaatccccgtcccaggaaaagccagggtacaccacacaaacatgatacaaaagacacatctttattatatcgataatatttacattattaccaaggcacttaacgcctgacaatcaaaaataaacagcagcggactagcgggcctacggctccatcttcacaggcgctcaactggggtataagccaggactccacctaggacttcttctccaaagcttctcttactgaaggggggaaagatagagcaagaatgagtacaaccacagtactcagcaagtcacaccgggagatgcatgcttaatgcaagggggtacaaggagtaataataatagggttaggttttgcagtaaagagcatttaaaagacacttagttgctcaaagctattttgtaaacacgatcctagagctacacaatattattaatcaaggccgtgaaccctcacgaacctgccttaatccaaggcctacgatgattcagaccgaacaggcaacccgacctgggtcccagctcgtccaaggccaacccaggcctaccattccatattttagttgtttagcaaattttaagaattaaaccactaacttgggtacattgataggcttgcccatatccgagggcacggctattcaaatatattatact

SEQ ID NO: 70890 - DNA, 13805 bp, Oryza sativa
cttggactttaaaataatcccactaacaaacttcactccagaattctccgaagcccctagatgcacaccctgtgagcattttttttttgtgttacagttttcaatcaaataaggtcaagtgtttaagtacgaaaattaaatataagacctgttcaagtaaataggcatttccatcatccatttccttgtcatatatgtgttcatctagctcccgctcagctggagcagcatgattgtgagaagaagcaagaataccacctgcctgcaagaagttatttgaggaaaatatgggaggaagcaaacaaaggaggaagttgagcacaatcgatattactagactggcacagatagcagctacaataaaaacttgtgattgctgagcagggttactgttcacaatttaaaccaaataaagtgactactcatcagttacaagcagcatgctcttgtcaaattctatgttttttataaagaaagttccatatgcctatcatcaaaaggtgtcatgtactggtgctgatttttttagttccatcttaacagtcaaagaataactggaagaattaattctatgttttcaaagaattgagatacaacctttgacaagaccatcttgaattcaagaagctcattgtatgtttgtagtagtttctcactatttgtattcatctcaagcagatcattctcatgctcgcgcaattttgcctgaaaggaaaaaaggcaagtccttaacaaattattcattttttccttcaaaatagctattagcttcagaaataacagaattgaacggtaataaagacatgagtaatgcacctctagctcctccaaatctatatctggttgcattgcaggtcgaacagaggactttacacctgccttgttgatctgatcattgaaaaatcttagtttgcgtgacatttcagagcatcgctttacctgtaggagaattgaaccatacttaacaacatcaaactacgtaaaagttattcagcagaaaattctctgcgtcaggcgggaaacacaggtgtcaatgtgcatctgtgcatgcacagaagtgacagttgacagaaaaaatatcacaattacagcatcaatctattatattctggtggaacataaataaataaaagcaaggaaccagttatatatattatgaaataatctctccttttttttaatatatgacaccgtttactttttaagatacatttgaccattcattttatttaaaatatatatatatatttattattgattttattgtctcttgatttatcgtcaaatgttctataagcatgacttaaaaaaaattacatttgcataaaaattttgaataagacgaatggtcaaacgtgtgtcaaaaagttaacagtgtcatatattaaaaaaacagaggtagtaacttgattggatcacgattcaaggtatcgatgaatatagtctgacataagaagtaagttcctccaaaatatttctcaacatgataatccccgctgcatgcttcctaaagctaaacaaggtaaccgcctgacttgtccattcactagtcccaagtaaacaatggtggtactccctcatcaaaatataaggcatactgttttctctgagttctattaaaatatagagcttgcatgcaaatttattgatgctttaccttattttccccgatgtatactttgaatgctcactaatcattttctctataattcattaattccctaggcattttaggtaaacaaaaatggcatgctcattttcagttatgttctcttgattttataatcatcgtaatatttctgcacacacaaaatccaccttaaattttcaggagagtatatgagtaccacatggacatgatattcaaacaaatatcttgggtacgagcaggccaagtgaagtaaaaaataatgggcgccacagaacaatagtatccaggtagaaatcagcatagtggaataaaacaaggttcatgcaaaatgatgtgattcacaaaaaaagatagatcgaagataaaaggttggaatacctgattgacaaatatacgctgaaaaggactcttatcctcattcaactgcatataaagaggaataaagttaaaaagagagataagcaattgggccttttttttgcaaatctcaattaaaccattatagcaggaagcacaaccaataaaaaagaacaagttcaaacataactatgtaagcattctctaagttctctgctaggatgatgccatgctcacaaagttctgtagtacacaactataacgatgacggtcaacatttagtctccctctcatgattttctttcatattgtcccaagatttcagcggcatctatgggataaagtgaacagagtacgcaaccccgtttttgcaatcaaactaagagttcataagctttttctaaacatacaggtactggtgtactttaagacccaactcacaaaaatacggtgtctattccattaactgattcatcaaataaatcttgctgaatagcaaggcatgtaactgtccacgaatgataccccatagcaaataatatgtttggcataaaatggtacaaattacaaggcaaagattcatgcatagaccgcaaaacaatgagacctgctaggatcagctaagcacataaatgtatttaaaccatcaccgctccaactcatgcttagagcaagtttaatagtatagctaactattggctattagctcatactaaactaacatgtatagactctattttttgtgttgctagctcttgcatgagagccaacacttctcatttctctctctctctctctctctctctctcttccacataagcttatagttagcttatagcgcactattgtccttgctcttatcataggataatctcgcgcaatagcacattgtttgattcgctccctaacctaatgcatttatatgaacaccgcattcattccctctgatctaaaacaaccccgccacccactatccaatcaacgtagcagcccaaaccagctcagacgacagaaacacgcgagccgtcgcgatccagtgacaccaggcaaaaaaaactagtcctccgatctgagcaccgccaaaaaccagatccaacatgagcggatagcacgacgcgcataagcgagcgcggtagagatcacgattcacgaggctagatcacacagatccgggagggagagaggggcctctgatgcgggcagcgactggcgccgagagcgagagatagagagagagagactcacgtccttgaactggaggagcccgagctcgccgaggtaggtgacggcgaggcgcgcgctctcggcggggatgatgagctgcacgaagcacatcttctcggaccgcaggcggtccatcggcggcagccggtcgaacacccccatctccccggagcagccgccgcctccgcctccggaagcttccaggaggttcgcgaaggccccgcgcgcgcgaggagggagagggagcccggtggcttgtctcagatctgaggccgcgggttcggtctccgaacaattctatttttctcccttctctgaaattctatagcgctagtgcgcaactgccaataccgcacggaagagagaggagaggaggcgcgcggggggggggagggaagcggctcggaaggcggccggtggcagtggctggcatgtgggcccatgcctccctggccctgggtggtgggcgcggatcggtcgcagtttcggtcgcctgcaactccagtccctctgggcgcctcgcgtttcgaggttttcacgcgggtgtagtggtgtaccgaggccaccgaccctgtcggttccgcgtggccgtgttggttgggttgggtccttaatttggggtccctccagagtccagcctgagtgcctgacgagtgtgaccggtggcagtggcagtggcagtggtgggctggtggcttgatcgacgtgggcttcccgtcacctcatggccagaatatacgggccgtatcagatttcagatggaataagttcaattcgtgactcttaaaagtaagtgatcaaaatctaatccatggtcctaaaccacaaaaccggatatatttaccccaaactcttaaaaccggtgcaatttgacttcctaggtggttttagagaacggtttcgctgacgtggcacatacgtgacagtattaactcggtcttctttccacgcggtgttgacgtgacgcttaggtagcattagaaataaaaaatatgtatgggatccattagtcattcacacacaaaataaaaaattgtggggcccactgacatgtgggccccacatgtcatcccctctctctccctttcttcttcctcccttctctctttctctctttctcttctctccccttcggctggccacggggagcacgagcggctggagctggagcggcggcgggcggggccagagcagcggcggcggtagcctctccatcggcctcgccaagtggagagaggagatgagaggagagcaggtgagggaggaacgaaggtggtgggttacacgagaggcggcggtggcgcttgagggccggaagggagaggggagaagcggagccgctgagctcgtgttgtcgccgccggtgcctcctcccgcactcgcgctcgcccgcacgtcgccggagccgttgctcgacccgctcgatgcctccgccgtcgacgtctcgcgcccgctgccgccgtcgacgtcccgcgcgatgcgaggattgatgcggggaggtggtggaggacggcgacgaggagctctaatcccagggatgcggatggatccgaaaccgtagccggctcgtagaccaccgtccccccgctcgatctcgttggcgtcggcgctgccgtcctctctcgcgtcagctctagtccgccgccgcttcagctctcgccgaccgccaccaatccggcccacgcctccctcccccgctgccagctccagcctatcaccgtcgccgctccagctagctcccgctggccgcgtcgcttcagaccccgcccaccgccgctcgctccccgcagacggccgaagtggagagggagaacagaaagagtgaagggaggaggggaggtccgggaggaagaagaaagggaagagatgacaggtggggcccacatgtcagtgggccccacaatcttgtgtgtgtgaatgacaaggaaaaagtacgaaatacccccctgaactatcgcggccgtccgaattaccccctgaaccacaaaactggacattcttcacccccaactacgtaaaccggaagaattacccccctcgacccaatccgcggtggttttggtctacgtggcatacacatggcagtccagtcagcattttagtttttttaatggtgggacccacatgtcagactccactttctctcttcctctatctctctctttctctctctctctctcttcatcggtcagcggcagcgccgcgcacgccggcggccggcatgcatggcgcggcgcggggaagggcgatgggcagcaacgcgggggcaggctggcggtcgatgcgcacgcggtgcgcggggaggtggaggggatgggggagagacgggcgccggcggccatggcggagaggcgagccatggccggaagcgtcggggggaggacgggggatggcggacaaaggcgcgcgtcgggagctggagcggcgtcgggatgaggacggggaggagcaagagaggcggaagagggagacagcggcggcggaggaggaggccgttcccgcgaccgccgctcgccatttcctccgcgcccaccttctgtcccggcggcctcccgcctcagcgtcacgcccgtcacagcctaccggttgcctgctgcacagaggggcgggcggcaaacggtggacgacgccgcgtgggagcgggcggtgggcgtcggacggcgatgcgcgggggcgggcggtcccgcgccttgagacgctcaaccaggacgtccaccacgtccccgatgctaaccacctgctggtgcctagcggcggtgccgccattgttggcatggtggagcagctgcgtgggcgacgcgaacgccgccatcaccggggaggcggcgactgggaacggcgtggcgctcgctgatggcgacggcgaggcagcggcgcaggaagagcgtggcgagcaggtggtgttaagtttggcatgcatttcttttttgtgagatttggttattttctcgatcgtggtctgatactaacactaacaaattcctttccttttgttagttccccgtgaagatgacgacgctcttgcacctggagaagaagaccggggagcagcaaacgtaggtggtctctacgagctgtacgcggcgttgccgccatgcggagaaggaggagggggctggagtgggccttcttcttcatatgctgtagctggatgagcggtattggtcgatgcagtcctccgagtcgtaggcgagctcgcggagctgcttcatccactccaggacgaagtggtccacggtgccgtcgtcggcctcggattgcatgcggtggagggtgttcatggtggccagctcagcgacctcgctaccgacgccattgagctgccggtattcctcggtcagcaactgaccaacgttgcttacgaggttctaagctgcgttctccatgcttcgatctctctagcttggttggctggaagctagtttggcgaccgtggcggagatgtggacggtggccggaggcggcggcgaggcggggccgtggcagagaggcaggcggcgaggcacgccaacccagctccggccacgggagccgccgtccgcgccgactaccaccggagccgaccgagctcgtcgacccgccgccgcctcccaccacccgcccccgcgcggcgccgtgcgcgccgaccgccctgagccctacagcgcgagagatagggggagagaaacatgagatagataaagtatatatatgacaggtgggccccacaataaaatgctgactggattgccacgtgtacgccacgtagaccaaaaccaccgcggattgggttgaggggggtaatttgtccggtttgcatagttgggggtgaagaatatctggttttgtagtttagggggtaattcggacgaccgcgatagttcaggggggtaattcgtactttttccgaatgacaaatgggtcccacatatatgtttttaattgaaatgccacctcagcgccacaccagcacacaaactaggtcaacaccaccacaacagcgccacgtcagcgaaaccgccctccaaaaccaccaagggagtcaaattgcatcggtttcaatagtttggggggagtgaagatatccggttttacactttaaggtcatggattagattcgtgtcactttgagggtcatgaagtgaacttattctatttcagatccatttgcaactgggtgtcagcccaacttgtgcatcgtggaagggccgaactgcaatgaacaaggtattcctttttttaataagtctattttatgtccctcgtaggctcattattgaatcacatctctaagtacaaaaccgggtataacgtctacaccaacttttaaaaccggagcaaatagactagttcgatggttcaggattaggtttggctaatatgacacgttaaacacggtcagacttcctgagtcagaatgggctatgtatggttctacatcatgacgactttcgcgctccacctagcgaagtcgatagcaaaggggaataagaacctcgtcttctagtgaacgtcgtcatgctgcatacatagtccatgttggctcagcaaatttaaccatggttaacccgtcactttggtaaaaaccgattcccaaacaataatcgaagttttatacttgcacctgttttaaaagttgaggtagatcaaagagaaaagatgaggaaagcaaaatatacttgttctctctctctctcttgtcgaagtccctcttacagcttgactacgagtttcacaaggggctcagtagcaaagctccgatcagtccaagtctgcgcatttttaaagacctatttgctctttgattactactcgtatgggttgattaagttcatggtaatggtcacgtttcaaaaaaaaaaaaaccatggtgagttcaggctttacaggcccagcatttcatttgtttccgcgaggccgatttcgagttttgacttttaaccacaaaatacattatgcatgttctttaatttcgcgtccataaactggaaacgtatcgtggtcaagtgggaaagctcaggattattggatgcgatggaaccgtcaggagttggcctatccagttcagcgaccgtgatcatcggcccacgaaaaggacgcgccatttaatttgcttcgaccgactgcagttagaggcacagttctgtcgagagccattagcaacggaaaagatgaactttcgataagcaaaagagacaatgaggttgagtgcgatgcgacgctgctgctacagccatacaggcacagcagagcacgcagcttagctcgaccgagtgataatgatgcaacagcgaagccgaagctccctgacgtcgacgcggtacgtgataaagccgaataaatacgccatatctccctctggtagttacgagcgatcgcggcacgagcgggtgtgcgtgcgtgcgtgtacgtacattgaatgcatgcgcgagagcggccggtggacggcgacggagctagtactacgagctggccgtagttgtcaacggagcagtggatacaacggcaagcaagcgagagccgagaaccaacgcaagtacgaataatcacggattcacggtacctgccccccgcgcgactggccgcctggatcttctcctgcaaatctgcttgagaaaaccgtgaattgttctgcgtggccgctgtaatctctcgcatccgcatctgtcaaaacgtgaccccgcgccgtgtgccacagtggtagatttcgcttcagacgatcagacgagacgacggggtttcacatgcggcgcgcacgccgggcgcccggcacgcggcttcaccgccccccccccccaccccaacccacccacacacacgcacacggcacacacgcacacacctcgcgcgcagcgcacgcggcgtggcatgtcgcgggcgcgagattaggaccaaagcaacggcggctacgcgggggcgcccgggggggggggggggcatcgcggccatggagctcaaaggtaaaaaaaacctcctgctacatgtcgcccgcgcgtgtgaccggtttcgtacccccaacactgggggctcctccgtatgcacggggctacctttacaaaggcacagacctgccagtctcgcggtaaaatgttacaaacaggattcaccgctttgctagattgcctcgtgattttagttttcagcttggcacgtagtactagcaaagctgtgctagtgcagtagtatttgcagaagccatccaaaagcaaggaagcgctaggagcacagcacgctttgttctgcagaagctttttacctttgatcgagctaaacatgatggtactctgcgtgcaagtgctgctgcaatacgtacgtttctactttctactactactttcttttttttttcagtcgtactaaaaacagagcagcgtactcaaattgccaacgaggatcgatcattatccgagatcaacaaccttgagcgcgtggcgtcgagcgcgacggcagcatcagtatcagagaactgttcaaaacctcaccaaaatatcgtagtaaacaaaaccgagcactgattgtgcagattttgttcgcattgatttcgtccacgggaggccaaaacaccgaaatgattgttcttcctcttgcgtttctgctcgctgcaggccttttttcctcaattctgaaatcctcaagatctgtcacaccttcccgccttatttataaagagcaggacatcctacttgcctagaacaaagctctgcttcaccttggggcaatggcttctcaaggcatggtatattgataggaaggccaatccaggcagagaagaggagagaagaaaggcatctcccagcccattgtgggttctagttgaggtgaggcttcttcattcagtttcgtttgctcctttttctgaacatcctacatcgtaggggtggttacatcaatgcattatgcatggctccaatcagccaaaaatgttttgccgcctctttactgggattggttgctgccacttctcatgcatttctgatttcctcattgaagtaatctccaattttgcccttttctctcgcatatgttctgatgcccaagcctagcacctacctgccttgtttagctaacaagcttgcttctttatccagatacaagctgtaaagctctgtttgagttttgtctcatcgccatcagtcttatgaagaccagctcacatgcatacgtggctatctaaattagttattccggagtttaaaccagtgataaagcaagtgtctttttgtttttgctaatgaaaggtgtgtttatttgggtttgcagctgtcattttggctaggtcctgcaactacttttgcaccatcgccatgcatgattcagctgagtattagggtgtggacgccattgctgctttttttgtggggagttgagtaaggcgaaagagagagcaaacaaaaggggaagccttggggtggtggattcttgcttgcttcaggcctacctttctgcagccttaagtttggtggttgtagtggtgtgtgtataatgtgttatcttccaagggaccatgtaggcctctagtagtgatcatgagagccatcaccgcccgtggcaaagcttaaagaatcggattgctcaccccccttcttctctgtctcaccatgaccatgtgtcatctcccagtttaaggttggccataagtattaaaagccagactgcttgtccttgtggttggctaagtggttggagtactagtcagtgccagattagtcgggcaagcaagcaggaaatgatgctgcctcgcattgccattatctagctgcgttgttcatgtgaagatatacagtgtgttgttcatcttgtagctaggtctctgtgcctctcattcatctctaaatttgttgatgaaagagagggagctgaccactcatattttctttccattttttgtctcgttgcagctttcttgtaggagaccttggtgtttgccgtggctctgaattctgaagtaaagatatagccatgcaggcagccaagataaggtttgtttccattcatttcatccccttccatgctacattccatgtgccatttggtgattgctgcaaacatgatttttttaaatctccctatgatcacgctatgtgatgttagattcccttctccatcttcagccgttgaatcaggtttaattagtcaatgtgcatgcatcggttttgttaatgcaaatgttctctgatccggtcttcagttgggctaccagcccatgttacaagtcctatcttctacgagcaatacgagcaccgcagaaaagttcagaggcaagaagctcctcacatggaagtagttcattactgctcactctctcttgctcaggggagttcaaacagagactcactggtcactacagttgcagatatggcaccgatccgtgatgatatgggtaatttgtgattgggctgctgtaaactacaatttcctccttatcacgtcctgcctgtcacccgtttaaaatttgagaaatttttactactggagccaaagaagagaacaagttttcaaatcaggggcgcatgtgaccgtgactgcgcgcagatagctccattcgcgttgcacaatgcgtgtcttgttcttgagctcggcgccaagggggggcggtggtccacttgtcgctaaccacatctgtaaagctccgcccttttgatcccgtgcttgcacaccgggagattaacttaatgctgccgctgctcctttttcttggttcctgcctctccctctctccgctcggtttgctcccctcctccacttcttgtcggcctctctgctcctttcggcctcggattctctctgtgtttttctacccccattgcatccggtttaagctgaaatcttgagccattttgggattcattcagaaggaatccacagtttggattggttcactactcgatttggttgaagtttctttcttttgcggtcgttttagcatgaggaggggaactgaaatctcctgcttattgtgacaatgctatctctgaacaaaatgcattttctcaagttatattccagcagtacgagcgggaggtaacgcgcttcagttgtgaaccctgcatgccttgtgattcttgcggttttttttttctgaatcttacttgatgtgttcttttctggcatgaaggaatggctccttggaacaccctacccggacgtcttcccagggagctaccaagacgagccggacggcgaggccggccgggccggactccgccgccgacaggccgtcgacgaagtcgccgcccgccgggaggagccccaaggtggagcgccgcatgacgatgagcgcggagagagaggtatctgatctgaacgcaaagcctctactgttcagtacactcttgttgagcagttccatttcgaagtagagttctcttcagtagtactagtactgtggtttggaacaagtacaactgcaaatggcatgtggatgggaaatttgtcagattccaatccgtagttcgttggagtacaagtgcttcaacgatccgctggctgttcataaatgccagagattttttattttcgtttttgtccctgataggtaagtgttctatgtggacactttggacacattctcaattagtagttgttggctggctcttggtcagtctctctcttgatggagcacactgtcaattacaccgaagcagacagaaggtgttccatagcttaattaagtggtccgggatattgaatgattagggaatttaggctatatattgaagcccctgtcagaattaggaatcaggtggatttgagatagctaacaattttcgcagaaaccgtgtactgtatgtgggagcaaccagtgagtgagtgcaggttaggtagaattagcaaacgctgaggaaattgttgatttggacagggaaactgtaattggcaccaccaattgttttttgtattgattatgttattgactgataccaaaagattgacaagctgatttagcacgtttttatgagcgcagatatcaattctgtttgttgcactgttcttttcttccagtagtcacataatccttgcagaaagaaatatccactggactggatagctcgatcactgcaaatattttactactagcattttagcaaatggtagtaaataggaatgtttggaaggtggaattttaagcttcaaaatttccagtgatgcatcagaatgttcgccaaaaccatcttgtcgtgtacttaaaattcgagctactaatatcgttaatcatgccgttgtggaaagtgatgggtttttatgagcactaatattgtcggcatttcgtgtttgcgatgaatatatgaccagaaaaggaggccaccgacgaagctatcggagctagagtcccagctctcgcagctgcaagacgagctcaagaaagccaaggagcagctgctctccaccgagcactccaagcggcgcgccctgcaggaggccgaggacgccagggcgcaggcggcggcggcgtccgcgcaggtcagggactccgaggcgcagctcgccgagctctcctccgccgaggagagccgcctcctcgagcttcgccggctgtcccaggagcgcgaccgctcgtggcagtcggagctcgaggccatgcagaagcagcacg

SEQ ID NO: 70891 - DNA, 3630 bp, Oryza sativa
cctgtttgttagctacactgcaacatacactaatacgctaagatatatagattgattctgttcatggtcaactctatgctaagtgtactagtttaattggtacagtactaagtaaacactgaatccactactctactattataaaattgaagatgttttgccggtattttagtacgttatccgtgtatgagtctgtttttaagttcgtttgcttttggaaatatatatctgtatttgagtcggcttttaagatcgttcagttttggtaatacagaatgaatcatataagaaatctgtttaaaaaaactcgcatgctaacttgagacgatcggactcctaactgtagcccatgattttctaaaaatatatatatctaatcgaactcccatagtgaatttcatcataactaaaccatataacaatagtaagattaaaatagacttcacccattgcaacgcacggatattttttctagtctttacatatatttaagctagcaattttgatgagaacatatcgctcttctttgcacacacataatactcaaattactatgcaagatccaatcactagagttcgcgtccggcaattaaatttacaagtgagtttgtttctaagtatttctttatatgattttgaggatatattgctacctaataatttaattatgattagaaactatggaaagaaccatagagcacttgaaaagaggcaaggagatgaacaagattgtcatgagccttcaagccaaaatgtaggcccaattcatatatcaatttcgagttcaccttggactctatgagtagcccacactaaaatcatcggtcagattgcatttggacttcgatttcaacgttctacatacgtatgtaaagctaacggaaccacatttccaatggatctggtccacgtcaaaattccttccaagttgacaggaatagttgaaacaagaaggcgttcaaattctgtctagatgttgcgtcactggctttgggcccgttgagccgtgtattgtgtcagagttcaatagggacgcgtccaggggtctaatgtcgaccctaaaacctatatattcagtagtcatcgttaatttagtgttgggtttagcttagattacttctgccattgcagtttctcctatagttcagtttaattgtaaaataccaactttgatatcttaatcattcatcagtaaattgagttgcaatatactttgtttttacttttgttatttgattcgcataaagagattagccttctcgcacgacagtggaccaaaactcaataaagcaaaattgaatgaaaattgcaaggctcaaaactaatgtttggtaaaggaaaaagtggtgcggctgtatagtgaatgatgggaaaaaattacaaaactaaaatcctcaccaggcaactgaagctctgataccaactgatgacgctctctctcgtggcccgatcttctggtgaggagataactctcgctttgatcgagtgcgacgtttgcgacgtggctaccaaccagaacaagtccaggacgccatgcaatcgctacaccacaaacgatgtcgtaccaaccgtgacgagtggttgatgatccctgcaatgcaaatgagagaacactgcaagaacaagataagatgcaatctaaatattgcgaataggtaattaagcacaaaggaatagttgcgattgaagtggtagatctaatcgacccggcaaatcaacacaccaactattgggggctctgaatcaatagttgccgactaatcgagcgaggactagagacaaggtgaatggcacttggcaaaattcaactaaacaaaacccaattattttttaggatgtacaaagctatttgtagaggaaaacaaagctagggttaagtgctaattcgtggaggtggagggaggcacttccgagatgggcctagtctattacaaggcccaaggcccaagttcggtttcagcaacaacactgtcttattttggcgattcccgttgacttgagatgaattggacatgagactggatgcgtttgaaaggtagcgagataagctttccacgaagtccaagatcacccaaatcggagttggcatgaagacgctaggtccatttgaagtcagtactgtctccgaaggccgaactggacttggacttggaattatcattggaacatgtgaagttatgagcgtatccgacaaagtgatgtcctcatcaattggaaaccggatcatgtatatcaagtttccaccaaattgagagttatcagtgcctattgaaagatcggacctatagttcatcatcaaatttaaatatttaatactacgaacactgatagatgctctgatcgataaaagattaattagctagtatgcgagtattattgattcttgtaaggcggatatcaacgaaagttgttaagtttagcactacagggttctcccctattttagttaactgttgtatgttatattgattattggtttatatttgggatacctaattaaatcaagtttctcgaacatttacacacgtacagtcgggtatgattgagttgcatgatatgtccaatgcgtcgaaagaaaacaaatttcagagatatttagctttttatatataaacatttttgctttgacagaaaaaaatgtttaaaacgaaaatttggtattgggctagcagtgctacaaagatttcttacacttgcggacctgccttaattgagggccgaaatgtaggcccaacatgtacaccgggccgaacacagcgagttgccgtctcacccgcatgcttcctgggccaaaaggtgatctggtaatcttcactttgcaggtgtcttcaaatgctgtcccaaaaaagcggaaatcctaatcggcgatcgatcgcctgggacgggggtagcgatcaattcccctcccccctccctccctctactggtttccttttttggcaccgcattactttcctattttagtaaatttatgtacctaaagtttatacacctcaagtttacacatctaaagtttagagacccaaagtttgcacatataaagttagagaccaaaagtttatatatccgattcaaatttgaatttgaattcaatattttttatatatagtatttctgtacatctaaagtttatagacctaaagtttatagatccaaagtttataagttaaaagtttacatacccgattcaaatttgaatttgaattatatctgattcaaatttgaatttgaattcaaatattttctatatatagtatttttatgcatctaaagtttatacacctaaagtttatagacctaaagtttataagtcaaaagtttacatacccgattcaaatttaaatttgaattatatccgattcaaatttgaatttaaattcaaatattttctatatatagtatttatatacatctaaagtttatacatctaaaatttatagacccaaagtttataagtcaaaagtttacatacccgattcaaattttttgtatatagtatttctatacataaatttttgtaactctttgtttttttaaaaaaaaattgtgtggtatactgtagtaggaagagaagaaggggagaagaaaggggggagaggagggaggaatgtatcgagtatagggggaggg

SEQ ID NO: 70892 - DNA, 12858 bp, Oryza sativa
  unsure (1)..(12858): unsure at all n locations
accaatgcacttgttatcggatggcatgtaattgttgtctccctcttacatttttcatgcatttgttgtttaacactataagtctaaaaacattctttctttgctgagaaaaaaaaaactatgcttgaactgcatgtgtatcaactattatgcatggtcttttaattttaaaggtttatccaaggttaaatggtgatgcacacgctcatttctttgtccgctggacggtaagacaccttaattgtatgctttagtgactgcattaccctagtatgtttaattttaaataatctacagttatattgtagattgatggatatcggaagacaggctgctacaatttagactgccctggttatgtacctgaagcaggtataagtatagttccaggagttgccattgatacagtctcagagcctggaggaataaaacatattatcatcttcaaaattttcaaggtaatacaagattatgttttttaagagctaaaatagtaagtatgttcaaaattgtaagacatgtactcctctaatctcctcttctgattttgaacaaatctaggatggtgccggagattggttactacactgcggatgggactcagaaccatacctaattgggcgttttcctgcatccttattcaccaccctacgtaacaaagctaattacatgaaggtcgctggttatgcggtggctcgaacgacccatttggctccaatgggaagtgggtatcttccaaataatccaaaagctgcatcattcagcaacgtgcaacttattgatcaagatggccaaacatccaagattccacaagatctacctgccactcagactttcccatccatctattctgtatctccaatcaattttgagggtaaattcacatatggtgggccgttagaataagaaacaatcggtgcagcttttctatataatagaaataatcattgttaattttgattatgaacttgtcatttgtagagaaggtttaaattttttttatctgatgtgttgttgcatatttgtatttttaaatttctaagccatccatattccaatgcaaaggcaatataacttgggtcgcacgccatgcacaatcccaatttgtatatatacgtataaactttatatgcgtgtatataaagtttatatatatgtatatatacatacgtatatactaatgggactagaggggtatgacttttttttaacgaatcgacgagaccaccaattttattaaatagagaaggagaaaactgtacaaaaggaattttacaaaagcacaaacaggactacgagtctacgaccctgacaaaaaggctaattacaacgccaaccagacagcgaggcttctcgcacctgcaaggctccacgtttttgcttcctcttttatcttggatagcaggtttgatgccggcaacttcttgggttggaaagtcctccggctcttttcatcctagatctcccaggccactagcaaagttaacgtgcgtagtgtcctttttggtgcttctctggtactcatgatggcctcccaccactcgtgtaccatagaagttgctagccagcgatgagtgctttgatggccattgccagtccaaagcgctatttgcagcctcgcgcggctggtcgccaatcaggcatccccacgatatggtctagccatccaagtcgtagatggaatggtgtttaacccttccctgaatacgaatatcctggctaccatgagtctctttccaaatacggtttatggtgtacggtatccatggggagagttccattatctgaggggtatcccatatttgctcccttgacacttcatatttgctggagtaataatacaaaagtactgttttaaattttccttttgtctacactgaaaacttgtacgttctctagataaaagctccagttttatgcatgacctgtaatggaatgtggaatgtgtcagggtatatgtactccgttcgtgctgttcagtactagtgagtgttttactcccgaaacatactccaggagattagtggtatggagtagttgatcgagtagaaaatttagccacttcaggagactagcaggatggagtagtatgtgagagaacattgctgaatgcttctcagtattgtactccacacaataatatgtgcttgcaaagttagagatggcaaccaagaatcggagattcaaaataaaacttacagagcttttgggtcaggctctttcagttttttgtttcgcttatctcagctagagaaaatgagatgaactaatgtcaagagcagatggtgttcataacatgcagacaatgagacgttttgttcagcaaattaacatcatcatcatgccatgatcgcacaagaaaaaatgtgagatctctagtaatttcgttgtttcaggatatcgacagccattacaaccagtttgccaagatgtcttacagacctgtacttcagaacctatatgttttaacctgtaaattaagtgaattaagaaaagacgccattccttttaacctgtactccaattgacattcaggacctgtatgtgtaaacctgtgtcattcagacaactccccaaacatacttgtaaccatataacatttttcatagttttttttcttcttcagaacaaagaaaacgtaggattacccaaacagacatttacttcaatcgacattagtatgggcattatcggattgacatcacatacacaattcttatttgtcacactgacagtactcaaattcagattgcatacatacccaattcacatcacatttgatcagtactctaaactacttctaatcagatcagcgttccagtagaagagaaaaaaaaaagaacatctaactgaattactccaatcatcaatgcagtaaatgaagttagcttccaaaacctggtccaatctgaaaacatttgcaaatacctagtctaatatgaaactaaggtattaaaacctagtccaatctgaaaacatttgcaaatacctagtctaatatgaaactaaggtaataaaacctagtcctaagtgcaattcactcattaaaaaaaggtgtttctgaattgaacgaagggagtatttggtacattcttgagatacctaaatattgaatgccccctctagaacacatgccattgcccatacggcaagcatcacagtcgaaacaatacggacgttacagaattatatgttaaccagcattattcaatgctagggtacttgcaatagatttgtgccacctgatacatgtatgggaatgcaaaagattgcagaactaccaatatgtgaaaattgctctgaatatacaggcaaaaacaagcattaaaccacttatgaagcaatttacatctgtgaagcaatcgccacagccaactgttaacaccctttctaaaccaacacccttcaagtgctttagtcttctactaataaatatggccctaatgtgggttcttccttaacagatggataataactgcagcaaaagggagtattgtgtcagaactagaagagcgcgaaaaagtataaaagcactcggagaatttttcacatgtgcagctcaacatctccagagttcacatgtaaaaagaataaaaaaatacagatgtagtatatgtgaaccttgagacagaacgggcaatttttagtgaaaaaaacatctaactgaaaactgccccaaggatggcaaatgatttctgtacaaaagatcttacctcacagaggacaccagttactgaaaattttcactgtcctcatctttaggtgtccccattatgatactgcacgtgtaatggcataaacagtgtcagctagaaaaaaaaagttgaatgtgcattattactttatatcttgtttagcttcaaggatgaaccatagcattgtgctgacaaatgatactatgctagtgctaggttacctgaggttgcatataacccatcccttgggtgtaagccccaaccatctaaaaatattatcagtatgtcagtgttttcaaacatcagaaagaacaaagcagtacaagttactgataccaaccccttgcgcacttgagctactagcgccactgtgcggaccaattgtatccttctttactgaaccatcaccagcctttgaggacagcttactatcaccctaccaagaataaggaatagtggtatggttagaactcaatacatcttgaatcttgatgcacaaaaatagatcttttactaaggcacaaatatagatcttagagtattactaaggcacaaatatatatttccaggcaaattgaacagtgacatactaaatggatgcggttagctttccttcaatgtatatgaagcagaggaatgaaagaatgattcaggtgttaaccttacagttcagagtaggatatgtacatttcatgttgagcaccaactatctctaatcaaagggcataattgcatatcaattttttgtgggattgttctaaaagcaggattacaagagtgacacatttttgcgttgacaaaaaaaaaattcacatgaaaccatagcatattgttggggaaaaaaggggattttgaggagggtagaatggtagatggtgtacctccatctgcagttaacagtgcacatccccacgtattgcaaatttgccaggaggacagaagagacatcagatattcatacaacaacgaaaggtttaacatttatactggcagagagtacgaagcgcacaattacctctctgtacttgtgtaaatagatcttcaacggatcaacgtactcctcaaagccaagcgtacccatcgcaaagaggagatcttccccgttgatggtcttgcgcttctccttctgacatttgtcgctcgccctgtcccatcccgcaccaccgcccaaaccacaaagcaaagcaaaatcacaccctaaaccaaccatcacaaaagaaggtgtggggagggcaggatcacggtaccgagcccgcgcagactcactcgctggtgacgaaggagatgaactccgagacgcactcctgcagggtctccttggcgtccttggcgatcttgccgttcgccgggacggccttcttcatgatgcggctgatgttggcgatgggcaggaacctgtcctgctccctcaccccgccgctcctcggcgggctcccgctctcgtcgtgccccgcgtccgccatccccgcgccgccctccaaaaaccctagatccatcatcatcatcacagcaacaaaccatcagagatggtggtggggagaggagcagccgagcagcgtcgttggatccgtaccttacgaaaaaaaaaaaacgcgcgcgcgcgggggtggagggagtcgcggagaggagaggagagagaggggggaaggcgagagtggggggaggaggagacggcggttggtgaatggtgcggtgaggaagggtggggaataggagatcggacgctggagaagggagaagcggcttgggccggtgcgatgggggcagccggggtatccgggccgttcgagaccctgggtgctgaccggtggacccgggagcacttgctgtttgggctttatttggtttgctctcttttaattattattagagtatattacactttggtctaccttttattacccaagtttcaatttgaactacccttaaacctatcttttcaatttggaccgggtaaatttatcattgttgcagtttggactaccgtaaacaatttttctcgtcatgcctaacttccctttcaacaaacatatgaaccatacatataggagtttggccgtatattaaagttgatgtgtttaagattgttaattgtactgaaaaaaatcgttcgtggtggtccaaattgcaacaatagcaaatttataatgtggcccaaagcgtaattcactcttattattatattgtatctactatagatgaaaatatatattagcttatatctagtaatcgcagaacaaataatttgaactggactggggaatttcttacgcattgatctggattgggaaatttcacatcatgttcaaatttacttgtagaatacttctccgtttcatcatattgtaagttgttttaaattttttaagtcaaacttcttaaaattttaaccaagtttatggtaaaatataacaacacttgtagcattccatttacatctaatattgaacatgttttgatatatttttttctttgtatgaaaaatattgttatatttttatataaacttcggcagtacatcatatagcgttggacgggacaatttatttttaccaatattgtagtatatctgaaaggcttagagtagtaagaaaatacataattcacatcatcaatataattgaagatcactcgttttagtttttttaccaattgatctgaagaagagctgtcatcaataaaattgaagatcactcgttttagtttttttaccaattgttctgaagaagagctgtttttagagttgtaaatgtttaggggtgaaatgcaagccccggcaaaacgatgaatttcaaaaaattcagcacaaatcggatggtttggccgtttgggagatgaatcaaagggatgaatccaagcaaatgcaaaacataagcgcaggtatcatattagagtcacagtaaatatgtgcatgtgactagcagtaagccagtaaatcaaagggacgccgacgaagataaccggaaaccatacgagcatataaaaatcaatagctaaacgatgcttcaggctcaaacaaagaacagatgaacgaaacgagctggagtcatcaaagaaacaaacaaaacattggcgcctcaaaatcggagaaaatagctcagcacagtactttccccttaacagaagcaaaaatctgacaaggcatggtttttaccaacacaatcttaagttaacaatataaagagcgcactttaaacatagcaaggaaccatcttcttgagcatctaaagccttcattcttgagcatctaaagcctttcattctgtctattccatgcttgccaaccaagatgtaccagtaatctaagacctcggcttctccttcttctccttgaagagagcaagcagagacacaccagagaccttgacgaccttgaaccggacaccaggaatatctcccacagcatggcccttacgaccaaatccagcaatcaacacctcgtcctggataatgacatgagaaataagtacaggtgacacagcaaacattcaagaagttcaggataaagaatgtacattttcctcaatgaagttcaggcaaccgtcattgggcacaaaggcagcaatcttcttcccattcttcacaagctgcacacgagcacacttacggatggcagagttgggctgcttggcctcaataccactgcaatagagccatcaaatttctcacattagcataaactcacaaggcaaagggtgacaaaaccatattatagtttctacatacatcttctccagaacgatgcccttggcatgagatgacccagcaaagggtttcttccactcattacccaagtggctcttcttgtaggccttgtctgcccatctctggttcctgcggtgggtcttgagcttgcgcccagctcccataccacgtgtcttcctgcattttgaagaattcatggttcatgcaactatattaaaacaagattatggtgtacaattcgacggtttgacatatagtgcggtgctagaaaagaacgtgtgcagaatgaaaagggatgaaatgaacaattgaaagagacatgacatccaaatacagactaatagcaaaagcataagaaagtgttctttgatgaccataatatgtaaatttgccatcagaagtcgatagttgtttgcaaagtgatgggcttagcataaaccacaaaaagatttgacagctaagctaagggcgattcctttaaacaacaaaaatgataacagtgtgtatgctaacatgcataacctcccagatccaagtaaattgatataagaaattctgattacacagcagcaacggattgatatcgcttatgaatatgtttagtgttgacggtttataatctgatcagcactggaccgtcaataagctgagttccatcatcacacgcaaatttaccaaaatacaagtatgacgcatacaaaaatcaagtggtatattcaagcatccagctacgagggaactcgactaaaccattccagatcgctaaacctatacagacaaaatccaccgcaggagagtgacagcgagcttaccccatgttgacggaagggcagcgaagatctccgaggaggcgaggcggcggcggctgcggcggcgaggggagcgcgagctgggagcggcggcggctgcaatagaggagagagataacggaaagggcagagaagctatttatttgcggcggcgtagctgtctagggtttgctaatgggccttcctgcttcaagatccgtgctggatggacgacggcccagatgttgagaagtggatcgcgggaagtgatagaatccgacggtggacctggcatgccacgtggagaatggacgtatagcacgattttttcctttatttgatagtaatatgttcatgctaaatgttaaggtgcaatattatttgttaacaaatatatttttcaaaccggagatggtctggtatgaatgaatgaatatataaaagaaaggctatatccagagctcagtggattttttatgtgcagatctctcaattataactcatgtcatgcacggattttttttttgagcttgtgataaaatattttattttaggataatgtcacatatctctattattgtttgccacacatttgataaatattttattttagaattagtttgtattcatattgaagccgcccattctaaagcactacagtgtgatttatgtcacatggccctttttttgcgtggtgtgataaaatagtttattttgggatcatgtcacacttttgtatgggtgcgttcaataattagtctattttaggatatttttttaattcctattgaaatgggtagtctaatttaattttgttatgtgtataagcataatgtatattgagacatgtaggtagtatatattatcgtgggagatgcagcgacgtgcgcgcattcactctccaaagtcgtgcatggtcgcgtgagaaattaaaaggttggaggttttaaaagttgaattgaaaatttcaatttgttgtgtacaattttgaaaacgagaccatagaatttttaacttaatactggagtaaaaaatgtcaagttaatagttttcacaatgtataacaattgtttgtcgtcttgttaacgtcttctttcaagatctacatggcttgactactattttttgtcgatggcaaaattagatactgagagagacacgtgttatatagtcatgtgatcagcgacacatgtagtacgagatgatcgggagaagataatcacannnnnnnnnnnnnnnnnnnnnatgatatgctggacaaaacaagagtacgttatagagtaacattccgatcaacaatttacaatgttgttcatattaccttctaagatggctatgtggtattgcacattaggaaacttaaatgagtggttttgaataattaatatagcatgtttacatattgttaatcattggtgatcaatttatactatagataccataatggtattatatatacaccaattgtaggtgagagcaaaaaatggggcaaaagcaaaaaaaaaaaaggaggaaattttaacatatatgtgcagcatatacatcatatggtcaaacttattcaacttatatgcaaattagataaatccactttataaaaccatcttatggtgttatattaacggtatcatatagtttgggaggtcggatgtccaatttcaaagtgcaggtgtttggtaaacttttaatcaaaattcaagggggggtttagacttaccgaaaactatcaatttacattaactaatgtcataaaggggacatgaaagatcactgtttatatctttaccaattgatctgaaagcagcgtttgcgatctttgtttcggatattttcaattgatctgaaagccgcgtttgtaatcttgttttggtgaggtaagcacccggaagatgactaatgtcacataataacccggtggtttgagagagcctctaaatttaggcaacaaaattccaattttcgtcgaccaaattcgatgatatgcaaacgaacccaagtaaatgacatgcgttcattctgatgattcctgcagcaccacttctatctgtactctagagtaccacatagttggcctaaatatgtattagccacagggaactccaaagagtagcaattcgcagtgaacagagctaagccgaacaatacctcaagggtcaaggatcctcaaacacaaacacagataaacattggcaactaagataaaaactcagcatagtactttccctcgacagaagcaaaatctgatgacaaggcatggtttttaccaacacaatcttaagttaacaatatagagagtgcactttaaacatagcaaggaaccatcttcttgagcatctaaagccttcattctgtctattccatgcttgccaaccaagatgtaccagtaatctaagacctgggcttctccttcttctccttgaagagagcaaggagagacacaccagagaccttgacgaccttgaatcggacaccaggaatatctcccacagcatggcccttacgaccaaatccagcaatcaacacctcatcctggataatgacatgagaagtaagtacaggtgacagagcaaacattcgagaaagtgcaggatgaagaatgtacattttcctcaatgaagttcaggcaaccgtcattgggcacaaaggcagcaatcttcttcccattcttcacaagctgcacacgagcacacttacggatggcagagttgggctgcttggcctcaataccactgcaatagagccatcaaatttctcacattagcataaactcacaaggcaaagggtgacaaaaccatattatagtttctacatacatcttctccagaacgatgcccttggcatgagatgacccagcaaagggtttcttccactcattacccaagtggctcttcttgtaggccttgtctgcccatctctggttcctgcggtgggtcttgagcttgcgcccagctcccataccacgtgtcttcctgcattttgaagaattcatggttcatgcaactatattaaaacaagattatggtgtacaattcgacggtttgacatatagtgcggtgctagaaaagaacgtgtgcagaatgaaaagggatgaaatgaacaattgaaagagacatgacatccaaatacagactaatagcaaaagcataagaaagtgttctttgatgaccataatatgtaaatttgccatcagaagtcgatagttgtttgcaaagtgatgggcttagcataaaccacaaaaagatttgacagctaagctaagggcgattcctttaaacaacaaaaatgataacagtgtgtatgctaacatgcataacctcccagatccaagtaaattgatataagaaattctgattacacagcagcaacggattgatatcgcttatgaatatgtttagtgttgacggtttataatctgatcagcactggaccgtcaataagctgagttccatcatcacacgcaaatttaccaaaatacaagtatgacgcatacaaaaatcaagtggtatattcaagcatccagctacgagggaactcgactaaaccattccagatcgctaaacctatacagacaaaatccaccgcaggagagtgacagcgagcttaccccatgttgacggaagggcagcgaagatctccgaggaggcgaggcggcggcggctgcggcggcgaggggagcgcgagctgggagcggcggcggctgcaatagaggagagagataacggaaagggcagagaagctatttatttgcggcggcgtagctgtctagggtttgctaatgggccttcctgcttcaagatccgtgctggatggacgacggcccagatgttgagaagtggatcgcgggaagtgatagaatccgacggtggacctggcatgccacgtggagaatggacgtatagcacgattttttcctttatttgatagtaatatgttcatgctaaatgttaaggtgcaatattatttgttaacaaatatatttttcaaaccggagatggtctggtatgaatgaatgaatatataaaagaaaggctatatccagagctcagtggattttttatgtgcagatctctcaattataactcatgtcatgcacggattttttttttgagcttgtgataaaatattttattttaggataatgtcacatatctctattattgtttgccacacatttgataaatattttattttagaattagtttgtattcatattgaagccgcccattctaaagcactacagtgtgatttatgtcacatggccctttttttgcgtggtgtgataaaatagtttattttgggatcatgtcacacttttgtatgggtgcgttcaataattagtctattttaggatatttttttaattcctattgaaatgggtagtctaatttaattttgttatgtgtataagcataatgtatattgagacatgtaggtagtatatattatcgtgggagatgcagcgacgtgcgcgcattcactctccaaagtcgtgcatggtcgcgtgagaaattaaaaggttggaggttttaaaagttgaattgaaaatttcaatttgttgtgtacaattttgaaaacgagaccatagaatttttaacttaatactggagtaaaaaatgtcaagttaatagttttcacaatgtataacaattgtttgtcgtcttgttaacgtc

SEQ ID NO: 70893 - DNA, 17503 bp, Oryza sativa
aggggagctgaatgttagtcagtgaagtggagcggagggggtgtgaggttgatggcaattggcagcagctacactggcgggccacccggcccattcacgtggttgccggccggcgcatccggaggtgtacgttatgtatatacgtgcgcgccatacatacgtacttatgaaaaccacgtagagattgcacgtagagagtacgtacataatgcaatgcatacagtacatctcccagttgtggttgtactgtacagtgttgtgtacactgtacagttatacgtgtgctgtgcgcaccctgtgatatatatatatagagagagagagattctgtttatatatggtttctttttatttatgcttggatttctaatatgattttttggatttttacggtttataggttgatggttttttaactttattactcccccgtcctattttaagcgcaaccatgagtttccgtgtctaacttgaatcgtacatcttatttgaaattttttattattagtatttttattattattagatgataaaatatgaatagtattttatgcgtgacttatgttctttattttttttcaagaattaagacagattatcaaaggttgaacacataaactcatggttgtgcttaaaatgtacggaagtagcaagtttaaaggtgaattaactaactccaatcctcatagaccggaaaatttactcaaacctggcttttgacttaatacagtaagagtgccttattgctttacaaaagtctaattaaatagaatcatctacgaaaatataatcattatgaaatttggatatgctgttcatctcatgctcttggcaaagtataaaattaactctcgtgttgaaaaatgcattgtacagccctcctagcagaacatggtctttttacatgggttaacagagtgaaatgaatagaaccccgacagtgatgatatctttgggataagttatgatatctctgggataagttggctcgtataatagaatttcttggaagttgcattcgtcgatgaaacgatgattttttgaaatgaggtatttgtcaatagtatttgttagattttatttttttatatatatacttctaatttatttatgaaataggagtagtgatattaaaacgatgcaaagtaaaagttagcaagcactgaagcaccgtcaaaagtgaattggtgggagtactacagaaggattaacagtgcccttcatacaagtaaattggcgatttgattttaaaaaggttcgtcggcaatttcacaagtaatcacaaaggcagtacccaaatgcatagggaacaacccatccttttcaattttcttctttgtcagttacttccagactttttctgcttacaatacagattcaacagttcagatgtcactttctcatctcgatcttttctaattctaaccttctagtactatctacataaactacggaaagaagctagagttctactccctgaccctttctaggttgagttttttttggatggaatgagtacaaattaatgctaattaataattcatatacactccacgtttgagcagaaaattaaactgccaaaaaatacaagtaattgcaattgagcatatgttcggatgattaatatatttcataatccattgtatccagcgccatcatcaatagctgacacagtgatacgtgtgatcggtaagtgatcgtcggtcggctgctgtactgacggtaggcgtaatcctccagggacatggatcgtcgacagtactgcggagaagcactatagctgtgcccaccacagtttgtttaatgcagtgaatattgagaaaacaccgtagctatagtgtgttgatctcttagtttttttctgttattgttttacattcactgtagtgcagaggatggctaatagatagttacatactattccctgcatctcaaaataaacgaatttattataggatctactacgggatgtaatatgtattaatacttatgttcagattttcagtagtatcacatctatagctgtttggtacggcagatgctccctgttccatcctccacgaatttcctttgcctttgaaattctaattttttgaataggggaatactagtacgcaaacacccgtattcgtcctctacgtactggtgagcgccttaaattcgccgccgaatcgatcgcgattagccatccgttttaatcaagcttccatcgtctaacgcaccggccgttcttcgccggtggagggacagacaggggatgcggctgcgctacctgcaccgatcgcgttaagtgggacaagcaagagcgcaaagacaagagcgcagcacggtgcgggagcccggtggatcagagctagtactagtatatactccagtttgacggacccagtgccggccgggcgacgcgcgcctgacgcccgcggatcgatcgatcgccgccgcgcgcctggacgagcccaggtgcgctgccctgacacgccacgcgcgtgttcatcgacagcgcctcctccgcacggaggaaaatgacgtcgacagcgcctggctagcaccgtcattacgtcaaccgctgacgtcaggtagttgggcttggtctcaagttcccgactgggagcacatgcattgggccggataccaacaccaccaggagaagaggaatcccggcccgatagcacatatcacacggatttgtgcccaaatttgtaataagaccaatgtagtgggccgactagtagcccgtagctcggtagatgcagtgatgcaccaattcggatagggcaggaaagaacggtgaaagacgagcgccgcgcgaaggccggtgaacttcgtcgccgtgatgcttcgtcttcccactctcctccccctaaaaccctcgcctcccaccaccggcttaaaccccatccacggccgccgccatggccaccaccccagccgcctcctcgcctcctccgccccgccgccgccaccaccacggcctcccaagcccgagccccgtaccagccacgagaacctaggcgacgacacccccgatttccccacaaccaagccccgcaagccgcgccgcgggcgccggagcgaggcggcggcggtggaggacttcgtgcgtggccgcctcgagcaggtcttcgcttccatccgggagcgcgaccccgaagtcctcgaaggcaagggcgacatcttgaagcgaaaggaggagctctccgacgaggagggaaaagaggggactggtgaggaagagggggagctgaaggctgtggttgaggaggaggatccctcctggcctctggacgccgacatcgggtgggggattcgggcgtcggagtactttgacaagcattccatcaagaatgtgacggtggatggtgtggagatcgattgggagagggaggtcgaggagggatgggtcaaagagatcaactgcttggagtgggagagcttcgccttccaccctagccccctcatcgttcttgtcttcgagcgctacaacaggtataaatcactattctacccagactctattcatgtgaacccatagtacctatatgttaggaccaaagtgataaacttcataaacttcaagcttctcactttatattgtcatatctgataattttgaatccattgaatcaaaagttcagaactacccctgaagtaatgcataaaaatgtaaaaatgtactatcgttttgagttgcctcagaaaattaggtgttctacttccatgacaggatgatatgtacgcgtaatgttttgcctttgtttatagggcagctgacaattggaagtttcttcaagaattggaaaaggcggctaaagtttactggaatagtaaagatcggctacctcctcgggtcagtgtgaatcatatttatagttaatacttgatgtattacggtaaggttattgaggtggttggtcatatgctaaatttaattgagttccagacagtgaaggttgatatgaatattgagagagacctggcatttgcacttcaagtaaaagaatgcccacaattattattcctcaggggaaacaagatattatacagggaaaaaggtgagtagttagttccatttttatggtaaatcctgttcacatagttaacaaattgaatggaactttgaattattaaattccttgattgctaatatgcactttcatgttaggcccacctttttcaatggtcaaaattgccactctgacaacacctgattgcctcatttgcttgtttacagaactaagaactgccgacgaactagttcaaatgattgcccatttctactacaatgcaaagagaccatcttgtgttaatcctgaagctattgcacctccgtgctaatctcctgcatttcagcgcttatgtattgagacagtgccttaattctcaactcttggtgagtgtacactgtggtaagcttttcatccaatgataacctgttccccgttagaaaactgtattctatactggtcattgttctctttaatgtcctttctctgtattagtacctggttcaggggagaatattattaattttgctaactttatttgccaggaaaatagtctaaatagaccagtgtggttatgatgcttgtatctgtaataaatgtatcacttgaagaggaaggagagaaacctcttactggctcatctcaagttgggagggggtcaggtatcaactatgtcatatattttggtatgctcatgtttttagctgtacactttcacctttgtactgtactctaacaaaacatacagttcatcaaatttctagatagaacaggagggaatgctagcttaattatctgcgtggccatcctgttaaggaggttgtaaagtcgattgtaaacttttgaggcgtagtgtaatgtcatttcacgccatagatgcaaaatgaaggcaggggggtcaacccatttgtcatcttataactcctctgattatttttcagtgacgtaattgaatttgttggatggagaacgatacaagacataccatacatgcattatagggtcattttggtagaacaatctcatcttgtggaactgctttcagatactcttttctttggttagcccccctttttttatcttgggtggcaaagggggtatagttgtgctccaaattcccatgagaatgggatggcaatgcttcccccggtctcaaaaacaagtcgcttgagaatgcgtccagtcagcataagttaagtttggctataaaataaattaaagtatatgttttgggtgtttccatctataaaaataacttgaactataggttttgggtatatgaaaatgatatatttaagtttgtcataacaagagctttaatagtagactgtccgcataagagagatcatgaacaatctgccactggttttgagtgctccaaaaggaatgcaaaatgcaatttctgatcaaaggtactagtacgaaatggaacacgcgtcatgtcagcctatgaaatcaacaattattaattgttccccatatcgaactataaagaaaggaatccgatgcaaacattcactttgcttaacaagagttactgacaaaaacagaacaatcacctctgtaaactataaaactatacagtacaatactgtcacctagactcctggtacaaattacaaagtataaacaacaactctggattgagcagtggacacaacgaatctacgcacacgatatcgaggaggaagacgaggacgcgatgcacaacgccggcgcggccgcctcgtcggcgccacggcctcgcagcagcagcgcgatggcctcgtaccccatcgtcacggccatctggagcggcgtcgcgccccgcctggtggcggcgtgcacttcggcgcccatgtcgagcagcagctcgacggcctcggcgctgccgccttcgacggcgaggtgcagcgggcggtgcccttccacgtcctcgcactcgatgtccatgcagcctgacccggcgagcagcgcgatcacgtcgcagtgccctttgatggcagcaaggtggagcgccgtcaggccgtactggtcacgtccccggacgccggcgcgcttgctgaggagggactcgaggctctggaggtcgcctcgcctcgccgccgtcatgaccagttcccaccgttccaggacgtccaccacttcttgctacacccaccgaacaacatcgtaactacaccagtataacttaatttgtaataaaaacgcgctgcttagagtacacttcttgcaaaacaatactgataatgctgctcttgaaaagtaacagaagtactgttcaaccatgtcatttcgcagacagaaagtcccatgctggccatttatgcatttctggtggacaataatggaattgcactactgtagcgtcgtcctactcctatcatgattcacgagcgcatcgacaggtcacataagccaagctacctacgtacatcctccagctggtccatgatcctccccgtcggttctgtaacttttgtacgaccagtgatgctttacaagtctacaactaaatcaatgttttcctaatttgacacaaacgtttttacgacctgctagtgcatttaggaccacacagattatggttcacattcacacatggttgcacggttagttaccaggaggaatctttgtcgagttgcaattaaaaagcagcatccgaattccctgagcttaggtacacgacagtaagaaggacagacaggtagattctagtaggagtaaacttacatagcccttctcgcgcgcgacgtccagtggagtcctcccgcgcgcgtcggtcgccgcggcgtcggcgcccatgtccaccagcgccgccgccgcctccgcctccccggccgcggcggcaacgtggagggcggtcctcccctcacggtcgcgcgctcccatcgagtccggccccaggcgcctcacctccccggtgtcccccctcgcggccaccgcgtgcagtggcgcccactgctcggcgccgtcgggcaccgccgcctcgggctccaggagcggcaggaggtgcggctgccggcgcaggatgaggcgcacggccgcggcgtccccggcttccgccgcgaggcggagcaggtacggcccgccgaagaacacgcggaggcggatggcggtggtgccgccggtagcggcgctggaggaggcggaggagtcgaggtgcgcggcggagagggaggagagcacgaggaagcggtcgcctcgggagcgcgggaaggacgcgggagcgtgctgctgcgggcggagcacgacgcggagggaggccgacgagagcggctgcacggcgccgcgcggggggctgacgaggaacttgagaggggaggaggtctggaccttgaaggcgacggggagggacgggtgcagcgagcggaggcggaggtcagcgcggcacttggcgttgggcttgaagtcgatgacgacctcgtcctccgccacctccaggagctgctcgaccgccggcttgtccgcggctgctgcggtattggcggccgggacgacggcggtgctcggcggcggcgagggagaggctggcttcgcggtggccatttcttggaaggcagagagactggtagtagcagggggtggaatcggcaggggaaggcatggaatggtggctggcttcctaggacgccgcttttgatgtcacgctggatgggcatgatgggaatgttgatcgtttgtgcatacggtgtcttgtgtggagtagtttggctttttgatggtttggcctctacatttctacaacttgtccgccacttgatgagtaatgtacaagtgaacagcacacgctgccaaattaacacagccggggtgtattgccgagtatgtaacgttatacaagcagtattacaaccaagtggccgatcgaacatactcactgactatatacaaacaaaagggtgggttttttaaaattttaaaataaatggtagggagtatttagctttggttaggaattttacggagtatttaggctagcatgttcatacacttctcaacaaaagggtgaaattgaaaccactcgtcatgaggtagtacatactcatgctcatacgtccacacacttcttaacaaaatgtagagttgaataagacgataggaagggagagcaacatgggtttatccaaaatgtttatacggtaatagagtaaatacctcaccaatatcctacttccttcatcccaaatgataagttgtaaagttgcatagataaaaatcaagttgcttttacggaaggaatacttccaacgttacaaaaatattgataacaccaaagaattcatctcacattggtacaataatcttgatataagaaaaaaaaacgaccatttctggaaacctctttgtcataagtttctagtagtttgaaagtcagtttcggggaaaagtggttcaaacaattcttttatttgattgaataggtttcctctccttgttggaaaggtatatatgtccctactatttgaggataaattttttaattcggttgaactaattagaacaaatatatgcaggtgaaaatgcaaagatttttctgaacattaagagataatagataaaaaatgcccatgcattgcaacgggtgaaagctattctaataatattattattgttatatagtttagttaaggtaaaattcactgtggaaatcagcttggatatatatatagaaaatcattagctataattaggagtccgatcatctcaagttagcaagcgagttttttaagagatttcttatatgactccttctgtgtttctaaaaacgaacgaacttaaaacccgtctcaaatacagatatgtatttattaaagtgaacgaacttaaaaaccgactcatacacgatggcataccaaagtatcggtaaaaacatctttaatttttataatagtagagattaataaaaggtacataataagctaacacgatgagttttatcttatctttttctgaacggttttctttaattattaagaggataagatattatcctcttaacaattgaagaaaaaacattgaggacaaaatataaaggaattcctcgttttgctcttacttaattatgagattaattttggaactcactccatggagaggtatagtaatataatatatgtacctatagttaattcaccaacagattttagtgctaggtagcattacaaacattttaaatttctttattatagaagttacagttggagcgcgcaatctagctcatcaaccatgggccatctctaccacatgctaattgatggatgtggactgccctcaacttttaatactgatgtggactaaactcaccagttacgaacttacagtaaagtaggagatgtgcatgcaccaaatgatacttattttaccaaaatttaccaataacaaaattgaaaattttgacatagtagcagtagataatcagaccaacctaacttaactgggaccactcagggattcatagcgttcagacctataccgttttgcgcagcgaaaacggtgaattcatcctggaagtggatcgagttcaattgccccccaacccagaccgtagatggccacaccatcgccggcaggccgtaccgaccccggcggatccgactgccactcgatcgcatttatctgctgggacctgcaaagaatgatggagccaggctacgatccatccagcacgcacgtcccatcagaacgggtggcaatcggcaaatcacgccgagcaagcgagcgcgctacagttccctcgtgaaggacttcagacgagcacagcctcgcacgcgcgcgacgagaatacggccccggtcgcttggtgaaggtgagaaccccctcaatttcgttggattctagcctgcatgtgcccggctgccctctcctcttccccccatttcccttgccgtttctcgcgcacgaatctgaacaataccggggcttggccgcgtgccccgcggctcggcggcacgcggccgcaaggagacccagtggagtagtagaatactcggcttcaggggatgctgccgctacccaacaattccgtcgccctggacttatcacgcgccgtaggtcatgtgtaagtagtagtacaatcctggtaggtttaaagtttaaacccagacgttgagttccaggtcgatccaccgggcatgctcggatggatggatggccggaataattcacataacctcacgtgatgcgagggaaaggggaatatttagaaatgctaagcctgttgtacacgggaaaatccatagattctaaaagggaaaatttcaagaaccagttactatatcagcctaaagaccagttgccttagcgaattattgtctataaactagttgaatcacgcaactccaataggaccgatcgcatgatacgtgctgtatccaggacatcaattaaacatgtaacttattgttaagttttgaattactgctatcaaagcgtttgtagtccaacggttaggataattgccttccaagcaatagacccgggttcgactcccggcaaacgcatgttttttaattttttgcttataaatttcttgggctcgcgtggatagagactctctttcaccttcctgttgggcccattaggcggtctccaatgggcctaaattacatggacacttccttgccttctcatcgagtttaattagaatccttataccacaatactagacatcttcacccttacctagttataatgtggcatcctagatagtaataaaataaaaaacatgtggggccccactctcacctctcttcctaagtagctcgctagtggggagaggggcgtggctgatgagcccatccacaggaggtgacaacggtggtgggacgctcacctcccttgcacgcagccggacggcgggtggcgctacttcgtcgaggactcaaggtgaacagtaacatctgcagccacgaactcgtttctattgttgtgccacctcgtacgcatgtgctatggagagacgccaggcgccgccattgccgccttccttctcgtgagcgcagggccgagctcaaccttgtgcgaggctcacacggctcacacaaccacaatagcagttgccgccgacgcttcctttctcacgggtgaactcacgctacaccgctttcttcacaactagctctctgctcaatatatcttgagctcgagctccttcatcttctaccgcagcgtagatccggaacaatctcgtagccgccgagagtaggaggccacctgccaccagttgcatccctctttatgcttgcgcgcgaaattcgccgtagccggccatctgtgatcaaaccccgcatcctgggcaccgctccctaacgaatgcagggctggctactttggggatggatgactcaacgtggacggtgacctcctgccaccgccctcagacgacggtggtaccggggtggcaagaccacccaaggcggatggcggcgacgcggaggggactacgagggtagacactaacaagggaggggatgctaagggcatggtttgctagcatgctggaggagggcggtggcttcgatggtgcggatggggatgacacggattgggtggtcggtggcagcttgtctgcatgtaggagtagatgggaagaggtgagaagtattagaaggagaggtggccatttacatgtgggctccacatgttctttaatctttttttctgactaggatgccacattagcgaaaaacaaacacccatattattatgggacctgatttggaccgttttgctaagataatgggtggagatttctagtattgcggtttatggatgttaattagacttgagtactcgacgtaaagatgaggggcagcaagtggacttattccaatggcataaatacagcttaacctggctttcacacctctgaaaagggctagttttgaactggcgcttggcccaatagcaggtgatcaagcgatccctatctaggaattgctatttagcacaactacgttctcaatatgcattttttacttttgtttgcaaaacttttagtagtgcctgcaaacttccatttgtaagtctttcactagaaactttgttgtgggccttatggaccaaaaggctaaaacatgtgtgcaactgtgctaattagccttcgtgcctctcttactaaaattgctcaatattatttgaacataaataaatatatatttgtgttttttttcacgctgataaaaatatagttgtgttaagaggtacatctcctaagggagaccggctctagagaaaaaaatatgtgaagactggctcgaaaggaagcctgtgcttatctacttccaatacatggtatatgtttttagtcagtgagatccagggcgtgatgaaggaggccagggatatgaagctgaagaaggcgaacagggactgcaatcgtattagccatattttagctaataaagcccggtgtaagtcccctacgaacttttggccggacggaagttgtaattttatttcccaccttgtgtgctatggctaagtaataaagttcatgtttttccccgaaaaaaaagaataaactaaacaaacctatagccttatttctatctatctatggtaaatctatggtaagaaaatctagtggagtttccaataattctaacaccaatggtgaaggctcgagcccccgtcatctcatggttgatgcgcccctgcacaacatgtgtccatccataggatccaccggctttaaaggtggacgacggaagcgacgaaggtgtattttttccatatcctacggtcataagatcccatcaccctcatgtaccgagaaaaagcaaagcctagtcagcatttcgctttgtagcgatactcctacactcgcaaatagcaaactacagtactaaacggtgcgtttcgctttacactcatgaagatataaattttatctcggtttccgttagcacgcttttcaaactactaaacggtactccctccattccaaaatatagggcataaccacccttgacccaaagaccaagaaacaattattatcacctatttgtcaatccaactaatacaatacatgcacccaatagaattaagcatcttgtgagtgtatgatttaaataataataatttaggagagaagagatgctaattaattgccatacatgtatgcacgccttatattatgaaacaactttaaaaagtagttgtgccctatattttggaatggagggagtatattccatgcgaaaactttttatatataagttactttaaaataccaaatatgttcatttatcagatttataataattgaaacttaattaatcatgtgctaatagctttctcgttttacgtacatcaacttaatatttatcttcatgagtttcaaacatcaccataatgtaatcaagggaatgattatggaaggttatccaaagtttgagaaaaaaaaaacatcattggacgagaacactcctttatcctttcttggagtagttttttgatatctcattagcattctaagatttcgggatcgttcaaggtaaccgtggttagccaggtccgtgacagttgctaagggtaaccgtggacgtcacatggcatcgccaggtttagtaggtctgcagaatcagagatagatcgcgagtcaacctctccacttctccaactctcgccgcatggttccggtaccaaaataaaacttcagcccatctgatggtgacggggccgtgccacatgcatgctaggggtcgaagcagaggcatttggctgtgtttagtttcttctaaagttagaagtttaggttaaaattgatacgatgtgactgaatgtgtgtgtatgacaggttgatgtgatggaaaaagttgaaagtttggatccaaaatttagatgtaaacacagcctttgaaatgcggcatttccactgtccttgaagctttcgcagcctttcgctctcttccccggcacccaccacccgtcacgtgaacggagcacgccgcgggcatattctcgacccctcgatgcgttggtgaattggtggtgttgctgatggcgctaggttatctaattctctgagtaccgagtgataccgctggactgctggcaggtacagtacaatatattttccgaacatcagtcggtggtcaatgcagcttactcctaaaccgagctgtcagcactactttccacctgctaattaaaacttgtatcccgagacagagcagtcaagattcttgtatgattattttaggaagcaagaatgtaaaacctgtctccaagttgtatttactctgtaactaaaggagtactagtactacttttgtatgtgcaacactagaaatacagtaacaactttagagcgaagctttgctgagaaagagggcaatacagttaggccattcacagtgcaccctgctggtattcagcccgagcggtccacataggcgagccgccaaaaatcgccgccacgtcctagcgttggcccacaaatcgcgagcgcgtgtgaccaaacttggtcacccgttcttcggcgctatcgaggcggggcagcgtggagaaacaagggcatggcgcattgctgaggcgtggctttgccgcgcggttcctcccggcgcgcttcatccccaaatcgccctccctgcgcgcgcgtttcttctcctcccgcgctcgcctgaatcaagcacaagacatgaacagctgcattagtcattgactgattgacatactgcactgatcgactgttcatctattggaaaatcaacatccaactactgaaatttcataatcacaaagaccaaaaaaaactaaaccaattcaaagcatgaacccagatgagaacctggaacaggttagcacacactgaactgattgatggcttcaacacctgaagcgtatacatgaacacaagaccaatctagaatcgatgctttagtactaatcaataaaaaagacatcgagaacaaacaacaaatcacgctggaaagaacttgccttcctcaacagaaaaccgatctaaaaaattctatctgaaagagcagtccaagaagaaagaaaaaacaggagatcagtctctgcaacaaagcaacccaagaaactaacctcccagagatcgcggctcgtcgcgccgacgacggggagggaggggcgccggcgacgttgatggggatgggaaggaggggcgccagcgacagggatagggatgggagagagggcgccgacgatggggagggaggggcgccggcgatggggatggggatgggacgcggtgagggggagaagaagtggcagctccagccttatctgattggggagaaatctatacgtattatctgacttttggggtgcaaagtgtaaaatttggatttctttgttaatagaaagatagcaagggactgaaatagaaaatacgaggggctgaaacgaaaaaaccaaagctacgcatgaagacccttgcactgtgggagagaaatttttttagggcgtggtttcagcgcacatggcagctgtggctcctcaaaactgttgggcgcattgtaaatgccgttatggtggcatcccctgcaacgcacgagcctgatgttggttatcactcactcacctgtcaatatgccattgctttgaagcacggttttccaatactggcactccgagaggcaggttcggtagttgccaggtgacagtcgttgcctgagacagtttgggggtgcagaggaggagtactagcagaaagaaggcatccattttgttgtgaaagatctttacatttccttgttgcttcaccgaccgtgctacaggagggaaaagccggcatgcaataattcgacgtcgcaaaccaaactgcaatgcttgcagataaagccaatcgtatcagttaccgtcatactcctactgttcttgagtaccctgcctggacaagcatactatcatggtactcgtgcatggtacatgggcctttcattagctttacacaacgggattatatagtctgttatcttcttatgatactactaatgcattatttttagaaactctcatagtgtcatctcctgaacaatattaatttcttcatagttttgatctttgatccactgggcaggagtgtactgacatgcagataagtggcccactgggcagtgttgtggggttgggttcaataatgaaggataggaggaggtgagaaaagctaagctcatagtatagtcacatgtttgtcattaagtaacagaaggggcacaggaagaaacataaacaagagaaaaaagacacccacacgttgggccatccattttccacaaatcagcaccggccaccgcgtcctcttgcattaaggctaaataaaccatccattgactgctaggaaaaaccctccatttcaaccaaattgaacattttccataatgttactgtgcggagatatgatcaccggtctttaccattacatagtttttgtccattatataaacatggcagttctttgtgctggtcagaaaacgccatgcagtttttccatccccttctcactgtaactaagttaatcaaagagtacatcgacatcactagggccattttcggtgaaatgactctatgggagaaaacgacgtcttgcaaccttcacgtgccatgacaccaacaactcaaaatcctggctccgcccgtgtttgtgtgtctttctcaattgcaaactatcgtatataggggaacatgatagattcatgttgctgagttcttcttcttcttcttcttcttcttcttcttcttcttcttcttccgtaactgtgtgaattcctacttagtatataagtgggttgtttacattatttaatgaaacattatgttacctaaaaacataaataacatatgactatctttcttgagaaaatcctactagtctagtactgataatcgaaaaaagacattttttagaaagttctctctccatctcaaaataaaccaatctaagatgtaatgggacatcacccaatatgataaatctggatagagacatgtctaaattcgttatactaggtgacatctcatctaatatttgtttattttggaacgaaggggtacttcggtacataagaaaacacaccctacaaactttgaggggcgtttttctgaaggatcaaacttttaagggctagaaaggaaaagaagagcgctcctcttcgaggcttcaaaccccaaccaaacctaacaacttcgaaaacttgaacccaaaaccaaaacgaaagcgagccaaaaaagctgtagtaggcctaccataacacaaaagcccaaaacacacgcttccccgcaactccaaaaccggaaaacgaacaaatcccctcgcctcctcccccctcccatctccgcccccgtcttcccctcgcctcatccatctcccccatgtggctgccctgggtgaagacgcgcccctcctccccttcctccgccgccgactccccctcgccctccaccgcgctcgccgccgccggcgcctctgctcgcttgtccttctcctctccctccctcaaggacctccaggctctcctcctctccgaccactcgccctccccgacgcc

SEQ ID NO: 70894 - DNA, 39982 bp, Oryza sativa
tcctctcagagccattggcaacccatcacggactaggcattccaattcttccttccaaggataatgcccttcttgattcgcatcaacattcatgcctgaatcagcatcagcactatcagctacaggcccttcttggttgggatcaactttctctacatcatagaactcatcatcggagtcctctgagggtttgatttcttcattatttgcagattggagttcattcgctgcattctccttatctgcagaagattgcttcttcttgacacgcaagctcatcatctccccaatgtggcctaaggagggccttatttccgaccatatctgaatcttatgtggtctctgctgtttcactttctgttcgtctgacaatttggacctgccatcctcagctttcttgccagcttcttcatcctcagcggatggtgaaaccttggcatcctgatcctctccggatgattcatcgtactcagcttggctatccagaaaattcttccatctctcagatctctcctcttcctcctcctggagattatgcaatgcaactcagcgagatggaacaagaaggtaccaaatggaggcatcaccaggtgcagcttttctaccttgtagatgtttgcatactctctgtaccgttgcaagtgttgtggccgcacagcgaatccatatgcatccctgcaccatccacaatagcatcagaaacagaaaggagaatgccgctaatactgaaccgttggtactcgagttatgtaccacaagaccggaaccaatccaaattcatactctagtgagtttattaaaaagaaccaaaaattccaactaaaatttggtcctatcatgtttacaatgtctgcctcgtaaaaaatcgagttaatttgcttcgattgtagcggacatccacacaaactccgatccttccatggatcagagaagctaacacgattcaaacactcctttctgagggagcaaaaaaaaaaaaactaatcacatcgtacacacggagatctaggactgcattgcccaaatttggccccaacatctcgcatcagatcgagatccccgcgcaaaatatcaccacgagaagaaaaaaaaagcaagtaaactacacgcaagcggaagtttcgtgcagcagaaacttcaaaaaacctccggcgaaaaacttccgaagaaacacatcagaaacagcaaacaccggcacgaacgccgagatgcgcgcgcgcgcccgcggcggcgggagacgaaacgaaccgcttgtgctccgaggcgatgaacgggaggctcttcgccttcatctccacccgcgccgccgccgccactgactccgcgccaccaccaccaccaccaactcctcctcctcctcttccttcccttcgctcgccggtggcgaggcgtgcagtgcagcggcgccgccgacgcaacgcgacgcgacgcggacggcgaagcgtgagcgagtgaagtggagtgtgaatgaatttagcttatcggcggtttggagggggggggtcacggctcggggaggcagcagcgccgatgattcgattcgatccgatcgccgtttactactactccgactcctccatcctacgagtcgtaggatttcgagatttgatctgtgtgcgtggaagcgtgaagctgcgaggtgacagattggggagttgggaaattggaggacaagtcttcacaactcgttgaatttttctttcgaccggttggttatttttttgtcatggagattggagagatggccagatggggactcgggaatgaccacccctcgtgggtttctcctcgtcgacatggacttggcgctgggcggggttcggccacaccgagatctcgattatccgtgccaagtggagctgtgttcgtttgtgtgctgtggactgtggagtgtagaggggcctgtggtgggtttttgtagagatcatttttaagttgggtattgatttttcttatatggatttgttgttggcgcatcgacatctggggaacacataaaatccatcattaagcttgtcttatttctatctttggcatactcactaataaagtatagctagtctttattgtggcatagtattaggagacaacctttaatagattctccatttgacatgtgatattgtaatgattttgtatcacctaacttttattgtttgatgaaaaatcttggatgacaaaaatgttgctgtgttaggatatatttgttgataaatgactaatttggaatataaatagtcaaatagaaaaatatcaaatgacaaattgacataaatgctacggatgtgcaccaacaaaagcaaataatacttcctccatctcatatagtgcgttattgttttatggaaagtttgacatttgtaaaacctaagatttatttaaatggggctgtctattgcaaaatttgacagagaactttagattttcctcgagttgcatcaagattcatacataaaaagtaacattatcctttctcattttcttcttctctcctacatcgctcgacaatacaagaggagtaagctctccaacgttgcttgcatcggcccatcgtccccgcctcaatgctcgcccaccatcctcctctattcccactgtttcggtaacactgtcttgttgttcgcccatgtacatcgctcaccgctacttcgctagcccttcactatccatggctatcattctaagccctagaaaaaaaaaccccttccccactctcactgtctcacaccctaaaccctaactagtcgagggtccgccgcctcgctgaagttacactactcattggagctggatgaagagatcaatgtgaatcatggcacggatctgatggtttaaaaatcgatagaactctccactaaatttctgtcacatggatgttagcaattccgttttaaaattttactcttaaaatttgatctccgccgatgcaagccagctgagcgctcaccaaatggtgcaggtgctgcacgccacaaaggatccatggtgtacagattatatttcggacgaaatgatgggtacgtgcctcctgcatgaagcggtgcgatgcatcaggcgagatagtagtaggaccaggcgcttcagcacagccagtgcagcagccttctgcaacgcttcagcgaaatgggatcgattaccctgcccgcctgccggctctctccggccggctttgcgtttttcccctctttggtactagaagtagtgagtactcatcacctcaaacttttacccgggcggctccagttattactgtaacagcaaccggatccataaatgtgtgtacgcttcgtccatttatactccgggccgtgctgcttgtcctctctgaattgaaccctctgtctcctctccctttgcatcatttcccaaagtacagcctggatgtgagtatgtgatgtgcatcgctcgttccggttggcatcaaccgtatccgtcctgatgttactccgatttggcaaccggaacaaactctagctgtcgacccgtcctctcgcgctcagctactttcatcggatcggaccaagctatctcgcgattcaccgatgaagacaggtaggagcagagcaatagaaggaagtgaaaagaattgatgagatggtgatcgactggcctcccaacaaacaggagacagggtacctgcagacctgcagccgtcctgacaagaaagtgagcacctaggcacgccggtctcctccttccttggtttcatcataaactgcaacttgagtggcaccccggccgaagtactcctatagcatccggttcaggacttcaggtggagctaacgggttccttttacttcgtggtgaaaacggagcacctgaattaggccctgtttagttccaaaggatttttttttaaactttcaactttttatcacatcaaatcttttatacacatacaacttttctatcacatcgtatcaattttaaccaaacttccaaacttcagtgtgaactaaacacagccttactgaactaccagtagtactaaggctctgttcggtatccccttttcccaacccctctctctcgtttttagtgtgtacgtttttcaaacagctaaacggtgtttttttaaaaaaaaagtttctataggaatgttgcttaaaaaatcaaattaatccattttttttttaaaaaaaagctaatactccctccatatttataaaggaagtcgtttagggtaatgtttaagtcagatcttgggaatataaatcattaataactctcaagttgttgagtttaaaaatataaaaattatatgaatagatttgtcttgaaaaatactttcataaatatatactgtcagggttacggataaggtataccctctattcttggacatacgttgtatactgatgcggtatactcgcgcgtatacggatgattcctgtgtacattaaggaaatctatcacgtgatagaaacaaaatttacagatggaatgagtcctactcggacaagactgggtctttaccatatcgtgaggggtccgatatctccgagtcctacttggagatcaactgacccgcgatataaaatggaccccctgggcaggacctaaggcatcgaatctcattgtcaacacatccaccacagcctacgaagctggagcctacaggagccaagtcgccgggtgatatagtcgaaccaactcgacaacggtcttgtcggtatcatcgagttctgttattccctttgtaatatgtggtttccatcatataatctcatatcaattggattagagctattaccttccaagtggcctgaaccagtataattcttgtcttttgtttgcttgatgtcatactacgtagatcctcataccagcgtaccccaataccctctatatccggtctacgggtatcccccgtcgacatatacatatatcatttttcaataaatatttttatagaaaaaagaagtcaaagttatgttttggagaccgtgtcgctgtcataaacgacttcctttacgagtacagagggaatacttagttaatcacgcgctaatatactgctccgttttccattattactgttgggaatgggaacagcatgtgcgaacacagcctaaagtccatactaggcattgtttagttaccaacttttttttttcaaacttccaacttttccatcacatcaaaacttttttacacatcaaaattttcctacacacacaaacttctaacttttccgtcacatcgttccaatttcaatcaaacttccaattttagcgtgaactaaacacaccccagcttatgctatgcttataaaagaagggtggtaaactggtaatgtaaggttgagtttagttcctaactttttctttaaactttaaacttttttatcaaatcaaaactttcctacacacatgaattttcaatttttttcttcaaacttctaattttagtgtgaaactaaacacagcctaaatatgcaactctgctgtgctgtagcacattaagcctgtccagtacgtatacgtagtactactaactactgctactatactagctactcaaatgacgaaacctacccgcttgattgtataggctgtgtttagatccaaagtttggatctaaacttcagtcctttttcattatattaacctgtcatacacacacaacttttcagtcacatcatctccaatttcaaccaaaatccaaactttggattcaactaaacacagccatagtccggtagtcccactggcattttcaccggtaatgcgtacagcagtgcgctgctgatcaggggaggctatggggttttcctgcctgtctacgtacgtactcacgacgtacggacgagctaatgctagcacacagagtaattcaggcgacgtaccgtccagatctcgatcgtgaggtggctggctggctgagcccgtcgatcgatggatcgcccagtgtcggtgggatagagtacgccgtggcccctcgtggcatgttcgcgcaaccggcgcggctcacgcgcgagtggttgaacgatgggcacactggtttagcacctagcaagctcgcacccaccacaagggacaacaccgccgccgtacatggcgtacagctagcggtacaggcacaccgcgcgcacacgaaccaccgcgaatacgatattgaggggtgcggcgtgcgccggagcatgcatgtgcttgtcttcgtatcacctgacaaggtcggcgcacgctagctagaaggccaccgtgccggccggccaccactccaccagcctaccgcggaggacggcagattgccgtaaatcgtaataggaacaggaatataaaaaaattccgttgccgggactcgaacccgggtctctcgggtgagagccgagtatcctaaccagctagtctacaacggaggttgctgcttgagctcggagattgctagtagtagtcagtagccccgacaaccagaccaaaataccaaccgatactgactgtcacactttgatagcgatcggaggtcaacttctacgaaccgctactgcacggcgcagggccttgcgacttgccgacagcgttcaagtcaaaggaaacattcagcattcagaatgctgaattcccacccgctcctttggctagaggcctgtgtgtacgtatgggtggatagcgagcccagattgactcgtgtcagctcatcaagataataagctagctcggctcaataagggcagtcccaacccatagtgttcataagtagtgtctatagtgccatgtcaataagacatcacaatagaaactacactctataacccatggtttcttaaagtgggccattaataaatatatcatctctcttctctaccaatcataattattcttcatctattatgaagacactattctctcccaatacataacttgatagtgtctagtgcataggttctcgtgttgaagctgtgtcttacatgagacccaattttttcctctcttcactctctctcttaattaatatagtgccacataagctaaaagtcctacataataatgtagttaataccataaacaccattctagatggagggttgggactgccctaagcaatcgagcccaaacaataacttggctcggttcgtaaaaggagctcgagctagctcattttggctcgcgagctactctactactagctgaggagctccacgcaagacaagtgcacaagtgtctgcctacctgcgtgcaaatgcgcaacgatgtgcatggcgatggcggcgctcgtcatgaggatgggagaaataaattacggttcagtaatttcatagcttgagtatttaggctggcctggaatggtcgtatggatggactgtattgtgatggggcctcaccagttgtccatattccctaataaaccaaaacggtttactatagagtaaaaattaatttataggtgaaacttttatatatttgttcgtagcgacttaaacaacaacactaaaaagaaactacgttgaaaatatcttaaaatcaactccaaaattaagtttaaaaaaattaaaaatttacttttgctttagcttattagcccaaccgataagggttattggttatttttcaactgtccttatgcatctagcgctcgcttagcatatttttctttttgggctattggacttgtgcatagctcgttgggctcgttaacttaacgagctaaactgctagcttggctcatcgaaaaattcaaacgagtcgagccgactcagtcccgagcggccgagccaaacgaagagtatggaggcggggacggtgggaagtgggtcgccaccttcctgaggtccatctcactgggccggcgaatccgcaggccggaaataggacggatgcatacgatatctgggccggatacatgcccgttagtgggcaagtcctagatcacgtcgccactggactgtactacatcacaaggaataagttcactttacatccctcaatttgttgccgagtccgaaatttgttccagtgcaaaaccgggtacaacacatccttcaacttacaaaaccatgcgaggtccctcggcagtattgtgcccagttttggctgatgtggcgtctacggggctcctttgactaagtcttcgtcccaagtggagcttacgtggaaatttgataaaaaaaaacccataggacccacatgtcagtttcatatagaaaataataataaaaaaatggtgggcctcacatgtcatccttactactctatcttctctctatcccctactctgtagtctgcaaggagcggtggcgagcagtggcgcgcgaagtcgatagggtggcgagcggacggagtggcgacggagagcctgcgggagtcgagatcgtccggggaagcaacgacggcaacgacggcagccttgtatcccgtcggcgaggtcacgctcggccattgcgcacctctcccttcgcccatcgccatcgagcccccacccacggcgcccggccatccccggcgaggagctctgtttttggtgggtgtcggcggagttggaacgaaggagggtcgttctcggcatcgatgtcgccatctccgatcctccaccgccaccgccgccctccccccctccattgccgacccctccccggcgtcgagaaaatcctcgcccgacctcagcaacaagaacgacgagcgaggagcaacgacgggaggagatagcccgcgcagctgtcgtgcttgccggcgacctccttctctgcctcttcctccaccggccacctccactgcccgtggcctgccgccgctccgccggcatgctttgaccgccatcttcgttggaggcgacgaggactaggacgacgacgacggtgcggtgacggctgtgaggtgacgctgtagcgcgatgaagaagaagagggaaagccaagaggggagaagatatgacatgtggggcccacgtgggccccaccatttttttagctgatatgtgggcccatgatttttattatttttccgagaaataattgtcacgtaaacgccacgtgggacggagacctagtcaaactagacacgtaggagccacctcagccaaaaccgccgagtcgtttacaccggttttgacagtttagggactggttgtatctggttttggggttcaggatgaaaattgaattcggtgtaaaattaagggacctctggtgtacttattccacatcacagcgcttggtgaattagctgatggattgacgtcccagggccggtgctggacgaccacggcccatgcgtggggctgtggccttggcgtcgcggtcgaccacgtatgtgcacggttcagtgatggatgaggtattaggctcggcggcgatccgtgtcgcgtgtcagcggtgcaacgaaagataaaaatgctccaaaatttaaaaatttccgttgccgggactcgaacccgggtctctcgggtgagagccgagtatcctaaccagctagactacaacggatcttgtttgataacgaactgccaagcttatatttccctttgtttctccaaacgaaaccctaaatatcctggaaaagagatactgataagtgctctgctccctatatccacaataattcagcatggtttcactgccaccttatataaaaccgtaaagcagctcgatttgacgtgcctaccatctctactataataaagataaaaaaataaactagagtagttatggacataatgcttgtctttcaaaccagtatcattgatcctcattgcgaggactatatcgaaatccgattgctttcctttcaaaaagagaggattgaatcgaagtcctaatcgactctttctttccgtgctagcaaaatgatcaaaatcttcagatatcatgttggtaggggaatggtctcatcgaaccggtgcactctcgctatttcaatgccaagaggaactatcaaaagcaagcttttagcgggcaaaataatcccatggtccaaaccattattgaagtttaataaactgacacatcagaagacactgccatgatctgcaggatccgctagctaccagaagttgttgctaagtgcgaaaagaaaggcaatgcgtttctgaataaattgcccgcgacaatcgcaagatgttctttttctgatgaaaagaacagtatctccaaacatacaaaaacgtcgtctttctctgcgttggaatcgtgagcaaatcgaaaggaaggaaaggaacggctcgtgctgagtggagctaggacaagttgaggaacagatggcgatcaggcgatggcgagccctacatgtcaagtgtgatccggatgctcccacgtgtcacccctgcccactgtgattaacgcactacctgcagtaggcaggggccaaacggttatggacagggagtcttgtcaggttactgtcagcgttttacctgaaaatggtaagggatattcttgcgcttctgcaggtttactgctgggtgaaagtgtttcccagtcgctttcccgaaggacatgatgtttcaacctgcaaatgcaattgtgctgagtgctgatcgttaattaattaatcaatctatagaatttatccaacttaatagtactatatttaattagctagattcgctacgttgaatgaccagctaacatcctccaccgaattccctatttcatttctctctgcatattgattgttctggttctacgggggcatatgtactagacgaatctttattagatatgaaaataatgaaacgacgcacgtcttcgagtgattatgatgtgcacagagtacaggtatgctgaaatatggatgcaacattgtgtttgctttcaagatggagcccaatatagctgagaaagataggcattgtcgcattgagttggtattatccatccaaagaacaattatataatcaatggccatcaagaataccttcttaatttgatttgagtttcaaacaagaaaaaggattcaaacaatctgatttgacaataatagctagagcccctttacttcatccagctttcactagaaatattctttgatatggtcactgtttagcagacagaaatgaactgtcgccttgaccaaatgaccagagagaactcagtgcgtgcatgcatgccagaagagtatgaacttaatctatcctggtggtagacatacgcccaagttacactagaaaaaaaatgctaaatttgattggattgcagtgccccattttattttattttttctaaaggttgctgttatcccaacttgctgatgttcaagcaaggaagtgcccatttcatgaatcctaccaaagccccaccaaagcatcaactgcaccctgtacacatgggcacatctccaatatgactaagatacgctaaccatctcttaattctttgtcacatttgcagaaccacatcttttctcttttgaaaacgtcggtaagacatatatagacaagatactcgtagctgtttgatattgatattgcacagtagtagtacaatctcagtggtttgtcaaaccgctcgttggaacaaaacttgtctttgccccctgggcctggaccgtctgcagtactagatctcattgagttctgaaaacaataggctacctcagggacaagactgatattttgagaagcaggacaggagcctggtatgccactacattgaaccggagaatcaagaccttcgttggtcatctctcttaaaaaggttcatagatcctaaagcaaaatatttttttagaggactaaagcaaattaaatttgatactgtaatatatttgaatattagataggggcaaatctttggccatttttctaactaaaacaattttggcctctatattaatcactttactttaatattcataaaaattttaacgatgtgtcggccaagaatggattttaatctattgaagggatgtcccctcatatatcttttttttctctcaaatataatgtaaatggtgttttttcgtttaaaaaaataatgtaaatgcggttatgattcttttttttttaaaaaaatacaatgcagagtatagtggcatcaatcactccataaaaattaagtttgaaatcgatctatacattgagaaaaaaaagagaaattcaggcaagaatagtgccaattctattcacacattggatttctgcatttcatttcatgaatgtacaagttaagtttagacacttgagaatctgtgaagtggtatatgtagattggatgagtgttgtaaacattttttttttgaatttctcacaaccatttaggtggtatttgagtgaacaagccgacattccctctagggattattgatttctctatttttttcatacgcttcgtgtatctctgtattaagattaagaaaatttacagcggttctctcgagcgacagagaaaaaaaaagagaagtagacaaaatgatttatctgtggtaccttaaatatgattttgcagaataaatgcctgttttagggtttaggtacaaaaacaaacaaacagagccggtccgaaagagaccggaccatgtgcctggtacatttaaagtatcagcctgtctactctaattccaaagtatcattttcattttttttttcactgaacctccacagagatgtcaaagcgtagagaatacaacaacaggaatgcatctgcatctcgtagactattagtttaataaagctccgtttccgtacttaaacaaatgaaaaaaaaaagttgattagaacgagagggctcactggagcagttgatcagagctagagtcgatgaactctggtctcctcccaacgtgcggcccattttcccggcaccaaattctgcgacgactcggctaaaatctgcgagacatgcgttgcaaacctccgatccatctcgtgatagatgcttagtactacatcatgccaaccgttcttctcccaccggccggcttgtggcatttgcagtaatcttggcgtataaacaattgcagcttggaacattctattccatgccatccaactcgttttctttagtggcaagcacaacgctgcatggctacgaattcgtcaagcctttccgcgtaatacacgtacaggagaatctctgataaccccttgtcaaagaataggagttagtgtgtgctagctagctgacctggaggaggacgatgctgtgtgatcatgtcaataaaaatcaatgcagttaggtgaggtaaagagaagaaactccatgaaaaagcatgaaagcttcctccccaaccgattgcaaaagggaaaaccaaacgaacatttgatcgatcgatcactgctcactgtcatgtcaaccaagctggcagccattgcaattgcaagccaagagaaggttgagaatatcagtagcagtggcacgtgcggctaacaaccatttctctttgcagggctcttgcttcacaccccatccggcttggcctccgacagagacccaccgacagcgagctccacttgttaaacgatgatgatctcaccgacgattctcatcttttaattggtcattttcaggtgtcgcattttcgcgccatcctgctgcaaaaagccatccctatcattgatccgctgtatacgagtgccattcttttttctggacaatggaataccacatttcggggcctccatattagttggtgaatgatgccctttccattagcttaaagcttctgaattacctgatttgaaccggtgaatatgacatatgcaaattttgatagaattgtaatgtgttgtctgccattagggaagaaatgtatatgtctagaactctatacggcaccgtgcaagcaaataggcgagctaatcatcctgtcctactgtccgagcaatctttaattttttaattggaatcgtccgagcagtattaatgtcctatttacgtgcaagtacgatgactttgttattaattactgtccttgttttgtcatgtgctaatcagggttagtttttttaatcgattaagagcgagcatgcttggtaaagctctcctaattctgcactgtttaaagacgtcgcaatgatagatcataaagatgcaatgctccattagaaaatttgagacaagatttcagatcattggtggctttctcaaaagttcaggcgatggctttcacatttgtgtggcttttcagactaatttgataatttcaggtggccaccctttgccatatattaatgcgttctacaaagctacacacatgtcccaagcaaggtactggttactaccttgcgttagttgatctactgcactgcaaaactgtctggactagggccggatgcttttctggccccggaggcatttttgctgctgttgttgttgatcagaaatcacgtgttcagttcacacatcagtgatctccaccttgcaaagtccaggcatcatctgggtacatttttttttaatagagatcttttacagtgcttgggaggtatgctaggtaccttccaatgtattgcacatccaccgtttattttttgagtgataatttagaagaaaatcaatataagcaggggtagtttagtactttttatagccacaccatctctaacttatctcgtggaccgttttttataactaccctcgaagtaatcctcgtaattctaatctcctgcgctcgtcgatctaatcattacggcctcacagcatcagtgcattttatttgctgtaccgtctattcatatatagattttagtctaattaaaactactttttccatctagttaaaatttgattcttcataatgattctctgttacaatctacacgcacgagaagcaaatattttctatttaatccaagatgcaactttcattaaccatcatcggtaactatgtggaaataaattactttgttttagattcgtattgatatatacttcagttgattaactcataaagtaccgtacgtaaattactttgttttagattgaggcgccaaacgtcagctgccatcgatctgttgcttaggcgcaggaacaatacgcaccaaatccgacttgtttggaagaacgataaatctgctagtaattaatttgtgtttttctatctattgtaatattcgacacaaaattacctatttaactttgcacctaatcttttaagttagagagaattcactcagtaccactgagttcgttatgattcaacaatatgccactgactttgtcaacttccattatataccatcgtctttgctttaacctttacaatttaccatcacgggcacaaactgttaatttgcattgaagaaaagacaaatacgtccttatgatgcgtgaagaccagtagcactatgaccatggcatgtagggtcctgagagtgataataattgagagagaatgtacaacatgactacacatgtgaaaaatatctcaacatgattataaataataatgaggacatattataagtatgaataatgtacagcatgtgtgcaaggaaattcatccataaaaggtgcatagcacaatttgacagtaaggtacataatatccaatgtccaagttatgcaaggaaaaatcatccataaaaggtgaacattacaaaagctaaataaataagttacgtggaaaagatgttacaagtacatatcccaggatgacaattacccatcttggatttcaatggagagagcaacaacggcaatcggcaccgggacgacctccttcgacgacgatggcgcgcggcagcataggggcatcttctcccatcggcagcacaggggcattttctcccattggcagcacctccttcgacgatgacggcggtgctgacgacgacggcactaccagcaacagaggcgcaaggaatggaggagccggggacggcggttgtcgcggcgccaggcccgacgatcggggcggagagggggacggctgttggggcggcgccggggacggctgtcgctttggggacgacgggcggagatgtagcgcggcggccggcagagatgcggcgcggcggcggagatgcggtggccggcggaggagatacggtgcggcgatcggcagagatgcggcgctgcggcgggcagagatgcagcgcggcggcgggtggagatgcagcgcggcggccggcggagatgcagcggcgggcggagatgcggcgcggtggtggcgtggcggcattggcgctagccctaggaagggctcgaagagccgattgactgggcgctcgaagagaggattgactggttagggttagatgaatcaaagggtatttcggtcattacggaaaaaaaataacagtacaaacggcatatagatgactgtctgtggacggcgatggtaaatcgtagaggttaagggaaaggcgatggtatataatagaaatcgacaaagtcagtggcatattattgaaccgtgacgaactcagtggtactgagtggattctctctttaagttaactagctgggtggcccgcgcgattgcgcggctagcacccatttaaaattatctattttctaaaatgattttacttaaaatttattaaatagctatctcgttgttttaaaactttaaaagaccaaaccttattatccccgtgattctaattttatagttcaaagtcataccagttgttactccttacttcttcgtcacctccttccttatttgtttgctcgatctaccactgcttctattctctctctttggaatctttaaaaattactccctccgtcccaaaatataagcatttttagctttgaatctagacaaccatgtgtctagattcatagctaaaagttgttatattttgggacggatgtcgtagatattatttagatatagtttattatcatcattgagtttcatttttatatttttttagaagtcccatcaaacgttgtcactgtactcctgtatgacccatccgttgcctgggattttaaaaatcaaacatgattatcgtttagattcattttttactttctagaagtcccaccaaaccatcactggctttgccactgtacttctctatggttcacccgctacctgccctctttattgtccttgagattttaaaatcaaacatgattatcattggggtttattttttatttttttcatgaccgtgttgcttaatagcctatccatcgtccttgcttttaatcgtcattggattatatttggggttttgttaatagtttttagatgtctcatcaatcgttacaactgcttctattcattctctttggaacctttaaaaattggaccttatagtttttagagtttattatcttcattgggtttcaattctattatttttggaagtcccatcaaacactgccactatactcctttacgacccgtccgctgcctcatctctttattgtcattgagatttaaatcgaacataattatcgtttgtgttcatttttttactttctagaagtcccgccaatcatcattggctttgccactgtgctcctctacggctcgccgctgccttccctctttattttatattttttggatgtcctgccaaatgtcgtgaccgtgttgcttaatgacctttccgttgttcctactttcaatcatcattgggattctatttggggctttatcaatagttttgagatgtcccatcaaccgttaccactctactcctttacaggcatgttgcttctcccatctttattatcagttgtcatatgttttctagatgaattttttgtttgaaaattccataactttcattccgatatttttttatttagaaaaatatattcctactttaactcttataattgggtagcccgcgcaattgcgcggctagtacccgtataaaattattatttttacatatgattttatttaaaatttatcatttccatgtttctaatttaaagtttttaaaagtcacgttagttgctacccttgctcctctgccacacctttatttgattgcttgatctatcattacttctatttatcctctttagaacttcaaaaattagaacttgtagttttcagatttgattgtctcgttgggtttcatttttataatttttagaagtcccgtcaaacgtcgtcaatgtactccactacggcccatccactgcatcctctcttttttatcattgggatttaaaaaaattgaacataattattgtttgtgttcttttttactttctagaagtcccaccaaaacattaacggcttcgccactgtactcctctatggcccgcccatagagatatttaaaatcgaacatgattatcattggggttttactttttataagtctctccaactgtcataaccgtgttgcttaatggtatgcccgtcgtccctcctcttaattgtcatttgattctatttcgggttttgtttatagtttttagatgtcccatcaaccaccaccactctattcctttacgggctcattttttctcccctctttattgtatttgtcatcgtagtgttctaaatggaccttttttttttgaaaattccatatttttcattccgatatttttttatttataaattatattcctacttcaactcttataattatttttctattttcataatttattttatttgttataccgaattttcattaatctctctatatggtctcttctttcaataattcttttttagtacaaattttagttatttatataatgtattccactctcatttttatttttgtattttcgtgtttttttattttgaatgtcaattactctcatgtcgtgttcttatttggagataaattatattcctatatgaactcttataaatatttttctattttcagaatttattttatttgttattccgaattttaattaatctctctctctatatagtctcttctttcaatagttcttttttattgcaaattttagttatttatataatgtattccactctcatttttatttttgtattctcatttttttattttgaatttcaattactctcgtgttgggtttttatttgtactcttctttcaacattgcttatttttaatttcgaattttagttattttactacttgaaatcttctttttgttaaaaaaaattcggattttattttatttatattttaaattttaattaatctcatattggattgttatatagactctcctttcaatattgcttatttttaattccgaattttagttacttttaaattgtatttttacttgaaaaattattttttgggttaatgtaggaatttatatccctcataacaagagtagagtacaaagagttagccgaggtaattgaataaatggaccagccatcaaatatatctatttctctcgtgtactggtcgtaccttctctttctttggctcctatttcttcgttattttgttggagacggcagatggaaactgtacgtgctgtgattgctttgtagtatctttttttttggtagctagccaccatagcaatcggacataaaatcatacacggacatagcttttttccctagattcctattacaatttttgtttcctagtcctagtttggtaagaaaagtgtatctgctgctggccaatttctataataaacgtatctgtatctgattaccatattaaaacttctatgctattaaatctcagcccttaaaatttagacaactaagatctaatggtgtaaagttttctctttttcttctattaatgtgagaatttctagccgccacaacgaacgtggtgtcttctttcaaagctgttttaataatataatagatagatagatagatacctggcccacattttcaagtacccacccacacataccttctgctatagatcgttggattgcatccaatcaacggatgccatcattcccaagcaccatagcaggtctctttttaataaaaaaataaagaaagatacacacagatcatcattccctctgtaaatctgtaactccatcattccatcaggaccgaaataaagctggaattcgcttgccttagaatcaaatcaagcctgaacctccggtcatcccggctgctgacagtaactagtggatgtgagtaaaaaaaatcaggacactggccgtcgagtgaacggaatttacccttgagattctccggccgaagatagtgtgggccttgcacgcgatagccactgtaaaacatcgggacaaacctgtcacctgctcgaacaagctaagatcgcgccatcgtgtggctccagcttctgcaaacaacaagggaccgtatattcctggagctagatttttggctgtgtatgtatgtagccaagcaacccttgttcaagtacaaaacgtggtacatatataaatgcaatcttggtcgaaaagaccggcgatttggcgtgtatatagccatcgcggtaatgacatttagccaagctattagtaaaagtgaacatccttttcagagggaacagcaagtgatgagcaagatggtcagtattgtaccaagtgattaaaaaaatgaagaaatgtttgttaactaaaaacgagatttacagggaaagtcatccctccaaatatattttttaaagaagacattatgaagttgttttactaaattggtatatattatgagcttgttttttttttgcggggatattatgagcttgttgatgattgaacatgaaactttagacttaaaatcacacattatttaccactgtgttaagtgtatctaatcgttaattaggctagcgatccggtcgcttttggtttatttttccaccctccgatttcttccggtgcctgccagctacctgcggcaaaggccaccacacgacacgcaccaacagacccctttccggcgcgggcccactcggtcaggctcagaaagaggccagccaagttgccccacctaacgcccgcctccctgagccgtccgttccccatccgatgtcccaccacccgcccacgtgtccccccttaccttgcctgctcgagaaggcaaaggctcgcgatgctacgtgagccgtggatcttgtatccgacggcggaaatctccccccgcgcgcagcagcaggcggtgcacacgacgtcgtcgcaacggctataactggagacgacatccgcgcatgttacccgccatatctgtctccctctccccttctcatctcccgagaagtagtagtagtagtcgtctagtagtagtagcctaccaccacctccctcggcgagcgggtcccaccggccaccgtccgtactccggtgagccggcattgcgtgttccgggatggcgtcgccgtacgaccaccagtcgccgcatgcgcagcacccgtcggggttgccgaggccgccgggggcgggggcgggtgcggcggcgggcgggttcgcgcgggggctgatgaagcagccgtcgcggctggcgtccggggtgaggcagttcgcgtcgagggtgtcgatgaaggtgccggagggggtgggggggatgcggcccggtggcgggaggatgacgcggatgcagtccagcgcgcaggtggggctccgggggctccgcttcctcgacaagacgtccggcgggaaggaggggtggaagtccgtcgagcgccgcttcgacgagatgaaccgcaacggccgcctccccaaggagagcttcggcaagtgcatcggtgagtccccggcccgcagcttccatcgatggtgcgatccagaaacagatagccgtaaattcagttccaaaagggcgattagttgttgctaacaagaacacagcagaaatatctctgattgaaggaatattgtgttggcgccatctttcttgttttctgtcaatcatttttatgctccgcaacagttgtgtgatgatgccgtgaactgttcatctttgcccaaagagttggcagggacagctctgcctaactgagatcggctctttgcttctcaactaatcccctcgaattaatgcttttgctttgcgaaatggtccattattaagcagtaaatcggtacagcaaaagaaacgagtactctgtacttctcttttgttattgcacatgcttacggagaaaatggagttatagcgaccggttcatgctggaggcagttaggcgatcgatggaataataatcgtgtagcgctaagcgaatcatttctctttttagatagtttggatgtctaacaatgcccatgattcatgatcttttaattgaactaagaaaaattaatccatggtggatctgcttggcatcaaaaggcatgggggactccaaggagttcgccggcgagctgttcgtggcgctggcgcggcggaggaacctggagccggaggacggcatcaccaaggagcagctcaaggagttctgggaggagatgaccgaccagaacttcgactcgcggcttcgcattttctttgacatgtaatggttcaccgtcccagttataatttccaagatgaacacgataaatcgatcgccaactgacgaaatggattttttttttccttccccctctctctgatgcatccaggtgcgacaagaatggcgatgggatgctcacggaagatgaggtcaaggaggtgaggacgaaagaattcttctggattggatctcatctgccattctggaacatggagagagaggattaaatatcgttttcttgtttggctggaatggatttgcaggttattatactgagtgcgtcggcgaacaagctggcgaagctgaagggacacgcggcgacgtacgcgtcgctgatcatggaggagctggacccggacgaccgcgggtacatcgagatctggcagctggagacgctgctgcgcggcatggtgagcgcgcaggcggcgccggagaagatgaagcggacgacgtcgagcctcgcgaggacgatgatcccgtcgcggtaccggagcccgctgaagcggcacgtgtccaggacggtggacttcgtgcacgagaactggaagcggatctggctcgtcgcgctgtggctcgccgtcaacgtcggcctcttcgcctacaagttcgagcagtacgagcggcgcgccgcgttccaggtgatgggccactgcgtgtgcgtggccaagggcgccgccgaggtgctcaagctcaacatggcgctcatcctcctccccgtgtgccggaacacgctcaccacgctcaggtccacggcgctcagccacgtcatccccttcgacgacaacatcaacttccacaaggtgatcgcggcgaccatcgccgccgccaccgccgtccacacgctggcgcacgtcacctgcgacttcccgaggctgatcaactgccccagcgacaagttcatggcgacgctggggccgaacttcgggtacaggcagccgacgtacgccgacctgctggagagcgcccccggcgtcaccggcatcctcatgatcatcatcatgtccttctccttcacgctggccacgcactccttccgccggagcgtcgtcaagctgccgtcgccgctgcaccacctcgccggcttcaacgccttctggtacgcgcaccacctcctggtgctcgcctacgtcctcctcgtcgtgcactcctacttcatattcctcaccagggagtggtacaagaaaacggtaaaattctcatcaggcgctcgatcttcctgtgactgcaatgaaattaagtgacatcatctcaaaatgtcaatcttgttcctgcagacatggatgtacctgatagtcccagtgctcttctatgcatgcgagagaacgatcagaaaagttcgagagaacaactaccgcgtgagcatcgtcaaggtaagcagctgactcatgtaactgggatccattctttcttagctgtttgcctgttactcataaaattggtgatgtgggtgtggcacatgcaggcagcgatttacccaggaaatgtgctctctcttcacatgaagaagccgccgggtttcaagtacaagagcgggatgtacctgtttgtgaagtgccctgatgtctctcctttcgaatggtaaccaattcacccttgtcgcatgaatgcatgtccaaaatgtggtttatctgagactatttctaactgtttttcctgcctttgcaggcatcccttctccatcacttctgcacctggagatgactacctgagtgtgcatatccgtacactaggtgactggacgactgaactcagaaacctgtttgggaaggtcagttgaggcagcacagctgcaaagagttgcaagaacaattagtttccctcgttaaacaattctaggagaataatgcagattgccaaaagatggagaactaaatcttagtattcatgtaggcttgcgaggcacaggttacttctaagaaggctaccctttcaagacttgaaactacagttgtggcggacgctcagacagaggatactaggtgactagagaagctcttctatttcacctaccaaatgcatttggtctacaatcattttctaaccctggttatcttcacaatgttgcttcaggtttcctaaggtccttattgatgggccctatggtgcaccggcgcaaaactacaagaagtatgacattcttttgcttattggtcttggaattggtgctactcctttcatcagcattctgaaggatctgttgaacaacattaaatccaacgaagtaaaattcttccctgataaatagtgtttccttatttcctacaatgttgtataactggaggaaatagataactaaaatgagttgatggcaacaggaggtggaaagcatacatggttctgagataggcagcttcaagaacaatgggccaggaagagcttacttctactgggtgaccagagagcaagggtccttcgagtggtttaaaggagtcatgaacgatgtcgctgaaagtgatcacaatgtactgtctcactctcaattcttcgctgtattttcaaatttccatagttccttcagtcatagatagaacataaactaatatatgtgggaattgcagaatattatagagatgcacaattacctgaccagcgtgtatgaagaaggcgacgcaaggtcagctttgattgccatggttcagtcacttcaacatgccaaaaatggtgtggatatcgtctccggcagcagggtattcgacatcttccccctcttctatctgaaatacttatttatttccagtgtattcctcttatttctgattgatctgttgcagattcgcacacattttgcgaggcctaactggagaaaggtgttctctgacttggcgaatgcccacaaaaactcacgcataggtgagcctcttttttcagcgaacatcgtcgatgcaacaattttgagctttgcagtaacggttgttaacaaatccataaatatgcaggtgttttctattgtggatcccctacactcacgaaacaactcaaggatctttcaaaagaattcagccagacaaccacaactagattccacttccacaaggaaaacttttaagaccgtaccaaaggacgtctaaacagactgcatatacttgtataggaaagaaatacgatagcattgggatagcaaatatagtcttacaagttttgctctacgatggattgtacaaaatatatgttgaaagctagtgtcaccatcgtgcatagattctggaatgtttacagatatatgtattggaacagtgggaatgcatgttagaaaaattgagttccaggtggtgcgccttgagcatgcatattttctctcttcagtctttctgccttcgccagtttttctgccctgactgtctgtgcattgcgtataagaacactattttgtggtgtgcattcagcactctgagcatttccagacaagttcctgttttttggaggcctgcctcttcttttaggctgagtattggcaggaatagttgcatcctttcgaggatacatagttgcatcctttcgaggcctgcccctttttctaggttgactactagcgttaacatatgcatcgttggatgtagatgctggaaccaacgctagtaagttattggattgatgttcatttgccgctccagtcatcatctgatcttccatagcattgtttgtgttgccatccgttatagcatagacttttcttggtctacccaccttaggtttgaagacaggagctgtattttgaagtgcgaatttatccgaaataagtgttttcagcgggatagttatgtccaatggcagcatgatctcctccacttccttccactcgagatcctcctggtctccatcttgatagacaacactgtaccagttactttcactatcatacttgtccactttccctacaaaatgcttgtccccaaaaggtttccttactttccgcccttctagaaattcaccaaaacgatgatcaacaggaggttctgcagcattacgtggctcaggttgtgattcggatgctacatcaggaggcaagtctggaactccattgataatgacggcaggctctctggcaactttgatgacagatgcagtctttgattcttgcatgccatgaatctcctccatgacctaacaccgtatcagttgtccttctatgtagctataacagcctggcacagagaggatataagaaacaatgaaacattcccaaactaagaaatcataagcaagcttagtccacagaacaagtaatcatgaaccaagcacttcaaagctaatgtaacatatgaagaaacataaaaagcattggtgagcatctaggaagctagaagcaccggtagttcacacatgtgacgtgatggttccatgatacatggcaggtctcagtatagcagtggcaggtattgctggagtacgcatgcctgttcagaaaaaaagaaattttccaacaagtgcggtgctctgaaattctgatacgtctgagccagtaaaattggcactgcatctaacccttgccagttatctgctgccaatctcagcactgcactagagactgaactcgaccatcaactggtcatgttccatttggtggtttactgctaatctaaagatcaacttttaaaacaaacaaaggccaattaaaaatataacatggcttgttccattagctctaatttcagaaataaatgggacatccaagttgaactaaaactaatttacgcgtttcagaaagggtctacctacaacagcaagtatctgtttttctcccggacgtaagtacaactcaaatccaaaaaaaaactgtattacaacattgattagaaaacaaatagaagtagtacctaaatatattccttaaaactagctcataaaagttcaattaattagaactcagcttcccaaatctgttccagaaccagctatctgaaagttttgatcacaaaataacatcatacacaatttggtgagagaactaggctgattcacaaagactcagagttgaacaaacaaggatgatgcctcttctttctgcattttacaataaaataaataagcagtttgatgcaaaaaaaaatatgataaaaaaagtaaatcaagcaaaacaccaagattttatgcccttccccaatcaggcttgccacatatgaaataaatcttccaacgacaaaaaagcctaagatcaatttcttcattttgcatgcaaaagtatgccagttgtggacacagcacattggacctagaagctaattcagatgttacaaaaaaaaaggtgtcatttgtgttagcattgtaaaaaccttttttttttcaagttgaggcaggcagcgttcccacatgcttttgagaacatcctaaaacgacattctcttctctgttttcggttgtaattagctaccatcataaagaaggtgaggaacccgtgttatcccataatagaaaggcagcactttaaatccaatgcatcatttctgatatatgaacatgttgtctatgctagggctctaaacaaggccaaatcataaaatttgttaagggtacgaggctacaggggcgaatccacgtacatgccatgtgatgcacaggcacaggctaaactttgacatcctaatcgtagatcatgttaccatgtaaacatgtaaacagagtattagatctaattcataggtacaatgaatgggtgggcataaaaatcccacaaccaaccgaaccaccattttttaggcctttgggttgacctttggtttctgctataccgcacaaaaccgctctctctcgccccagtgaggatatagtgcaccctacatcgtttaagtcaattcagcacaagtttgcaacagaattatcaatttaacatataaaaccatctgagcagagggcctaggccaccggttcatcagatacccaacagatccaaacggatgcacaacgcgcttcgtttactagacaaaatggaggcggcatttcatcgaacagaaagctctcgcagtataccaccgcagattatgatccaacggatgcacaacgtgtttcgtttactagacaaaatggagcaggcatttcatccaacagaaatctctcgaaggaatgtatggatggcagattcagcggactcacctcgggcttgcgctctccctgcggggaactgtgctcgcgaaactcggagggctctgtaggtacgcgccacccccccccccccctttcgcgggtgagagacctcgctcgccgtcgccgggtcgcacaaaccctaaccctccgacgagaagggcggggggtagatcctgacggcctggatctggcagcagccacgcagtacgatgggagcgcccgcaaaggtggtggccgttgagggaggcacggcgccgacgagaggcgggcgcgcggtggccgccgtctccggagaggcggagacggcgagaggtgagcgccgcaggcaatccctctgcgaagtgggggactggacagcacagccaacagagtcacagggaagatggggagcggatttaggtggtaggtattgggcttcagcctttcggcccatgtaggtttggatctgtttctggaggcccataaagtgttttgggctggctccatctcggctatggaagtgattatctaatgggccttctgaaactgagtaatttctttttttgttagaaacaaaacgcaataatttcactatttcagtgtacaattcaatgtgttcttttctttagcaatggtatacgtacaaaaattttattgggaaaaaaccgctcaaaagtttcacgtgttatcataaacgagaagttagattatgctaaaaaaaagaaagaatttagatgaggttaggtgtttgtacaagttcggtaagaaatcctaagggattgtttactttatagatattttcaatatttccaaaattttagcaaattagtaatatcaccaagttttggtagaatatactacatatgatgttgtcaattatctagacatggcaaatattaagtaataaactaaatgttgtcatatatctgttaattttaataaacaatgttcatcgcaaaaaaaaattaataaacaatggtatggtttaatataacatgaatctgaacatgccctaagtctaccatttccctttttaagagagataaaataaactttggtatatttgtatagtacctatgcatttttttaaaaaaaaacacctagtattatacaattgaagcgaagaatgaaaatgttttttttaaacttaagttttgtattaccgtttccattctaaaattaatattagcatcttttaaaaacgtagtccaaaggcgtaacaatttttcagaggagcgcagttcttttaaaaaaaatatagagagaggaatgcatttcttacgtcttcatgacgttaatgattctcttggacgattttaacatttacctgctcattgccatccaatagttttaccgcgttatcttaaccatgatcttacatcagtaacatcacctttgtatataccatgaattttgacgctacatcatgcatgtcttctcttttttttactgcgggtggtaactgtgatagagactttcacacgaaaacaacaaaatgatcatgttcctttcacttgggaaatctgtgtctgctgaagttctttgaccacccaacaaaatcttggtgtgttcacatttcagctgctgtcatgcatgaccccaaaatgcttaagctactacgcctaattgcgtttaatagctaacaagtggcaaggaatcactagctagctagtttacaacttccatttgcgggaattacttagaacactttcattaccaattaccactaaacaaattcaactttgtgttgtcacttagcatttctaaatagtaatatttatgcccctttgctgattccatctttttaccatgttctttcccccccccccccccccactgaaggaatttctgcagaaatcttttgacctcattgtcacattcgttgtcctgtttgtccttaatcttgaatccgtccttaaacaaattaatgatacttttccaatcaagatccctcgctggagtgcgcaaagatcatatctttttgtttttttgttctaacctcaagtaagagcttgcttattggtgaagtggttagggtgggctagtaccctacatttcttactagggtcaacaatagcatccaagtgtgcacttttagatgttaattcatgccatgtgttttgcttatgattgatttatccgtgaaagcaaggccatcatttgattctttgggccttacactggtgtaagcaatctccacaatactataactatatagagagggaatgcaacacctcacatgattcccttgttcttccttcctcctccacttgagaaagtggtttggtgcttctaattgtaaatggtttcttgattattttgcatgctactacaaatatgctttgccgttacacgccattgctggtcacattctcttcataaattgtaatcatcatgaagctaagtagctagctagctaatctacctgaagaatagcacattagccaacatcaactgtcgagcggcgttagctgaacaaaagaaaaaaaaatgactcagcttagctgaaagagggaggcggcattttgactatattctatatagtcgcacgttcagcaacagcaattacaaaattggtacatgaacttagcacaagaatttgtgccaaaaagagtactaattacacttgaaatcatagctagttaagatagattatctgcacaaagtactctgcttaccggccgacaaagattcggcagccaccctccccgcctctacggagagagggaaagagagatagccttgctcaaagctagaaattccaaagagtcagagagagataggggcagagagattcaacttctgcttgctctaaaatatatactaaggaagtgggagaattagtgcgcccttaattatagggctctcccagcataataatctcctttcctcatccctaacctatatgcagcattagaagccatttgcatgcctttggaaacttacttgacggaaagacaagaactgcaaatggccttcatgtgagcttgggaatgtctgatgttgtaactaaattattaaaaaaagcacggtacttagcttattggtagcccgcagtatatagggattagggagatgtcgacctccttcctgtcagtgcaaagatgcaatggtcactttcatgacataattaaatcgagcgactgatcacatgaatcccatagtcacatgcaaaagtataaacactcacatagaagagtttgaatcgaagtgatgatccttgctagctaatggtctatgctgtcacatgccattatgtcctgcctgtagatatatgtgtttgatttgcacttgttttgccttctctgattgtaattgtaaacaacaactgactgtcaaaactcaaaacctctttctcttacagtcaggagacttctgtgcatttttctaccgtttcttacagtcaggaattaaacagtatctgagaaattaaggaaggattctgctaataactgcaagagcaataatacattaactcaacatgcatggaggcttctcaattgctcttctaatcattgattgagtcgcattatatacacttgggttcttattcttgtttgactcatctttacggtatcatgtcctggtccctggcccggcgatggtgccggcgacgatcgtgcccgttgcgatcagtctaaaggtgtgattttttttggaggaggttcttgcattgctttctttcttctaactctcatggatgcatgattcccaaaatcgagctcgagatagaggcgaggattggaactgaattcgctcttgcccgttgggtgattttcttgccatgtcctttcgctacatttcattttcgtgctacatttcgaggcgcaattagttgccgctttaaatgttctttggtgataaaattttgcgattcttttgtgtggtcaaaagggtgtgctaatagtagagttaattgtatctgagctactgcgaatcgaatttttcccctcggtgtattctgtttgtgataactcggtttatcttcgtccagaaattttagccgcaattttatccccatatatgctcatttgtattatagagacatgacatccacaaagctaaaaatgataagaatccgggaatgccgttcctaaggaagcaatccgtcttttggtaaaaaaaaatgccaaaaatatcagtgttcctatattttgtttttgctaaaattttgaggggtttcggttcaattagaggacattggatcaattctaccagaggattgttatggttcaacagttggtactcccgttactggtaccaccctgtaccaaattatatccaaccgttgattctttaaggtacgattgagagtagagcatcggtctcggactctcggtcctcaaggcgcgattattttgcatcttcacggatgcatctaagtcgaaggtcgcggctcagcgaagcggtagtggctacgacggcagaattgtgtgaaaggcaagggaagacaacatcgttcatctgaggaaagcagcggcggcggctgaacgagactttggatattgtttgcctggagatattcccttgctagccgcatcctcagatcagatagaccaaacaaaatttaacatgaaaagtcaaatttaccttccacatcttgttctagcactaagtaccgagttctagcagccgttcgattgatccctagcatgttgaacggtgaaattccttattctacaaacatcacaaatgactgaaatatgtctccacttaattaattaaagcatactcccaatgtttttttatttgttgttaaggacatcaatagagacggtcagcatacaattttttgtgcacatatttaatcacggcctattctaaccatatattcacagctatatttaaaataactatgttattttcataaacaaaatgttaatacttacatatacctatgagttaatattataagtgttcaagaaaaatatctatcagagaatggaggaagtcaacatccctatttcctcctatgtacgagtgatgccagtatgccaccgtgcccataacctcagtcatagttctcccaattcccgctccctctgttccctgatacaaacatatgtaggattaaattttgtatgcaatataagtatttctcgtggcacaatgattctaatacacaagattgaaaatttatacgtaatataaatattttttgggacattaatacacatgaatttaagtatttaatttttagccaatcagatacttggggaataatgtgaggaatttaaactgaaacataatatttttctcttaaccttaatagctaaacaatctagaaatattaatattagtgacagatggagcagtacttagcaccacttctgtttttcttttctcaaccctaacgacctcacctagccactgagctcctctaagccacaatagacaaaatcaagtagaaacaatatttcacataaatataatgattttgtggcaactagttagtactagtaaacaagagttgagaaagtagaaacattattccaccggttgtccggttcatccaacaagttgggttctctgcacaagtaggatatatggccaaaaaggtccaaaaatgttatagtagtatgcagatgtttatttctcaacgttgagaatttttttcgatccgattacatgaaaaatgtataatacacacacttctactgtttgtccttttcttttcttttctaactctattatcccctttttacgcacataagttttccaaactactaaacgccatgtgtttacaaaagttttctatataaaaattactttaaataatcaagataattatttttaagataatcatacactaattcatcatttcattttatatgcatggagggtacatccccttgaacatactctcaagaatcatccggaaatctttggtctcactaaattcctagttaaaacacatccatgtatatttagtaatggtgtttgaacccttcattgttgagcggcaaaattcttttttaaaaaaaagcatacgtgctccaactctcgttccatttcatcagatttcataacaaaatactcttacacaatttgcaatcgccggccgaattcttgggaattgctcgaccagtacaccaccgctagtccacgcagttcgtggggggaaagagcgagaccgaacagctaaccaactgtagggcggatcacgtgtccgcacgcgtgcaggtagccgggccaatgggaactcgcaacgagggagggaaaggcggccattaaaccctctcacccaatgcaaaacaaagccgagatcagacatcatcgccatgggcgagggaaaatcgatcgatctgtccagcagatggttgcgcgtcacggacgcctcgcctgtggcagcgacctcgccgacagcgatccgcacccgtttgacctcgccgtctcgccatctcccacatgaagggaaccaacccaataatcccaccctcccaccaccgaagcctgaatcaaatacgagtggaactgcatggcatgtcacatcgcgtcacacttgatcgtttggtaataaaccttttttagacgagacgagcacggacgctagcttgcgctgcagggtgcgagcagcactaacaaggaggaggaggaggaggattcaggctcgttcagggctttgtggaagtaactgggaaatcacggagcagtagtagtggtagcagcacaagttgttcgatctttctcagtgtccggtcacgagagaaggtttctttttgtccctctttttttcttttttttcgtttcccagctttcatgatgtttctggcgaaagttacaataatactacacacaagggaaggtcaacgacgccactctgacctgacctgacctcctcctctcgcgcgctgcacactggcgctggcgcaccactacgctgcgcaccggtcgcccgcccgcgcgcgcccgccaccctgagctagctagtgcgtgctcgtgctcgaacaccggaccccaccgaccaccaacaacgacgccggcctacgcgccggtagatctccagctcgatcgttcgctcccctgatcggcggcgacagcgtactacgaggcgaggttcacggacagcatgtcgccgagggtggcccatatctcctcgtcgacgtcgaagccggcctgccgctgccgctccgcctcggcggtggtggcgcccggcgcgcgccaccaccactcgccattgtcgctgccgccgacgacagacgcttccgtcgcggcgccgtccttgcggttgtaattgtagcagctgttgacgctgctgctgttgctgccgctgcggtagtcgctgtagcccgcggcggagtagtcgtagctgtagctcgcgtcgaacgcctcccgctcgtcgccctccgcgtcggcctcgccgttcctcgcgaaccggcctttcaccctcggccggctatccgccagcgtcttcctgcacgcgtactgcccccaaacacaaccaaagcgtcagcacgaataatgggcgatcagagtgcaatttttgagcgtggaggaggggaatggttacagtgatcttcttgttgaagttgcgttgatgccgcttcacgcgatacctctcgatcctctccttcctctcctcggcactgtaccgcccgaccttctgtgagaatggcccgctgccgtcttgcccgcagctttcgccggacgggagcggccgcggcggcgacgatccgttcatcccctgttttcgtcaggacacaattcgtcagtcgagcttccatgaacgcagctcgattggaagtgtgcaccgtgcagttcaagctgttgcatgcagcttatattacctggaggtcgccggtgctgaagacgcggcggacggggcatggcgaggtgaactcgaagaggtcgccagaggaggaggacggcgaggaggagagcggcggcggcagaggcagctggtgggaggaggaggacgacgacgagaagaatgcgccgccgaagtggtcggtgagctggaggtgatgcgggagggagtgcgagctgatgctcctctggatgttgttgtagtaggacgaagggagcgacgaggagtaggacggcggcgacgacgacgacgacgacaccgcccctccgaagtgaggtaacccgccgctaacattgccgtcgaggtagccgccggcgacgcgagggatctgcgtcgggacggcgggcaaggcggccgccggcgagtggttcatgaagctgacgtcgctgccgtaggaggccgccgacgaggcagaggaggaatggcggaacatggcttctttttaatttggacgtaaaaaaagccttgggacttcgggcgaattgtgtgcttggggggaagctcaagtggagggggcacggtataagaaggggaactggggaagggcatggcgcgttatgtgcgctggcttatggtgccatgcactgtgagaggtggtagggtcaccgctcactcgtccatgcagtacaaaaaaatcttatcatgtcccacgcgaactataccgatatatactatatcggaactcatttcacaagtcaaatcgaatttagatggtgtgtcttgctaaaagaaaaaaaaacaaaaaacattatgcactgcaagaccgagagtggtcacatctccactactcctatattacaaggtaagaacaagtttaatattatagcactattatctttaaattatctatagttaatttaatagccaattcatataataattacatataaatatataatatagaagtaatattttgtcccatctgtcatacttgtagtctgtgttgtggctagctacaaatatgtagcccactacttttctctttttttatttatcttatcgatatgtatttatagctttatagctgatttatagtcggttattatacctacactataagtagaacaactaccgatatgtatttatagctgatttatagtaagttattgtacctaagctataagtagagcaactggtaggactgtaggagggttgaaagtatgcgtgtacagggcatctgacttttcttccttgtacaaagtcagatttcctgatgctgttgataaatttacttgctactactactacaacggttaggtgatatcagccgctgatgtaaaatccgacggccaagattttatgctcttgtccctttacagtagttctttacactcaacagatccacatatcattacccgtttggccattagaagattgcctagactggagcatctactggaatatttgtactgctgaattgtatggcataggcaatagtccttaaaaaggttgttttaccccttttatttatgaatgaatgaatgaaaggtgctattggaaactagatgcttttgccttgaaaacaaaagcccgcgaaatattctcattagccccctttcataaaagtcatgctgaagttaacaatttagaggaatgagtataggtgtcacagctagggaatatgctccaactaattacacattgattaacaaacacaacgaagttgatgccagggacctttctgtataaaatcagatcaatagggtacggaggtacagcttactgaaagatatttttgcgtgtatggaacgtcggcaagtacgttcagagcaattttgttttcacggcaggaaacataaacaagatgattcactgggtatgccgtatgcgtgtttccaattttaagcaagcacaccataaaatgagagaaattaggtaattgaaaacttataagcaaatcgacaaacagaaacagaaataaggccttacccaaatacacttgttgacaaactttgacagcacctgtcaaacacagcaccaatcttttagaacccccatgttttgacctttgacttcacgtcacatattgccaattaaatccacttactgagaaaaacagaatagtaatcaacactaactgaaactggaccattctctctctgagagtgagagatctagagagggaaatgaaaagtatagaattcatactgtagttagacaaagatatgctgcttgccagaagcagactctgatcacctgtctcaacatgccaaactttaacatcgaatcggctagagctccagtgctccacctagtgttccttatcttttgtgctgtaccaacgtccatgtacgtagcccatgagaatgagatgtatgtagtgctgctattagataaactagagatgcttttttaaaagaaaactagatgctttccctccaatattccaatacagtttgatacagagatacttgtatagttgtatatatgccattttcaaagatcttatagggttcattgttgcacgatttgcattatatgagaggactagggaaaaaaaagaagaggaaatcccatcactcgcctcttaaggcagaagaaaagtactgaacagggtggttaagatgatgggttagctaagactgtttactcatgaaacaaacgcgtgcatggaattgcaacaagcacggtgtgactagaacaggtgatctttctttttaagttgtcaaaaggagatgtaagtcagttagtgtacttgcatggactagtattcttttattgatttaacttaattattgatccttctaacctcacgctatactccaaatgcttccatctttcaatgtatactgctacttgaactgtctacatgttaaaaattatgtcttaaagccatgctttaacaaataacttgtacaattaaatctaaaaatttgtcagttgatcatggtagtcatttagatatttccttaagtttacaaatttctatcattttggcctggaacattcaacttagtttattcatgcatagttgcagactacatttagctacacaatcatagtctgttgcagataatgccttaattctgtttccatttttcctgtaaaaaatctaagaatacagtcataattcataaggttctgtaaccaacgttgactataacctaaaaatgcagagtgattgtcctatactacaaggttcctaaactgaacaactggatagacataggcaggacttgaaagcagcttcagaagttgacctgttaggcttggagtttctgggacgcccatcatcttgcacactcatttcaggcctctgttcttgcagaactatgtttaaaataaacaatatatacaacttctaaactagctcatcgagcaacaattttgtagtactgttgcagtcgtgtacttaaagtactatgcaattatagaacgataaaacaactatggagcatttcaataaggagctaaggaccactcaatagtcatacgataaaatgatttaaagcaatgtatttcacctcgaagttttatcggaagtagattcagacctacaacatttggatgagctttatgagattcaaatctggcatcttagcatgtccagtcagtccatttcatatttctttagctcgcaatatctaacaacatatcaaggagaaacgttagccattttcatcagatgacatgaactagatgaataaatagtttctttttgtttttctttaatgatttaacaagacatttttctcttcctgaaaaattcaaaggagttaactttttggagaattttgaccaggtctattagaaagattgacagcctaaagattgatctcccaatgttacaaacagaagaagaaatgcataatgacaatcctgatggtgtttaagcctctgccaaacgtatttgttcaga

SEQ ID NO: 70895 - DNA, 17096 bp, Oryza sativa
tgcatgtggtatccccttgagatataaaaggaggaccttgcccacttaagagaaaaaagagagaagaggggggggggaaaaacaccggagctcggagaggagagaaagaggaagagggtctttagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcaccttgcgcccctggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgcccccctctcgccgaagtcttaggcgggaggaggtgctcgagggggtcgaaagatccgcgacttcgccgcccacgagcgatggagaaggacggcgagacggggagcgtcgcctcctcgtctacggcgatggcagcacgccccagggcgcgctccaagctgcgggcgcgctcttgcgtcacccgcccgtcgtccccgatccagagactccagcccgacgttggctggatgacgtggccgacttggtcatgacggcgcagcagcgcctaggcgccggtgggcggtcctccgccaccaaggcctctggcgctgctaccgccggctccgtgtcgtcgaggcggagggcgcggcgagcggcggccgttacccgccgttcgtctgccatttcctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggtttgggcgcgggggccagccccccgtgcccccggttggtggtgtcggctgtcgagcctttgtggcgagccttcggaacgtccgttggcccccaaggttccggcccactatcaccgaaaaatatgacggaagtgtcaaccccgccgagtttctccaggtctacacgaccgggatcgaggccgccgggggtgacgacagggtcatggcgaatttcttccccatggacctgaagggacaggcgcggggttggctaatgaacttgccgcccgcgacggtccactcttgggaggatttgtgccagcagttcaccatgaacttccaaggcacatatccacgcccaggtgaagaagcggacttgcatgcggtacagcgaagggacgatgagtctcttcgctcgtacattcagcggttctgtcaagtccgcaacaccataccatgcatccctgcacacgcggtaatctacgcgttcaggcggggcgtgcggcacaaccgcatgctcgaaaagatcgcctccaaggagccccagaccaccgcggagctttttcagctcgcggaccgtgtggctcgcaaggaggaggcctggacctggaactccaccggttccggtgtggcagcttcggccgcccccggatccgctgctcggtcagagcggcgggacaggaggaggaaaaagaggtcggcccattccgacgacgagggtcacgtcctcgccgtcgagggcgcttcgcgggccacccgaaaggggaggcctgcgagcaacaaaaagaaggaggctggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaaggccccggcggctccctccggcaaccggcgaagtgaggccaagcaaaaggcccccgctgaggacatcgacgatggcgacgatgacctagggttccaggagcctggggccaccatcgccaccgtcgatgggggagcgtgcgctcacgcttctcgtcggagcctcaaggccatgaagcgagagcttctggccgcggcccctacccatgaggcgacgcggtggtcggaggttgccctcaccttcgaccagaccgaccacccgccgtgcgttgcccggggaggacagatcgcgatggtggtttcccccaccgtttgcaacgtaaagttggggcgtgtcctcatagacgggggtgcagccctcaacatcctttcccccgcagcctttgacaccatcaaggccccggggatggtgcttcggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcaacgagaggctcagcacctccatcccagccgccccgaggcagcggatgatcacgtgcgacgaggtcccggtcaagaaggttgccctgggcgacggcccgtccaagaccacacgaatcggtggtcttctggacggcaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgagaggttatccatccggagtggctggtgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatcgctagggaggatgaggaaaaaactgctttcattacccccataggaacttattgttatacgacaatgcctttcgggttaaagaatgcaggtcctacttttcagcgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaaactgaaccccgacaagtgcgtgttcggtgtgcctgcgggcaagcttctcgggttcttggtctctgcccgaggcatcgaggccaaccccgagaagatacgagctatagagcggatgcgccccccagcaagcttagggatgtgcaatgcgtcaccggctgcatggccgccctaagtcggttcatatcgaggctgggagagaaggcgctacccctatttaagctcctcaaacgctccgggccgtttatctggacggaggaggctgagcgggccttcactcagttgaaggcgtacctcagttctcccccagtcctggtcgccccggagccagatgagccgctgctactttacctagcggcaaccccgcaggtggtcagcgcggcgttggtcttggagcgcgacgaggacaaccctcactccgcgcatccccaccctgtgtcgactcgacccgggagagagcagggaggagaggcccccgagtcgaacggcggcccgaggcccccgacggccggagttggccctccgcccgcttgtccgacggtgccaggcacccccgacccccaggatggccccggggccactgcgggaaggccgcgcctgtcgccctccgaccccgaggtcgtcggcacagaagccgagtgcgccccgcgcggcctctcggacgaagagcgccctggagatgtggcccctagcgaagaagatcggccccgccgaaaggtgcagcggcccgtctgcttcgttagcgaggccctccgggacgctaagacccgataccctcaggcccagaagatgctttacgctattctgatggcttcgaggaagttgcgccattattttcaggcgcatcgggtcacggtggttacgtcttaccccttcggccaaatcttgcataaccgagagggtactggatgggtggtgaaatgggcaatcgaactctctgagttcgatttgcactttgaaccacgccacgcgatcaagagtcaggccctcgccgactttgtggcagagtggaccccggcccctgagcccatctccgtccccgaggccagctcgggcccctcgtagctgcctcacaccgcctactgggtgatgcagttcgacggctccctatctcttcagggcgccggtgcgggggtcacgttgacctcgccaaacggagacgtcctcagatatctggttcgcctcgactttcgggcgatcaataatatggcggagtacgagggactccttgcgggactcagggtggcagctggactggggatccgccgcctcctggtgttaggcgactcccagctggtcgttaactaggtctgtaaggagtaccggtgctctgacccgcagatggacgcttacgtgcgccaagtgcggcgtatggagcgccattttgatgggatagagcttcggcacgtgcctagacgggataacgcggtcgccgacgaactctcgaggctcgcttcctcgcaagcccagaccccaccgggcgcctttgaagaaaggcttgcccagccgtcggcgcggcccgaccccctaggggagacggacgcgcctgaacggcccctgaggcccgtcggagtccaggcctcgggacccgaggggagcgctcccagctcccttagattggttgcttggatcgctgagatccaggcatacctcacagataagactctacccgaggaccgcgaagggagtgaacgcgtccagcgcatctccaagcgctacgtgctggtggaagggaccctctatcggtgcacggctaacagagtcctcctgaagtgcattcctcggaaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcgggttcgagtatctgtatgtcgctgtcgacaagttcattaagtggcccgaggcttacccagtcatcaagatcgataagcactccgcgcttaaattcatcaggggcatcactgctcggtttggggtgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaacatcctcaagaagcacggcgactcgtggatcgaggagttgccagcggtgctctgggcaaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgtgtccaaacgcgtgctggactgagcaagctctcaccaatatgggagggtccgtatcgagtgatcggcgtcccccggccgggctccgttcggctggccacgggcgacggcacagagctgcctaatccgtggaacatcgaacaccttcgtcgcttctacccctagtgggggtcgggtgtcaggtctcgggctcgggccaaccccgcgcccccccaggcgtgcagggttggccgggggctaccacatgcataaacttatatttttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaaaggggcccagaaccgagccgtgccccggggcgtggtgaactccgggggggaatcggcaaaggcccacaatcgggtcatccataaccctcggtcaccacattcccggcctggccagtctcgacacgtggatctccccaggcactagccccgacccgcgccatttgaggctaggacctaggcacgagcccttgtttaagctaagacacagagacacagaaggaccgtggcacagaccatcctcgtctcatacacacaacaaatgaaattgacacaaaaatttcctctttatttgattgcagattaaattagtttatacaagaagggggcccgaaggcctcagaagaagaaagaaaaagctatttaagattggcgggggcctgggggctcacgccgacgcgcccgggtcgccggcctcatcgtcgctgacgtccgcaccaccgtcaccgccctcctcgtcggagtcgagggcgaacgcgagccgaggggccgtaccctcgaagctgtggacgatgtggtcggcggcgtcccggacctgcgcgcgcgcgccatcctcggttccaagagggaactcgtccagcgctgcccacggggagaagtcagggtccctagcctggtagcttgccagtacgagctccaccgccccccctgcgaggtccctcgaggatgacttgatcgtctcctcgagctcctcggggagccgctggagggtcccggccatctctgagaggcgctgggcgaggcccccctggttggcggcgtatttcgcggtccgcccgccccagaggcccgcctgccgcccggcacggtctagacgggagacggcgtcccgaagcatgccgggccctacctcgcccgccaagcggagggcttcgacctccccggcggacgagtccagcgcgccctgcagctcggcgatggtgtgttcggcggctgcgaggcgggcggctaggtcgccgtcgcccgcggccgccccgccgctgcgcgctctcgcgtccagctccttcacccgcgcctcgaattcagcagcccgctgatccagtgcggccctctctgcgcgggcgccttccagattgaggcgcgcctgctcctcccgccgctgcgccgcggcctcggcctcctcgagagctcgctcccactcagtgagctcgtcctcacggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgctgccgggacgcgtcgagcttcttctctagctccgccgcccggctcccgtattggaggcagaggtcgtcctgcgccgcgttgaacacggcggtggcgatgagggcagtctcccgctcctcctccacctccctggcgatctccgccaggtccctacgacgggcctcgagctcggaggcgtgccggcggtgtgccttgcggcccgcctccaccatggcttccaccgagcgccgtccctcttcgacgcgcgcccacgccgcatcgacctccgcccgctctgcctgcaggacttccatctgggcgcttaacccgtccaacaccatggtgttcgcagcggccaaggcctgcaggaggggctctgcgctcagtggggcagcggaaggcagaggggagagccgcctcggtgtgggcgccgcgcggctcggcccgccgatcgacgtgccgaactcgggggcgtcccccgacgcgggctcgtcccgaacgtcgccagaggggtcgggcccgagcggcgcgcccgcggcctcgtcgtgggtggcctcggaagtcgttgtcgcctcgggcggagtcgggtcgggggcttggcaggccgcccggcgtgtgcgcgccgcctccgtctcccggacggactcctcggcccggcggagtctggcctcctcccaagcggcttcctcagcctggcgagcccggacggcctcctgggcagcttcttcggcttcccggaggcggtctgcggcttctcgccggtcagcttcccgcctccgggcctccgcggtcgccgtctcctcgacctcagaccggccggacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttggggggggagatgaggtttccccggcatggttcggtcccccccatcttgcggagccgcttcttttttcgctcctcctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctctcggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccatcttgaagtcttcagggacccagtcccatttgaccccctggtgggtcctcatgtagtcctcggacccggtgtactcccaggcgccccgggcgcgccgctggagtggcgcgatccggcgatgaaggtaatcgccgtacaccatggtccccgtgagcccctgggatcgcagaccagccaggcggtcaagaacggcgtcgtagccgtctcccagatctaccggcgcccgccagctggaggcctgcgccgggggctggttcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccatcggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcaaaggaaaggaagaatacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcatgctaccgtcgagcggtgcggagccccgtgccatgacgccagcggaggaggggcttgagagcgagtgagtgtggcgagggtagggcacaggaaacgagaagttagagcgcaagcggcgaaggcaaggggaataatggcgagaggaaggaaacgagtctcttcctcggcgtctttatacccttgccaacgctatgcccggctcctcgcttcccgggcccactatctcgccccctcgtttctcacgcccactcctccactaatcccgctcgcccgtttgcggtgcacgaggcggatgtgcggccgtggcagtcgagatgggacatatcgtgcgcgccgaccgatgcaccatcatcacatctccaggcgaaacgaaccggctcgtcccgattcgcgcgctgctcaagtaatgtagcggtcttgaagaaagccgctcattattgtcggtcggttttcccttgccgatgcgcgcaccactggattcctgcccgcctgtagagaccggccccgcctgtcaccaggcctaaggagtggcgtcacgcccgagcgctttcctcgaggagggcgatcgccctggcataacgccgggggctactgtcggtgacatgggaccgggggtatcttgactagaggtttggggcagctgcggtcacccacgtggcctgaccccctcgggggggtcgggcccgagggtgatgtggccgcccctccctctgtctccccgaggggttgggccgctcccgtttcggccccgagggctggggcgccccgaccccctgcgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcatagtgtgtgaccggtcacagaccggtcagatcgcgggttgggtggcaacaggcggcctgtcacacgcctcgccccgtcccgtcagaatgatgagagcttcccggctctcgtccctagccggagccggcgtgctaactcctggagttggtacgtcagtcccggtcagatccattccaggcttcagcgcgagcatggcaaggaagtcgctggccattgaatgaaggttaaaatgggcgtccaccgggaaagctggcgagcggggcaggaggcgtgtgctctgcttgtcagaggtcacttccggctgtagactagccctcattgtaaaaagcatgtttcctttcttaggcagctagaggcccctgtggtgacccctgaccagataaaaaggaggcccaggcctaggaggagagggggactctggcggaggggttctggagcctgaactctctctcgctttcgagctctctgtattccttcacgcacagatccaccagaacacaggaatagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctctgtcatccgtggtggtcagagatcatgcgggatacttaggctagagttgacgcacgtggttgatggagattccatatggcatacgatggaggtattgtgtgcgtatgggatgcggagttgaatttggaaggagtccaaatttggtatgattggttatgtaaagtttgtttcttgttctagagggtttcctaaggtgtttaggacttctagtatgagtttggttcgtggctttagactgcctatctcgggtataaatagagggggagtgtgaggcttcccggtatcgcttttgagagcaattgagttgagttttgagttagggtttcgagtttagtcgaaatttttgtaaggagtgatgtttgtgccctttgtaaacacagagagaatcaataaagtcgtcatccactttaagagttcttcaatttgtgtttcaccgggtttcggcggtctaaccggcgatataccggcggtcagaccggcggcatacgggcggtcagaccggcggcggcgatagcaagcggcagctgatctcggcagtcagaccgatcgatctacaccggtcagaccgacggggacaggcgctgtcagaccggcaggacaacttcggtcagaccgatcttcgtcgaattcgagggtaacttttatttccgctaaaagttttcggtttttgggtataccaaccattcacccctccctctggttggcttagttgttgtgattcgatcctacagtgacactcctatgggcaattaccttttgctagtgtctcgttattcttggggaaggacagtggcacattctcgtgaacttgcatatgttttcaatttgtcgatagaacaaagaaaaaggttgtatttgaactgataaattgtacttcaacatttgtaacatgttgataaataatatattccttagtctaccctataattcaacaaataatttcactcatctttcattctttcattcatcacttaatggtcgatatcatcttctgtgaaatccaacgcatcagaatcaactacgtagtacgcggggtcactaggcggaaaatcgcacacgcgggatcaccgctgggtttcctttccactttccttcgccctccgccaaatcgccagcgctcggtttcctttcccttttccttcgccctccggagggatcgccaaccgccgccctcgcacccccatggccccatcccgcgccgcccgccgccctttgctctccgcccttcgccaaacgccgccttgacttcgatccccctaaaccctggccaccgttgcccgcgttcaggtcgccgttcggaccccatcgcgccgcgtcgccacccggaccgcggccaggagatagagcagcggtagacgtgcggcgtcttcctccttaatccgtcacctcggtttcttagttcctcccaccatgcccctcccttccaaccctatctcctttaagcgccaagtcgccgcagcagcaacgaggttctcaacggggcatgttaaggtgatgtctcgtctattcctctgttcctaaatcctcaaacaaattaatatttgtgtgccaaatttgacttggatgttttgttgtttaatgtaaatctaaaaatgtttagcaggctctgcatgagatgagaggtcgactcaacgatggaggctgaaaataaagcttgatgttaagaacatggtagtcaatttgatggagttatatttacaaaggattatgcggaaaaagcatccgtacttcatttccttctgtgcaatgaaataaccaattgttctttatttcagccatttatgtatgggtttagtttgcgttggagccaagctgccagatcgtgtggtccctggtaaatctggagctttattttcatatctatttactctatgaacattgtcaaataactaactgaattatatgttttgcaagcatgctaaggaaccattaacctagcttatacggctggaatgtaattatatacatatagccaactgagtcatatgtggtcaaggaataaaaaagtaggaggaactaggaagagatgtcggtgctgtgttgatagtaaacatatgggtttgcccacttagtcaattcttctattgtgtgatttaagtaaagttaagtgaggaaaccatgcttagacatctctccccgtatggctgtatggctaatttgtttttaaaggcagtctgacggtaattgtacatttgtactgtcataaactcataatctatggcctgcagagacgcgtttgtgtcgcacacaagcatcccagtgcaaattaagacagcttatcatttcgatcgcttttaatttgacacctccttctgaaacttaattaattctcattagccagctataggatagatatagtaggtcgacacaaaacgatggagtatagtataactgcaatcagcaggttggattctatgatattactaaatggtgaaatactcaaaagtattggggctgtatcctgaaggaaaccatcctatttcatccaataaattagtttcgatatcttacaaatcgatctggttttgtcggtgtgtgtaaatggtgcatgtgcacgtatagcaaacatgagttggattactaatcttatatattgtcaattaggtaagtatagggacaaaaatctgtttaccagtggactggaaatctgtttgtcaaattcacttcaatttttcagtgcaaaatttatattttcagaccttttcttattttcttttcattccatatcaatgaaagtaatttatttttctgtccggggaaatttggtctcttaatcattcagcacttatcttcttgcaccgatcttataataaatcttctgcatccgatgtaatcacatttctgtcaagtcacattcgatacttattagatgctaataaactaaatctatatgtcaacagttacaggttgaatcaactaattttctgacagtagatgtgctgacgttcatatactgcagttgaatttaacttccaaatattactgccagcatccggcctcctcaacatcagatcagtgtttcaggtgtgtgtgtgtctcatttaaattagtcatcttttccggttcgaaattttcgctttgcaattggtatatatgtttacatcacaccctgaaatttctctaattcagaagaacatgtaaccatagtaagtataaaatttgcaagatatagatcttgatggcctggtgctgctaggtgtatgcattaattctgttgtgctggatgtagtttgcttgcctttaagattatatgattagttagatgtattttgttggcctactggatgtatgcattcagctcctgactcattcttgatttatttgtgcatgccggatccatggaagaatcggccactaaagtctaaactctgaaataaggtttttggtatatagtggcctatatattctgcacgtcatagatctttcatgtcacagtatttatgtaaaggttgattagtacacaagtacacataccttttttgttatcttgtagcatacaaagtttacacttaatcactacacaaaagcacttaagtataactttgtattatcttgcaagtcaccacactaaaccactaaaccactaaaccatcctatcaagagagagagagatagatagatagaggtggtgaggtgcggcaccgcttggatagatggaagctgtttcttttcctccgctaatcacacttggatactctggtttatggcaataatgagcaacagggcagccacgacatctgtaggagcataagaataaaaagcccagttaatcattgacgtttgtattcaacttatcgatgtctggtagtgctaatctccaaaacaatcaagatattttccatagccatatggatcataaatatgcatctgatccttttgcaatccctgaaatttctcttaaagaatcaattgcaaatcatgtattgtagttttctgaggtccgttggtccattgccaaatattagcaaatacgttatttagtcagagttatggtatccttgaaggttcaatgattggatttcctttattcatgcatcaggaatttgtgttggatgatcaaattgcagaatttttatgccctagatctatatactttttaatgagagagttgtatggtctattaggagtgaagatcaattcagtttctatcctagattgagcagagttaacatggtccatttttttatcataaattcatgttttcctgtctaatattttttttgctaccaactgcatattcaaatcaactgtaatttgattgcaccatgaactgcatagcattagcatgatccaatctaatctatggcctctaacatggtttagtgcaatctgtcatgaccttctgcttggtttcatgtgcttgacatgttctcctcagattgaaggaaaaaacgcatgtcctcccactaggagtggttagtggttcattcttgaggtatatactactcatcctcttgcatatgttagctttatagttcacatgttagggtggaatgggatcctttgcctgttcactggacgaaccactttggaatgttcataatcactgtttcctttttgtttgaatcatatatacatcccattatatgtttaattgtcaaaacatagatcatcttttgactgttttgcattaacaaataatgccataataccgttagcacgggcatgttactatcataattcaccaactagcagcatgatgttttgaacatctttaagaaatgatttatttataaattgattctgtccctcttatttataaatgatttatttccctgagtatgtattttctcgaaaaaaaccaaatgattcattttcctaagtatagtttggccttgatttactgtttgcccatttcaggttatctttctttttagcttagccctgataagtcgcacaaaactttctctaaattattttggcctcattcctaatggctacataaccatcattgaaaaaagtgtatgtgatatgtggatttgggtgatcttaccatcctgttggctttttacatggcatgagcgatagtgtgtaaataaaatcatttagtactctgtaagaatttatgttgcttgttcatctccgaatgggcatgtataacattgtcatcttacataaatactatgatttttaacattcattgtttagaagaagaaattacaaattcgaatcctactgactactgtcatttgattttgtatagcataccagaagaaacacgtgcggtaccacgtgattatcactggcttaactctttatgtaattttttgcttgaaccttaatcccaccccttctatggggaaatgtaatgcctttaaaatatcaaatgtcactatgacgttatatctttttcaatttgagttatcaattgtc

SEQ ID NO: 70896 - DNA, 1306 bp, Oryza sativa
atatatatatatatatatatatatatatatatatatatatatatatatatatatatatattatcctctagtcaagttatggatatgttcagacttcctcaatctactccaaaagacgatactagtagtatacaagagttgttcaaaaaaaaaaactctaaaaagaaagtactcactgttccaccataggtgcagttgtagtttttcgtattcaacgtttaaccgtccgttttttttaaaaaaagttatgtccgttttttttaaaaaaatatgattagtatttttgttgttattagataataaaacataaatagtcctttatgactaacttattttttaattttttttataaaatttttaataagacgaagggtcaaccacaatagcacttacgatgaaatagagggagtggtatacaagagtccaatatgtggggaaaatgctccatactagtcccatgtgtggcgcagcgcgttggctgatgcttggcgggtcgtactcttcacggattttctatcatcctatcatatatgagcttcatatatgagcttctaggtagtaagttaaaaacgttttcttgcttttctgttcttccacgacgtcatcttaattaggagttatacatctaaaagtagatattaggaagagatagcttcatccttcccatatcttttatttagaaagtctcttcgctcttaaaaaagttaaaatactacttgtgtcgtttggttcaactacaatttcattggacaaaaataagagccgaagcccttattatgatgcgtttgatctcagttatttgatcggattacaaacatgccaataacatctgaactcttttcctggtccaagtagcatctatctggcgaaaatgctctggttcggacacccaataggaaagagaatatcgggtgctcgcaccccagtcgtccatgtctcatcgtccttttctctccttctctctcgatcttatccatttcccttctctctctacaccgtttctcttcacgcgaggcgcttctcctccagctctctctccgtatggcaacacttctccttccgctcctccttcgcaacggcgacatcactgaatgccgccacctcattccccgcctagccgtagtctgccagtggttgcggcgacgatgacaacagccggatccctagccctgaccctgcagccactgcagcaaccgcggcctccgccgtcacaacatggctcgggcccctgccaccgacgttgtgttgtcgtcgatgatctagccaaccaccggagagaatgaagcggatctaagtagtatttaggg

SEQ ID NO: 70897 - DNA, 805 bp, Oryza sativa
ttataggccgaatagtttgttaagtctgtttttattgagtgatcttttttaagatcatgtttattaggttcgcaacttgtatttaaaggttgttttgggaatttctacttggtaatttcaacttatatttgaaaattttcaattcaaattttttaaaaaaaatcaaatccacccaaaatttgaaaacttcgtatattaccatcgtgacaaagtgaatctcaatgctccctgccatgttgtttgaagtgatcttacgctgaatttctttttcattttcccaacctatctcacttgtttttcacgccaagtttttcaaactactaaacaatatgtttttttaaaaaaaatctatacgaaagttactttaaaaatcatattaatttatttttcaagttttttagattaatacttaattaatcatgcactaatgtgtaatatcgtttttcatgtagagaggcaggggcggagctagaacgaaatggaggagggtcctcttgcttaatttactctaatttagatcaagttttaagctgatatgtgtatgcctaagtttgtattaaggagggtgcacacatggtgaaaatcggtgagttataactaaaaatttttttttgaccggattcttgggcaccccttccatactctacctccgccccatcagggaggtggagttaacacagtcttaaggtggagcccaagtggcgtgcagaagtttctctagatttgcaagtgtttgggaaatgcacatatgtgggctctacattttcctaaaagtaaagaaaaatagaattccaaaacaacctgt

SEQ ID NO: 70898 - DNA, 1104 bp, Oryza sativa
cttacattcaggaaaaaggaataaaatacgatggtggaacttacatgtcagacaaaaaaaaaactacccttctcttccccctctcccactaacacgtcctgacagtgtgctcctgtccctctatctccttccgctgccccaccacttagccacctgtggcgacaaacagagagagctcgcgcatgcaaggaagtatcatcgtcttcgcccatcatgttggtatccgcaacattcgttggagcaggggggaccagcctcgttccttgtcatgctcgctgtcgtgttggctgtagtgtgtgtgtgggcggcgtcggggataggcaggaggacgacaggcagtgcttcgtcacaatcaacacgctcaccatggccatcgtgttgtacctcctcgttggcgacctcatcggtgtcggcgttgtcaataatggcagggttgtctcgaacaccttcgtgggcatgctcctagtactagtgctctctctctctctctctctctctctctctctctctctctcttcgtcgatgttgtaggaggctcaccgaggggcaggacaagctgtcctccccggcgtccctccccctccctgcgctcaaagcctccgttgaaatccaccgccgccgcagaaccccttttaccccaaactggtcatgtggcggctgccgcgtgtttggacgaaggtgccatccacatcattgtggtggaaacaaaggaaaattcgatccaagaggttggggagtgggggggtggggagagagagagagagagcatgggtttggggatggaattttcgagcttagctctcctcccgtcaatcgctgtccttctccctgctagccaccatcctaccttggagtccatagaaatgggaatagaggggagaagtgagagataagggcccctaacatgtagggcccatgctgattcagcgttgttgatttcgatcaattagccacgtcggacaaaaccagccgctatattatcatgggacctcctttacattggttggttttgtaagttaaggaagatgttatatctggtattgcagtttaagaacaaaatttgaactaggtgtcaagataaggacctaaagtgaactaaggggg

SEQ ID NO: 70899 - DNA, 37710 bp, Oryza sativa
aaaattcataaatttttcaaataatacagacggttaaattttagacacacaaatataaaaattaatttattttgagacggatgtagtagaaagtaaggaacatttggtacttctagttacttttgacatgctgttatttttttattataaaaacattaactacttagtatccgtactaccgtataaataaaagtaaatttatttcaaggcaaagggagaatcttctatgggtctatgacgtgtattatttagcctcttgttttttgcttgatggcttatgaagggtagctaaaataggttatctataaattattcttttttattcattcattctattaaaacttattgggatagtagtaaaggagtatgttatttgtgcatgtggtaagtaatagatttatttgtggattgacattcaattgaaatttacataaaattttccaatattagaatttgtggtatgtttatttcaagttcgtaatatgagtaatatttggctagtgatattatggtcatttaaagagtggaatcaatatttcatctttcaaaaaaaaaggtataaatacagagatatgtaattaatgcatgtgactatgacctcatgaatgagcagaaagtaaaagagaaatagtatgcttgagatgaattttccaaatgtagtgtttagtagtttccatatgatggtgagattaataatattaatatccacaccaacaaaaatctagaacatgaggtctagtaccaaatagtcaaaagtcattatcggaatatgaaaaatgtgtaattatcatcgacttccttatccgttggaaaatgacgttgtctctcctacttgccagctttctttggatcagattatcctagaaggaaacaaaatatagaggcaatctatcatttattctgatgatgttctatgcatggaccaaacacgcatgcctaaatatttttgcaggtaataggaggaccattccacatgaggaacttgaggtaggagtgttcttttctatcaaagacgatgtggaccagtgaaagcgttgcaaactttaagctaaactagaattttctccaatgatatgttgtcaatttcacttactagtaatatcgtctctagtatctaattttgttcgctggcatcggttggatggagctttggtgaatgctgtaaacttactatttcttttctatctttgattttttttaaaaaaaaaacaaagcaaagctccttcttccatttcaaatatgtaattttgcaggtcaactcccccaagtgcttatttgcaatatatgtcaaattttctcaaatagtcttgatgatatttcacattgactattgagtactcagtcttacagatagccacaaaacgttgaatggagatgcttgcttacacaggatcctatccatttggtgtggagtacgttttggcattttcggcttcaccgcgtccctaccaaaccaaaccaaagcagctgatcatttcacagcttgaccgttgaaaactatggaaaagtttattttaagtgcgcataaaccatagtggagaaaataacctaatagaaatagacaagtagctgtacaaattagtgggtccatgaatgttaatttctacgaaattgccgtcgccttcttgttgaaggcttgatctaccgtattgtcttggtctaaaaggtttgatccaacagaaacttctacaggtatcagcttaccgtacttgatgttgcaaagctatcatccactttttccgtaatcctaaacccttaccttttctggtcatcttaagtgctaatccaaagtaatttttctggtcatctagtaatccgtaatataagctcatacaattctaacttaattaacgcatgcttcacatatcatcatctgaacatatcagcatatcattaccagttcatcaaagtcaccaccggcccatgcctgactttttgaccgggattaatttatcaccacgtttatttgtttgtgatccacagttccgaaatgctggaggtacatacttaggataagattgtttttacctgctttggataattattcatgtaaaaataaactctcagattaattaaggtccttaagctccaactaatccgtgttcattttctcaggtagtcactctctccccccagtgtaaaaggcggtttttttcttgggattcccgtgggctgaagaagccagcaaaaccatttctctgtcaatcctgcgtgcaatgctttccagcaaacttaaaaaagcttttttttaggcgattaaataagggtaaataaagtacgtgtgctgctaacaaatgtcatgcaagattggattagattaggcacgcctggaggtgtcgtttcgtgctgggccttttgactccttgccctcctatagtcctatttgcttgcagctggtagtccactagagtagtgagatatttttttcatggccaagcaagcaatgttgttgtcgtgtgatcatgttagtcaaattgcagacgtgtgcatacatgcaacatatcaccaatcattcagaaactttaagttctactctctctctattccagtttaatcatcctctaaataaataataccaaaactaaggacactaaaatgtatatcattcttaaattaatcctcatcggttaaggtgcttttactacagtactatagtattttttttcctttttcttttacttcatcaaaacatctctgttttcgccttgcagccttgagagtttttgagtccctgatttgttctgcttgttgctggtgactgctgagcaatttggtgcaatacactgaatctgatatccgacattgaatccagaaagcatgcgtgcaacttgctctggctggctaggcatgggcgtctgtgttatccgtgcccggtttgcgatctgtgtgtgtccctctgcatgcgacgaaacggcacgcatgttggtttgcatctatcagacattcagacatagaggagaatctttcgtacaagaatggtggtgcccatgcgtgcgaccgtgcggaagctgcaacagcccgtgacacacgcacacccccacgcctcgtcgacgacagcatctcagtattggaatcgtacagtaaaacaatcttaatacatacaagtggcagccaatctgataatacactaaacctttttttgatctttgttactactgtaacaaggagcagaggtcatcttctccttaccgtgccggcccataaaatttatggcctgggcctggaaagaccatggcaggtgttgggctggtgtcgcttgcaatgggcccgaaacgaacgtgagcccattgggctggcaccgatcgagagcttcgcgatccatcgactgcacagcaggccggtgtccagttcccgtgcgatctcctcaatccggcccgttcccgatgcccatggccgtctgctgcttctgcctccgtgaggcctctaatcacgaatggaagtagatcatgatcatgcataggaataagttcacttgatgaccctcaaaagtgatcggaatctaatccatgaccctaaatcgcaaaaccggatatctcgaccctcaaactattaaaaccggtgcaattttactcccttggcggttttggagtgcggtttcgctgacgtggcggtattgacctaatctgtgtgctgacgtggcgcttacatggcatttcaattaaaaagatacacgtggataggaaggatagctatactaatttggtatactcaaaatacacctttggtacaaaattgacaatctcacaaggatgaaatatcagtaattttctatttactggttgatcccatcttttacggaatcaattccttttttgaatgtacaaaaatttggggagctcagcatgtctggaagcacgggagaacgttcttttgctgatattattaccagtattcgatactgggttattcatagcattactataccttccctattcattgcgggttggttatttgtcagtacgggtttagcttatgacgtgtttggaagtcctcggccaaacgagtatttcacagaaagccgacaaggaattccgttaataaccgaccgttttgattctttagaacaactcgatgaatttagtagatccttttaggaggccctcaatgaccatagatcgaacctatcctatttttacagtgcgatggctggctgttcacggactagctgtacctactgtttttttcttgggatcaatatcagcaatgcagttcatccaacgataaaccaaattccaactatagaactatgacacaatcaaacccgaatgaacaaaatgttgaattgaatcgtaccagtctatactggggtttattactcatttttgtacttgctgttttattttccaattacttcttcaattgagagaaagaaagagagtagtaagaattctcttatccccatttggaaggataccatccttataactatccatgactgtttttgtctctagcatgaccacttgataaaatgtggaggaaagtaggggaaatggccgatactactggaagaattcctctttggctgataggtactgtaaccggtattgctgtgattggtttaataggtgttttcttttacggttcatattctggattgggttcatctctatagtaattggagggaccaggttgtaaacatgaaaaaataggaacttagcgggtccttacccccttttatctgattagagcggaaaggacccgcggaattcttactcttataacccgacttttttaatctattccataacctacaaacgggtttcctattttgatttgtaaaaataacaaagagaaagcctttgctctgatggtcagaatccctctatttattcgttttgtttgttaattttgtttgttaataatgttagtgaagtaatccatcagttgatttataaccccctcgccaatgaaattaattcacttttatgaagcgaggagaaagaaaggatcaatcgaggatccaatattttattccccggaggaagtctcttgtaaatcattgatttaatttagagtaataaactaataaaaccttaattaaaactactcaactagcctaaaaataaaaaacagccttcaatggaagagtatccgttttttttgcaaaatttctgtaagttctaaattgaacttaattgaacaagtcaagcaattctatttggtcacaaaaaatttgtcccacgccatattttctttccctctttttgtccactacatcgcctgaacctaagcaaaagaggttcaagagacagacccaaataaagaagaaatagtaatctttgccgaataggaagaaaaaagattcatatttcgatacaagaagaatcgacacaagaaaaaggcaaaaaagcctttttcttgtgcccaatagaggattaagaagaccagcaatccctcctaaaaggatttgttccttttattgttctcgcccttgccttgcattctcctcgttttgcatgagatgatagaaataaggaattgcagacaagacatctcgcaaacaaaaaatagtctaaacaaaaaaaagatttccaaaatggatcatagagaattctagcaatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaagaagaacaaaaggccttgaacgcgtaatggatcctgaagcactatttctgcatccccctgaccaaaccctcccacattaggattacttgttaatggttgatcaagcttgatcgattccccctctgaaacaagaagttctggaccgggaggtataagatcaatcacttggcgtccatccgatgcatcgactatggatatttcatatccccccttttctttacgcagtatttttcttactacacctgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacagcacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggatatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaaggaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacaggaaaactacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtatttgtggatcccactgacatgtgggccccacatgccatcttatccgtttcttcttcctcccctccccccttctctattctctccctctcccctacagccgttcgcggggagcgagcggaggcgggcgggggctgaagcagcggcggacggcgggagctgaagcggcggcggcggaggtaggttggagtccatgtcgtgccgctgccaccaccacccgcaccacccgacggccggcatcgagatgtcgtcggcggccgagctcccctctgcgggtgtcgcggcggctggcggagactgcggcgagcggcggcggctgcacggagtcccgagcggcggaggcgcaggtgtggagcggcggcctgcgagcggcgcgacggagacgcgggtgtggcggcggcgacctgcaggtcgagcagggcgcggccgagctcgccgtaccccgccgcgtgtgcctcccgccgccgccgctgtggtctcctccatcttcgccgtggtggagctcagcccgggcaccgccgccgcccgcaggcgatcagctacaccgtccgctccgaccgcctgacgcgctcgcgctgctcctcttctcgcagcagatataccccatggtgaacgaagacgcgcagtacggcgacgagctccgggccgtgtgcccgccggatgcggaggagacggcgtgggtgcacctggaccacggcacgccgggggagctcgacagccagtgctacgtacaggaacgtgctcgccgggaaggtgctggctattcaactcggatcactgggcactgatcagcgaagcggcgacgaggcagatggtcgaggacaacgcggtgaaccagtcagccctttgcttgttggcttgccgcttgatgttagtacacacatgcactgcctgttgctaccgcttgtgcttgctagccgcagtccagccagtcctcatctgtcgccccttgccgattgcctcggcaaccagcaggagaatgctcaacgcagatgcctcccaactcgcgtgtggttgcgtcgttgtcggctggctcagcacgccgaccgcgtccatcggcggcggcggcgcctcccccgcccgcgccgctcctcccgccttcaacgccgccgccgtcgcaagtgcaggagaagccgccgccggatgctgccatcttcgaggggatgccgacgcgagtcgcggtggcgagacgcaagcggcccttacgcgttcgtgggcgcggcgggagaacggcggaggcgggtgcgtcgtggccggcagagagggcgtggagcacagtggtggatagtgcagtcacgaggccgagggtggcgaggacacggccattctcgtggcccgttttcttccttccgacggccaaccttccacggcgggctcgatctccgccgccgccgccgctccggccctcgcccgcatgccgccgtcaccgctccagtgccactcccaggactccgccgccgctggccaccgtcccacactcgcggagagaaagagagaggggagaatatgatttatgtgagccccacatgacagtgggtcccacccatacttttggtgaatgacaaatgggtcccacgtatatatttttatttctaatgccacctaagcgccatgtcaacgccacgtggacagaagaccgagtcaatactgccacgtaagcaccacatcaacaccacgtggacagaagaccgagccaatactgccacataagcgtcacgtcagcgaaaccgccctccaaaaccaccaagggagtcaaattgcaccgtttttaagagttgggggtcgagatatccggttttgtggtttagggtcacagattagatttcgatcacttttaagggtcacaaagtaaacttattcctcatgcatatactcttcagagattttgatccaaaagaaacatatgatccatgacaccatccatccacaaacacagaagcagttttccccagtccatcgtaagcaatcctggggttttaatttacatcttcctcaaatccgagctgttctagtttctacaagagggagcttgctagtaggcatggttggagaggatggccctcccatggcggtgcgggtggtgagcgcaggcgcagtggacggaggtgaggctgaggcatccgctgatgatgagggagtgccgctccgggcacgtgtggagcgccgggaaggagtcgcacaccgcctggaccgccggcggcgtcagcgccgtgcactggctgatgttcaggctggccagcccgtcggcgccggcgccggcgttcttcctcgccgccgcgtcccagctccggcctttgctcctcacccgccggctgttcgccgccagcgagtacattgcccggtcggtgatgttctggcagtagtagagccccagcgaccgcaggtgagggcagccattggcaagagcgaccacgctctcatctgcagatcaagaaattgatcagataccattttgtcaggcttcgtacagtttagagtaaatcagcatgtcaaagcaaatgttattcaaaattcaaactgaacaattttaacattctgtgaccctaccaaaattttggtaactttaatagtaaacatgctagtttagattgaagccaaacaattagtagtgcccacgctcactttggctacattctataatcttcttcactctcatactaaattttagctttatattggtattaaaccaaacatagattagctaactttgccctaccaaaaaattgatagtgccaaaatttacctagattttggtactaccaattaattggtagtgtagagaaccaaataggccctctgatcaaggaaaaaaaaacatcggagattacctgttatcagaacacagccacacaagtccagagcccgaagttcagggcaccctgatgccaagctggtcactcccttgtcagttacactatcacaccagcctaggttcaaagactgaagctgaccacagttacaggcgatggcctgcatcaaggttataaagatcagaaagaattcgatggagagcaatggcgcaactactttggtacctgcaatgctctgtcggaaactgccctcacacacccgcacagattcaggcatttcaggttcttgcactggctactgagataggccaaagcagcatcgctgaaattggaacatccactgatgttgagccttgtaagatgggggcatccatgtgccagagcatacaacgatcggtcgctaagcctaaagcttctgctaagatccaactcgcgtaaatcatgacagttatttgctacagcctccactgcactgtcctcgagctgaggtttgatttgccgtaaagaaagaacttgcagcttcgtaaatttctgagcaagtgacatcactaagtcattcatgtgagcctggcacctgaaaacaacactctccatggttaaccaacagccttattgtccacagatgcaatcaaaattttgttcagaatgacgaggttttgcagtcactaaacaatatgtctgaataaagcatactcctaaaccatattgccaatacaaagttatctgatcatgcttcttaaactctcgtatgactgtcttagtatcaaaagtttcaatcaaacaagcatttgcaccaccttgcaaaaaactagtaacacaacaaatgatgtttatgactcaatgtgaccacaaacaatactcttctcaattggtggcgcgagcaaacagatgaggcagaaaagttgcaacagaaaggactacgttcagttttcttgaccacgctttgggagatttggacggaaagaaacaatcgcattttcagagggaaggagtctacaccatcagctcttgctggcaagatcatagatgagctttatttgtgggaaatggtaggtgccaagggagtgaagtgtattatgttaagagattaggcttttgttttttctcaggagtgcaggcaggaagagttccttcacgaatgcctctcctcttctgttctgtacagtttttgtgttctctaacttcttctataatataaaaccagttcgctgggttctttcaaaaaagatgtttatgactcaatagaaaacattggaacaagccagtcagaatatttttgtcagacatcataagtggcaaacaggcaagtttctataaacactacaaaattaaaatccggagtttctttagctataaaagcatccaatttaaaagttacataactattttgtggatattatcacataacaattcttctatgtctgtaatattcaacatgtcaatactatgtgagccatctacccataaaaggtcagatagagacgacacgaagaatctaaatgtttcgtgagaatcatattcaggaatgggaggagaaggcaaattgccaaactcaccacgaaagagaaagattcgtgactccccattctaatgtatcacgccaaccggtgcaaacaccagagcccacgattaccatcctgtcgtctccagccatcgataatatccgcaggagcagctccatgggaaggtccttccaacctaacaaggtagtccctgtgccctcatgatgtgcctgtccactctcaccctctccagaaaccatgagtgcgttgaacgaattgtccaattcaccactcatcagctgctcaccgtccattctttttttttttttggataatctgaagctccgaatacagctaacctgcaagcaacagtgaagttatcagggactctgcactgatgtcaaatcccaatctgaacttgatgctaccagaatatagcaaattaatcccagaaaaactcaacaaaacagatgggagcaatcataaagtcgttttgcaactgaacaactcaaatcttcaaaagaaccgaaatagagctaagaatggagagataattcagaaagagcaaccttactatcaacaattctacaccatctagatgagaatattatcataaaaatctcctagagaaacttatagggaacacacagaaaggtacctcaaaggagctcctaaaaaagcacgtattctctgcaagtggcaatttgagcagaaaccgaacttttttttttcccttttgtataaaaaagggagctccttgtaaaggtcagaaccgcattaaacccaaatgcagatgagacggcaagcaaggaggaggcgaggcgcaagctgcccagcctttgatttggccgaaaaattcaatcccttctgtcgctaaaacaccagaggcgtggccggcaccgcaaatcccaatcaacaagaggcaagtaggcaacaaagctaggctttcagatgattccgggccacgagaagctaatccaggaaaattcaccaagaaaaagctcaaatcatttggaggcgagatgaatgagcgaatgataacggagtcaatctccaacgcagataacatccgttcaagactgatagtgacctggtctaaatatcttcaagaaagggaggaaaaagaagaaaacaactccatcgctaaggatcgcagtagctttcgcgcacagccagccacacaaacaaaacagctcctcccgaaatgcagagtaaagctcaaagattcatacagcatccaagaaaactacatgggatccaaaccacgagagatggcgatctcctcatcagcatctaccacgaatcccagacacaaaggccaagaaatcccgcaaaagaattcacccccataagacgtgaaacttcctttcttactcacctagtcctcgctcctcctccaagaacacgcgaagaaagaagaaactctagatgaggcagtcgataacccgggggagaattttgtttttggtttttgccgcagttgtgaactggcggctgggttgggaggggaggagggctcgggttcttgtaggggaggaggacgccaccggggagggcagcgacccgaggtggcgcgtggcgggtggaaggagaggacacgtgggcggtggcgtcggggggcggggcggttagggccccgggatttttatccccgttgatttgcggatgcggggacgggaaaacgggaggagttcgctgtccggactccaggcctggaagcttttgcccccgggaaggctctggaagggccgaagggagggatcgtacgccttgctctatcaggtcacgatttatttatttattttttaccgggcttggccggtagaaggcccagcagaaattttgtgcttctgcattgttttctccatcttaaaataaacgatcggaatgggatatgatacaacaaattagaatatagggttaattggatctatggctatatccgctaatctgaatttagacataatccggatttattgtattaggcgtcccaatctagattggtttatttggaatagacgtaatgcacactcctgctgtgtaaagattaatttaggtgtgtctatattctatagcactagtacccaataaaaggaaacctgaatagcaagggctagaaattttgaaaaacggttagcatgtggatttttcctcttctgtctactagctcattttcaagcagcgaagctattcgatcaagctgtaaattttggcatgttcgacagcagtggtagcatctgcagtcgcacattatgcatgctgtttataacactattctggctggatacggcgcaaccacaaccctaacagccgaataggccttatgagaaacaactaagcatcggatcttggggcttgatcagattatagccaaaataaaccttaccaagttttggcaatgcaaaaaatttagcaatacatttttggcaagtgataggatttcttatgtattgaccagatttggtaacgaactaaacgtagacatttttttagtaactttgcgaaaaaaatagtagggttgaaaattgaatcagagtgaacatgcacttgataagctaagatatcttagcttctagctactaattcattttcaagtattaaggctatctaattgagtcggaaatattaagaaatagctggtatgtatcgaattgcttctaaattctactaattcattttctgaatcctaccgttgagttttgcatactaaaaaaatgaatatagacttttcggataggcagatattcgagcagctgtgcatttgctagaaacttttcattttacattgccagttttacagaagattagagtagattatccagccagaatgccagatggccgtccagattcaatgaactaaaccaatgaacctacagtacggcatgagaccaatcatgcctccattgattgattgatcgatcccaaaagacaggcgacacaccggcctctgatcagatcaatctttgctcccttagtgggcagtgtcactcaccactctacatgctgatttgtccttgctaatgctctactgctacccactcgcttgtcgatttgcagtcgccatgaacctagccacgaatctagcccaaattggcactcatccccggagctcccaaagcagaaagcacccgacgagcaagagacagaggcaatgtggtgataagatcaacagagatgctttggcagagatcggccacgacgtagatcgatttctagagattaatttattaatagatgggttaaccaaatcgcatggcatcttctcatgcgggttgacgcaagcatgcatggaccccgttaattggcttaatttgtggtcttaatacagaggattactcagtttcagagtttctatgtgttgctcagggcaaaggttggattggatgatccggcaagcaaagtagacgcaacctttaagctataataatggccatagttatctagcctttcagtgtgtgtgatgtttacttggatgtatccttctaaactctgactgaattaccagtttaccacgcaaaggattgttaatttcatgtagagttgagtttattaaaaagaaaaacatctgaccatctcattccatgggctccttggttctgcagaagccatcagttcacaggtctttttcccgacgttgatcagttcacagtaataatcctgtgacttatgtcatctttcagcaagaaaccgcaggcagaaaaggctaaaacctagtcaagtacagtcatcaggaagagcttctccgaatactcgcagacatttcgatatgcttttatccctgaacatattcctgcttatgtgtacagtatgtttagcatttttttttgacgcaatacgcttaacatgacacacatgattcctttcctcatttaatgtacagaactatcaattcagaatatgtgttctttgctaatcccgaacgatggagaagcttggcttttaattatagttgatgtggacgcaaaaatccttgtacctgaattccttgtttctgcagtttttgatcggttgcctacaagctggaacagcaatggcgtctgctgctcatttgcttgctgatttcaacaattggctatgctatgggatatcaagaacagctttgatcaaaacactgtgtgagtcagcatctgacgagttctgatattgatagaggtggctggggtccattagtattagattaatgatgagacctgagtgtaacacaagttccttctaatccttctcttggcagattctctttgaactgttgtatcaagtaaaggaaattggaatggttccttgtcaacattaaagctgtcacaacacgatgcatgagtggagtgctactcatctttttcttgttcagagattcctaagataaaatttgtttcattaaactgacatagtacaactttagcacggtcttctaattaacatagaaaattttgccaatgatgttgtttactcgtaacttgttgtttcattagtaggaaaagcacctttcctcctagtacacaacacctttcagtttcgtaggataacgttatagtattccaggagggaagaacagcaacttttcttgcgcacacatatatgcttttgcaggttcttggcttcttgggtaatactaacattctgccctcatttattttctgaaattgcatcctgggaataggcatccaatcaaaaggcattttattccccctacgaactcaaatcgttgaaacggttcggccgcctaatgatgacccagaatttcagacttcccattcaacagaatgctggttccattgccaacttgtagaggatggaaaaggacggcagacagcaatccacaggtcaattcattccctataagcatgaatctctttttaatcagaagtttttttttttaatttcttctgtaagttagtgattggaatggccccataaactatattctgcagaaacctgttcagctgggatcaaaagcagatgtcagcattttagatggctcatatccttatctgattagtacttattttcacctaaaaacggcaacggatggagaaactgaaggaaaacagctgcctagattgcatatctttatattagcagaaactaaactgctgagttacatatatgctaataaaatggtcacaacatagcacggctcactcttctttcgtactctacagatcacactcttcacctacacagtagccccaaaatttgatgttagtaacacaaaggacaataacatgacaagatgcttttctttcatttacaaagataagacagaactatcagaaagtgaagcgctgattcctcaaacatacagcgttgtatgcatgtgaacagataacgggagagagatggaaaaagaaatcacaacagtggcagagtattattaagggtgaactcaaagcagacgatttctctctgaatactgcttcacttggtaaagtgtgggatgaattgccgggacaaatctctgatgtgttcattttctgactcaataagacgaacaacctctcccatagaaggccgctgttctgggtttatcctgacacaaagatatgcagctcttgctagatgatacagcccatacgtatcgtatgtttctgcaatgcgctcatcaattagttcatgtagtgcaagactctcgaccaaaggttcagcctgaaaattttgaggtgtcagaaatgaatggtgcaggtctactgtaagtaggttgacaaaaacaataagaaggatctactaaagtgaatacccattgtaatatatgtgtacactgccctccacattcatcaagcaccttgcgaccagatatcagctggaaaagaacaatcccaaaggcataaacatctgttctgacagaaactatgccatattcagcatattcgggagccaagtatctgacaataatgacaagaaatactggtactgttagaccttagaaaacaggagcaaaatgttagcataaattagaagataaagttttatcggtgaaataatttgagtttattccaaccctgattgccccagaatccttgtatggatagaagcattgctagccttccattttgcaagaccaaagtccccaagctgtgatggtataacatatacaatcacagtcagattgcatgaagcatttgcatcttgaaataaacagataagcagtgactgagatctagtattctccagattaccataggaacaaagtcatgtgtcaaaagtacattgcttgggcgcaaatcccgatgaataattggaccagcacgacattcttcgtgtagaaaacgcagcccttttgctataccaagggcaatagcatgcctcttgtgccattccagtaagtttgcgtccttgtctatttcatcaagtgacgagcaaagtaaattagccacccttcatcttcacaatataaattactttctgcacatcaactaagctcttaccaaataaatgccactcaagggatttgttgcatatgtactcatacaccaaaatgttgtagctttctttgcaacaatacccaagcagcatgacaatatttcggtgccgggcaaagctgagaacttgtacttcagagaagaactcagtatagccctgtgagcttgcttccttgcgtactttagctgctatgacctggccatccttgagttggcccttgtaaacatgcccaaacccaccctcacccagcaaattctcatttgagaattcagacgttgcagcttgaatctctgagaaggggaatttcatagattcctttatgtaaagaactgactttagaccacaaccagcacacagaactggtcgctctgatgaatcatagtggtagaacatgtttccttcaacacctttacctgtaaggacaacaggagcatatgtaatgtgcgcaaataggtatggtacatgggctgtataaaatcaactattggagggtaaaattgcacaattttaactctgagaaaaggttttcaaaagctctctaattctatctgtatgaaatagcagaaatacaaccaggacacagtgtttccttttctttctttacacgtttatctagtttgaaattttgagcaaagtacactagttgctaacttacgattttgctttacaaaagaaacatgccataccgttggacaaggaatcagttccgtcaatcgttgtgagagacatggcgctcattgatggtgtcaaatatgacatgctgctcccgaccacactggatgtttcatgcatctcgtgatagcttagagaggcaaaataacttacaggtgatgacttggtcaacacactatgagtgtcagtatctaatgtctccgaacgcaggtcgagtgatactgctaggtgctgcagagcctttacttcccccatgcttttgctcggtggaattgtcctaattatcttcaatggctgcaccaccaagttatcctgaaatactgccaccttgcaggcaatgtgcttttctaagtacttgaaatctctcctgaagtgcctaaaaaattacaaaataagtacctcgtcaagtattgaaccaaacaggcttaagacttgtcacacagatcctctcctgtaatgcagagaggaactgtgtggacagtaatttgtctctgctgctagaatagaaagtctgtaacaatgttaaacaagacataatgtgcatacctatctagtacaacccaagcagctttgctggatttgacttcattgataatgacaaacttggctggtgatccaggagataccttaagggtcacattaatctgaaataaaaacaacgagcatcagagtgtaacacaatttttagtgcatgttttcaatctaatcggtgaagcacttcattatccagacagaaaaaggttggacagggattactggattagagacgaaagtacttgcagttttgtttcataaaaagaagacttatttctctatgaaatactccgtaaatgcaagcattggtaccccgactttgcttagctcctccacgtcatgacggagcttgttttggtagaattcagctttcgccttaacctgatcacttagtaatcgcaagttcgtcccggcaaaagaatcaatacatgccttggtttggtatcccactaaacaaaggaaaaataaaaagaactagtaagttttcagtaaatgcaatcattactttgctaacatataacattcgaagtagcacaaacactcaaacaggaactgaatccatatttccaaacatacctgtactaagatggataagggtgcactagctaaccattatttaaaatcgaattattacagcttcagactagatatttttaaaatggaactgttatcattgacattcaatgtgaaatttcacaaaagcaggatctaaacatatcatcgtattaatgctggactatctcttgaataaatgaataggattctgtttttgaaacaagaaaagaggaattctaacagtttccttgtgatggaattagatgttcagaaatccaactttgtcttcagtgattcgctgaataaagaatgcatggatcttctttttttcttcttttattttcttttttcctcttcgtcactctgtttcccttacatgacattataggttgtcctacccaacgagatgttgccccaatattgatgaccaacagcacagaattgcagtaggcacatctatttgacatctctttcactaacaaaacaagaatgccactataaaaattctatctaaatgtacgataaaagtgctagtgtgctacaatccattcccactctagaatttgcacatgtttaggcttccacttgtactcatgtaataccacttcaattgtggagtactatgtaaatgcaaaatgcaactagacagcatttcgggtaggttaattcgtctaagtacaatttctgagctgtaggagttaacaaaagagggagttttaattcaaggagaaagagctgggagaaggtaacccgtgggaaaagaagggggagcgtggccctcactgggattggtgatggcgtggagcacgccgagcacgaggagggagtcgccgccggcgcggaggatgtccccgcgcgtgaccaccgccctgagcgccatcctgatctcctcctcccggtggtccctcgtcgcgtcgagcgccagcaccaccatctgcggcggcggaagcagcggcggcagggccgcgggctggaccgctgccccgccgcccgcagcggcgctcccatcggcagcctccgcggccaccgacgacgccggcgtggggtggtcgtccccggccgcgatgaccgagtacatcgacatgggcgtgctgaccggggtgctggtggcgctgctccggtcgtccccacgcccccgccgccgccgccttcccccatcgtggccgcccgggagcgaggctattagtaggccgaggcggcggcgcgcggcggagtatattcgcgacagcgcggagtacatcccgccgccgccgccctgcttgctgcaggcgcggggggcatctcgaaggcgccggggcgggatatatggtggggcatctcgcgggcgatggcgacgcggggggttctaccgagggcgcccgcggcggcgacccgcagcaggttgcggttgtcgcgttcgcgcgcgcgcggacggcttcggcttcgccggcggaggcgacgagacgaggcggcggagaggagcggagacgaagaacttttcccgttgccgtcggccggacacggcccagcgactttagggcccattgcgcgaagactatccgatcgctcgcgctgagcatcgtaggccgatttagcaactaagcccatcccttcgagaaaagaaagcccatgcacgaaatataataggcaacattttggtgtcctctgttatcgattatcaacgtgggagtaaatccgacaattaagtgctctaatacctcttcatttgtagagtgtgcagcgctacccatcaaacatgggtcacccaaatcacattgagatatgctctatcgtaggtttaaccggaattaaaactttagatactggtctgcacaatctaaaaaattagtctgatgggtgagaattgtttttaccttttagtcgtgcttctccatcatcctataacggtataggactaaatccaacaatttaatggaaatggaagatccgaccaaccacgaaacaccaccgacggagaatcataccaaagcaaacgagtcagatcgtaaatcactataaattatagcagcagcacgtgtggataggtgagaaattgctgcaacacggacctgacgaccagcaatcgtggccagtttctagccatttatggcctgtgattaatacagtgtgtggccgaactgattaagaggtgcagccgcctataaattcagcctacggagtactgaaacattcacgatctcgatctacgcggcatcggagagaagctgatcgatctatcggtggggcgcgcggccgcgatcgatggcgaagctggcaggccgcggcagcaacggcgccaccgacgaggcgctgcgggagtggcggcatcacggcagcaagttctacgatacgttcaccgtctctggcctccgcgtcgacgccatccagcccggccgcgtcctctgctccttcaccgtccctcctcgcctcacggtacgctactagtagctactacgtccgtctcattttaaatacagttttggttttttcgcgtccaattttaaccgtccgttttatttaaaaaacttttaaaaaaaattaaaaacataagttaggagtaaagtactatttatgctttatcatttcataacaataaaaatactaattataaaaaaatttcaaataagtcgaatgattaaaattgggcgcggaaacttatggctccacttaaaataggacgtagtgagtagtaaacactctttctgtcgcaatatacatgcatctagaattgtatataatattgcgggcatatttagattgtagcgaaaataaaccttaccaaaatttgacaaattgccaaaattttggtaggatttcttatgcatttattaaatttgacattttttgcaactttaccaaaaaaatagtatagttgaaaatagcatcaatttgaacagtcccttcataatacaatgagtttaaatggataactgtccatagtcgttttactatgaaatatcacaatcgatcctagatacgcttataataaaatggagggagtacttcctttctccccaaacaaacaacgccattaacatttttacataaggctcgactattcatttctctactacttaaaaaataaaatgtgcttccatcgtccgtaaaaaaaaataggcgaaaaaaaacaagtttgtccgataaaaaaaaccgggcgaaaaaagtgcgaaaaaaaagaaaaaccaaatatgcccgatccagaaaaaaggggggaaaaaccggggaaaaaaaccaaaattgtccgatccaaaaaaaaaaccgggccaacaaaaacgtaaaaaaaaaagaaaaaacaaaatagcgataaaaaagtccgactcggtcccgtaaaaaaatagcgataaaaataaaaaaaagcccgactcctcgttgcgattccctctcagaaacaaaaaaaaagtccaactctagatccgagtcccactcctctcggtttgagtccgagatactaggcaccgcttctctcagtttcaatctatagcgtgatatttcatacatcttggtaaaaaaaaattgatatgccggattgaagatctgtttgcaaaaatggaacctacatgtcgagagcatttcatttttatatgattttaatttttgggtttgtacatttgcatttgagtccctgtaatttttatatttacatttgagtccctataatcttgcaataaggtgcttttggtcctttttttttgaaaaaaacaataaataaaagggatagaacaaaggcagaaaggtgcataaaaaggaaaagaaaagccacacaaaaaagaaaataaacaaaaaaacaacaacaacaaaagtctatttcccctaagtggtaaaaaaactatagatgcaaacggaaaaaaaatctaatttgtataaaaggcaaaaaaaagtggcgaaaaaaacgctatatccgattcctttaaaaacggaaaaaagtctgatccctgtaaaagcgaaaaaaatctgaaaaaaatctaaaaaagtttgtccgattccctaagaaagtggcaaaaaatagttcgtaaaaaataaaaagctggttcgtataaaataaaaaatgcacgcgagaaaaacaatgaaaagggcgaaacaaagtccaatttctaatcactataaatcgctctgaaaaaactgttagaaaaaagctaaattgatggacgcttgagtcggataggatccatcgattttttaccatctactacacggtttttatttcgtcatatattctcatgtattggaaaaaagcaaaaaataatattcagaaaaaacaggcaaaaaaaccacgcgataaagtaattgttagaaaaaataggcaaaaaacacgcgagaaaagcaaaacaaaaaaggggagaaaaatatggttttcgtcatcagtaaaaaaaaggaaaaaacatgctaggaaaaaattgttagaaataaatgcgctatttctgaaaaatagtttgagaaaatcgagcaagaaaaaacaccgtttataaaaaaaacaagccgctcattaaaatacaaacattgtcattgacatgattatggatgaaaaacttatattatcattagaattttttcacccgttgtaacgcacggacattttgctagttatttaaaagttacaaaaatattattttttgtcgtaacttgttgtttatcataaaagaaactatagttttaacttatattttcatatatttatactaattttttaatagtacgaatgattacacgttatatatataaaaaaaaatcatccgctcggatattttgggacggagtagcacacatctacgcttacatgtgtatacgtatgcttacgactcgaaaaatgagtgaagaatgcaaggagcaaacgcatgcatgggggcgcggtggcgtctctggtggacctggtggggtctgccgtgttcttcgccggcggctcgccgaagacgggggtcaccgtcgagatcaccgtctcctacctcgacgcagcccgtgcaaacgtaagtacagtacccgtgatcgagcttcggctgcttcgcgatggatattgatcgatcatgcatgcgtggtcgcaggaggagatcgagatggaggcgagggttctgggcatcggcgagacgaccgggtgcgtcaccgtggaggtgaggaggaagggcgccggcgaggtgctggcgcacggccggatcaccaagtatctcgctgtctcgagtaaactgtgacgatatataataccatcctgctagctaagcttgcagcaggcaggcatgtgcgtagtgcatacatacatttgtacaattaaatagctgatgatttttccatgaaatttgatgttttactagtagtagatttaaaagttggcaatatatatccgtcccactctgctgaagggagtagacgggcgaacaggggaggctgcgagaaccgagaggtgcacgagcacgagtcgggatttttcggccgcggttgggcctaaaccacggtagcctggctggatgacggcccatcaaccttctggcccaagagagttcgggcccatgttacgatgccacgacggaactgtggatgaataagtctattctgtcttcctcatgtcttgccaccggttgaatcgtgcccctaaatcgcaaaggaaaaagtacaccgaaggtccctcaacttgtcatcgagttacaaaatcgtcccccaactgcaaaaccagatatataacatccttcaacttacaaaaccgtttactttaggtctcttggtggttttgacccgattttgtctgacgtgacggctgaatcagcatggatccatgtgagccccacatggcaggattccacatcatcatcctatctctttcctctcctctcccttcctccactctctctctctctcacttttctcctcttgggcaggccggccggtgggtggggaggaggtcgccgacagcgggatgcagtggctgcggcgcgtacctagccgtgccgccgggggcgcggtcggtgcgatgcgcgctctgccacgccgtgacgcgcgtccctcggccgcgccaaccacagcgagcttagcgcccggagccacgagaagtagtcgctaatgacgagaagcgcccgcgctgcctgcctcgtggtcaggatccggtgcatctgctggagcgtctgctacctcagcagatcagcctacacaaaaaaaaatcatcgcatcacgccatggtaataagcaatttagttcgccattgatgtttgaccgaagcttgaggaagttctccagcgtggtgagcatggccatggcgatggctatctgtcccatgtagttggtgacgttgtcggcgcctatgccgccgacgaccacggtggcggccgccgatgccaatgtgtctcccagcgtctgctgcagagcctccatcccctgcgacagcgcgtcctcgacctgctgcgaggactgctgtaggttgcagatgcccataaacaactgatccgtcagtggctcaagatggctctcaagaacctgcacaaacaacatcatcatcatcatcattcaacaatagcagtcaatggtagcttcagattctttgcttgttactgaattgagtgggtgatcactcgtgtcaaaccttgaggagctcagaggaacagaagccgccgagccacatgaagaagcgctcagcgtggctcatccacaagccggagaggacatggaacacgtcggactaggtggcgaagctcttgaggcggaacacctggtcgtagtgcatcatcacggcgtcgacaagcacgcggagctcgtcctcgctcatcagtgcgttcacgctgccgtcgccgttgacgatgtcatcggggtacacgcgggcggcggcgagctacccgcgcgtctgcggcgagaagcgcggtctcctcatcggcatcagctacgccatcacaaggcaccagcggcagcctcaccatctccagcagcggctgcggcgacatccagatcaataagaccatcgtcactgccgctctagctcccggcggcggttgctccgaccacacatggtccttggccggccgcgccgccgccacgttcgagcccgccccctctgcagcttggtgtgttgccgacgccctcctcctctcccgcgctcgccccgccggctgccctacccaaggaagagagagagaggaggaagggggagaagaggggaaagagaactggaggccaggggagaccggaggcgcatgcgcgaccggtggcatgcagcggagaagagcggcggcttgctcgctccgtcggaccacctcacccgcctcgcccggcgacctcctccccacccaccactaccagccagcctgcccaagaggagaaaagtgagagagacagagagagagagggggggaggaggaggaagggagaggaggggaaagagggagggtgataacgtggcatcctgacatgtggggtctacgtgggtcccacgctgatttggccaccacgtcagacaaaaccacggtgaaaaccactgagggacctaatgcaaacatttttgtaggttgagggatgtcatatatctggtttgtgattgggggacgttttgtaactcgacgacaaattgagggacgttcggtgtactttttccaatcgcaaaaccgggtgtaaccctgggggatcctaatgggcgatcgatcgcccggagacgggggtagcgatcgatcccctctcccctccctccctccacccctccacctggtttgcttttttggcaccgtattacttttctattttagtaaatttatacatctaaagtttatacacctcaagtttacacatctaaagtttagagaccaaaagtttataagtcaaaagtttatatatccaattcaaatttgaatttgaattcaaatacttttttatatatagtatttctatacatctaaagtttatacacctaaagtttatagacctaaagtttataagtcaaaagtttacatacccgtttcaaatttgaatttgaattatatccgattcaaatttgaatttgaattcaaatattttctatatatagtatttctatacatctaaagtttatacacctaaagtttatagaaccaaagtttataagtcaaaagtttacatacccgattcaaattcaaatttgaattcaaatattttctatatatatagtatttctatacatctaaaagtttatacacctaaagtttatagacccaaagtttataagtcaaaagtttacatacccgattcaaatttgaatttgaattcaaattttttatatatagtatttctatacatatttttttctaactttttggtttttttaaaaattttgtgtggtgtactgtaataggaagagaaaaaggggaggaggaaggagggagaggagggaggagtgcatcgtataggggagggggcgggcgggtgatcgctgggcggacgggggagcaatcacccgtccattagcattctcggtaacccctcccacatctttaaaaactcgtgcaaatcaaattcctactatggtttccaaagagtttccgtcctgtatggcgttcatgggacttcatgtaagcgagataaaaagttaaaaaaaaataacagctccatgtgttagtcatcctaattaacctccttttctttttcctcttcctctctctctttctttcccattctctctctcgcgcgcaccagtcgagtgccccactcacggccgcaatactaagatgtggggccgttttttaatcttttttctcaccgacatgtgagtcttatgagtctcacataggacaaaaccgtcttcgcaaccgctaaaaaagttgatttgcatcgattttcaaatatgcgagaagcgttatacctggttttacgattgaggaagatgattcaaccagggccaagacatgagggagataatggaacataagatagctcatgaatattacaataatgacatatgctagtaaaaccatatgagcctaatttttactccctccgtcccattttaagcacaacccatgagttttcgtgtccaactttaatcgtccgtcttatttattttttttaacaaaataaaatatataagtcacacataaagtattattcatgttttatcatataataataataataataataataataataataataataataataataataataataataataatataataataataataataatactaatactaatcataaaataaataaataagatgaacaatcaaatttggaaaaagaaactcatgattgcgcttaaaatgagacggatggaatagcatttaaagtagtacactccttctgtcccacaatatagccagttttagccctcggccgagtatcaaggagagagataaaaatactttatttgtctccttagggatgggtgaattgtcgactagttgggatcttgggatgatataaaaggccagtgatactctagtatgggtagtttagtgataaaaatttacccttacaagtattctgtcacccccaatccggcaccgccgtacaacggtacctaacaggggcgtgttgtcggaaaaacggtgagaaccgcttcctacgagaccgcgatctcagtaccaatcccaggacatagcgctggtacccacggtgacaaatataaatcattgcaatccttgaaataaataaatgacttatttaccttaactagggttgcagctcaggatagcccgagattacaaccgacgacacggacgaggcaacaccaacaacggcagcagcagcggaaacaacggactaacacccaacaccacaggcgacggctggaaaccaggacgaaaccctaatcttcgcttcacttaatcttctcttcaagatggaggaactatatatatatttttttatagagcaagggtgagtactttcgtactcagcaagtcacgggaatttaggtgtttaatgcaagcttggaagagaggcaaggttgttttgcaaatctattgttttgaaatcattttgaaatcactaagtggtctacttctttctaagtttgtgccgaaaagagacttgtgtctcgattcgacttttaagagatgtttttcaatagctcatttggtaatgtaccgacctcctgggtcagatcattacttctcggctcccagagccatttcacttgattaagcggctcccagagccttttcattttctcggactcccagagtccaactgcccagcagcacaacaatccgcttccactcgggaagcctagtctatgatgcccgtagacatcccgaatcacacagattcgtttcttgaccactcaggtcatccatctgccacataggctgattctggtaacgattcccacaccacaacaactttttacaaagcacaggcaaacacatctacgctataggaaacaccttacatccgcccatgaccgtgggcacggctgttcgaacagttagttaacctctgcagagggggtacactttacccacacgacattactaacccggatcatccaacccgtggagaacagctacgtctggtgaccttaaggctttcatgacaaggcatttcgaaagccgacacagggtcgccatatgccaacgagaggggtcccagaccgacaacaggttaggtcctagaccatactgtgccaggaagcctgaggattccacccgacaccaccccattgaatccacatgtctcttggcatcaaggcttccctggtttgctatttactcagccaggggcgtcccattgcacccgtgtggtcgcacttgttatatgctcggatgaatttcccacaggaatcgatccttatatgcgaatacgggacagtgccacacaggcacaacccccgcatcgtgagtttacacaatttattttattttcaaacacaccgacaccacatgtcgggttttcaaggcttttcaaacccatttcccaagttttcgacaaacaacgatgtatgtgggatatttggtatacgtgcttagatagcacgaataccgaggtaccacaaaggtggagtgacaaggagtcagggtagtacaacctacaggaattagtgcgactactagtaggtccctcggtttggcatgcaaaccgaggccaagcaagttaaacgggtgattctaataatgcaagttgcaaacaaaataataatgatttttcaattataggagcaattggtcaaagggtgacttgccttgctcaaggtcttcacgaatcttcacgtatcttcgagaaatcccacgattgacgaaaatccggtaaccgcaactatacgcaaacaatcgaaaacctaaacaaaagaccaaaagaaagatctatttagactaattaatagtgccattgaatagatctcaattttatggatttactggaagttgaacgaaatcaatcggatgagcggttgggaagatatggattttctaaggattatttgattttctgtctaaaggaaaaggaattattaattcccttggaaaagaaaaggaaggagggatcggatttagacttcctcgggcggcttaggcgcggcccgagggattcacaaggcttggccggccattgggccgagcgcggccatggggaggcggcccattagggcgcgcggggagagagggagggcggttcgggtggacgcggtccaccacgcgggtccctggtggggctcgcatgtcggcgacacggttcacgaagaggtgggcgcacgcaagggcggcgctggggttcgggagggggagcggtgcacggcgcggtgctcggaggactaggaggcgacgggcccacgcgcagcctcacggctcgcggtggaccgcgcgcgcgagcgggggacggagggagcagctgaccgggacaagcccatgtggcgccgaggtggcggccacgctggcgagcgagaggaggaagacggcctgcggcggggattaacggcggacggcggcgcgcgtcgacggagcggcgcgaggcgcgaagggagaaagggagaccaccggaggggaggaaaggaggcatggattccattcctcggctcagatgcggccggggctggacggaggcgacggattgcggcggcgcacgccggcggggagaagaaggggaaatcgcgccgggagggaatggggtcaattcgcggcgtcgggagcatctccgggaccaagggaactcgccatggtggtcggatggagcagagcagcgccgtggaggtccggcgacgagaggcggcctccgggagcggctgtcgacggcggcgagctcacagcgagcagcggcgacgcttgggcggtgactaggcacgttcgggaaggtctaggctagcaatcgcgcaagttaggagggagaggaagagcggggagggagaacggggctaccgcgtcgggaggtcgccgggaagagcgtccgacggcacagaagggattgcctcggcctcgggccggggaaggggagggagagagggcgaccggagtcctcttcggctccgcgcgcaagccagcttcccggcacacgcgacggcggaggaaggcgaggatggcggcagcaaggcggcgatggtggtttggcagcaacaatggcgctgcagcggtggagagtgaagcgggagggattgagaggaggggctcggctgtgggctttataggcgcggatggggctttgaagggaaggaaccgacattggggcggtcaaggggacgaggcagtcgcgggctcgcggttcctcggtgctaggcgccattggcggagcagggtgccggtctgggaagagaaaaaggaaaaggggagggaggaaagaggctcggtcccttgccattttggtgtgtgagagagagaggagggtggcactgcctctctgctttggaagttagcggtggagccatggatgacggcaaaaggcgagcgcccgggcggtcggccacgacgcgggagcgcgcgcgtggacgcaagggcgcggcgggaattcgaaaggcagcggcgggatttcaaaggcggtggcgaaaatcgattcgcggcgacggcgcatagcgtggcgagaggagagagagaaaggaaacagagagagcgtaggcatcgagacagagagagagaggaagagagacgacgctctcgctctgggcacgtgcgacgcacgcgagaaggggagcggcagaggggagatgggccaaggggaaggaaactggtccatccaaaacagagggaggcaaaatagacttcttcttagaatttgaattggagagaattggagcttggatttgaatctaaatttgaaacttgtacacaagggttcaaggagacgaggaaggaaacaaagcgggtgtttgatactttcgggaatgggaacaattatttggagaggattcaaaggaagggattgactttcggaatttgatttcggagactcgaatcggaattggaatcttgaggtggacgattttgatggcgacgagaaggacaaggagattaaattgagatccacggcacgacttagactcgcacacaaagaacgaaaaatttcgcatataagattttgccgaattagtttttttaacgcctcacgaaaagcggagcattacatattcgatagttatatttgaaacagcatctgaactctagaaattattatatttttgaggcagatacaatatatatctctttaagatgaccacttaacataaccagttataaatgcttcatttcttctgccactttaggcttgtttggtagagattcaacttctaaatttaactttaagagatgtatctagagtgaagttgtggagcagtctgaaaccacgctccatgtctttattttgtgagagtactccaacccactctaattccttttttggtggaacattggagctgaaaccgttgtttgtgctctagctgcaaaagaggtagagctagagttccgctaaaaggctctttatctgacttgttcagctatctgaaaagcatgtttgatttggcttaataatacgctttattttttttcgagagaatgcttcatttgttacgctaatatcacgtgaagataaaagtgccttcagcacttcagcttgcttgcgatccgtcttacaaatgtgagtaaactttcagtaaaaaattagtgaatttaccactggtctttaaatacgtgagcataatgttcgcatgatgttcatgagcatatttcctgtaattggtaaaaaagaagtcatccaaagcacacactggactactcgagtgtactagtaacacccgaaaatagcaggtaaagcacatccacaaaatccatctcactctgtccaaattttcacttccagcacacacgccgcacacgcgtacacccaagttgcctcgatgctaagcaagacgagtccggtgagccggtgaggtgaggcagccaaagtagtagtagcggccaagtccacaccgagacatcacacaaacatccccgtcgcgtggactcgcgaaccccaattcccctctcccctcccacccaacctcgccgtcgccgtcgccgtcgccgccgtctccgccgctcgatttctccccgccccccacgcagtccagagcggatcgaatgcgtggccctcgccgcccgtagcctaccccggcccggaacggcgagcgcagccagtccctcctcgccgcatccggatctccgcatgcgccacgtccgcggcgggatctagcggcgtcgcaccccccggaggttgtagaagggtttccgggatttgggggcgccggggggtatggcgactgaggcgtccacttcggcggccgccggtgccgggggcgggagctgggtggaggggatgtcggccgacaacatcaaggggctggtgctagcgctctcctccagcttcttcatcggcgccagcttcatcgtcaagaagaaggggctcaagaaggccggcgcctccggcgtccgcgcaggtgacctaatctcgtcctaacatcaccattttactcggtgccggacctgtgtgtagtttatgctcctttttttggttttctgatccgaaccacaatgtttggtcttcttttatacttctatacatgcgatctctccggggaagtactgcggatctgtattagggttaggagagtggtgagcctatgggtacaccatgatgaggcattttaggcatagcgagagtggattggatactaaattgattggcaacggcatggaattagatggtgaggagttggcatatgttggcgcaataatgatgcattactatttcttactcttgagtttatgcttcatgttctataattgaattgtagtttataataattgtccgaacatttgagcgtgtaaaatttttagatgacctagtccagctaagagtgggaatggcctaaattttcctgataagattgggaagaaaccataactctattgtttgaactttttaaggggttattgttggcttggctgcaagatgcataccttgttagtttggatgtacaatatagttataaacatatttgccttgttagtttgggtgtacaatatagttataacatatgtgccttgttagtttggatgggcaatagttctttttcgctgactatgtttacattggttgggttgcaggcgttggaggttactcctacttgtatgaaccattgtggtgggctggaatgattacaagtaagtcaaaatttctaaatataagtaattattcatgctaatacttatcagtgtgatattgacagtattcagtgctgttttccagtgattgttggagaagtagctaactttgcagcatatgcctttgctcctgctatcttagtaaccccacttggtgcgctaagcatcatcatcaggtaacagctagcacctacacttccctaatcttgagatctcctgctgtttatattttcatcagtctgttcattcttcatcttagcatatttcttctacagtgctgttcttgcagatattatgttgaaggagaagcttcacatatttggtatacttggttgtgtcctctgtgttgtgggttcaacaaccattgtgcttcatgcgccgcaggagcgtgaaattgattctgtagctgaagtgtgggctcttgctactgaaccaggtactgtgttgctgacaattgaatctcaaaaacattactggccacatttttatctcgtactaaggttttagcttttgccttgcagcctttctattttatgcagtcactgtgcttgctgcgacttttgtgctcatattccgctttatcccccaatatggtcagacacacattatggtgtatattggtgtttgttctcttgtagggtctctctcggtatgtgttccatgtgttaataactcttttcaattgatattcataaaatactgttgagtagttaagctgttctagtatcctctattcataaaattgtgtatattgctgcttttggcaggtcatgagtgtgaaagcacttggaatagccttgaaactgactttttcaggaatgaaccagctaatctatccacagacatggatgttcaccattgttgttgttgcatgtatactaactcagatgaactatctaaacaaggtaaccatgatttctggcctaaaagtgaactatcattatatcataatatgttttcatgtcatccaaggtccaaggaacatgaacgaaattggaacatgaacgaaattgtactggaatataacatgccataatggacactagctagctattaaaattagtatcacaacacctgattctgcctgtttagaactcaggcttgatatacatgcatgactgtacaatgtccatcactttacagttcaatatagcttgttaaatgccctaagcttactctgtttccttttacaggctcttgacacattcaatactgcagttgtttcgcctatatattatacaatgtttacatcactaaccattttggctagtgtgataatgttcaaggtaacatcttttggcttctatgaccttctgcattgatgtatgccaggcatttctttagcttaacttttaaaactgcaagtttggcataaatgaagcaaagcttgttttgactagaattttacattgaggtgcttatatatagctttcagatgctaatgtaatgtgttggttactcggagtattgtcagattatatttttcagcacaaaagtatatccttctctgcattttgtcaacagcaatatgcttttttttatttccatatttgtacataggaattatgataaataagggagataactgagtctcatcagaacaaatcagaaactaggaattgagctttaacaccttcatgtttctcatttattttcccttctttctccaatagtttgagcgtgtgacgtacaattgattcttgaaccgctctttacagtatcacctattgtcctgaacctcatcgccgttctatttgttcaacttttttgtgagatttctatcattagcattgtcgggacaaataccatgctgtaagattttgctgaagcatacactgctgaaatttattaccattctggccatctgcttctgtggccaccccataatacaagggcacatgtttctgtagaaactaagtggcatttcttgctagatgagtacagaaataccgatcctattcactctataccacattttcctagttaatatggagtatgtacttgtgtgcttagtactctgctaaggctgtaaaaaaaactcgagggcacttaacagtctttgcttaaggcttgtgagctactcgagctcagcttgttctgggcttggctcaagcctaaaacgaactgagatcaagcctaaggctcgtgctccgcattgagccaagctctaatgcatgcataaggattatgctcttctcatagcctgtcaatctctcatgctttacctgctctacattgaagttttcaattcctcaatgtcaagcccaaggctagtgcagtaatgctagctatctgcaatgcatcctagttgcatgccagtatgccaccatcatcttattcataccggtggcagccgcctgtctactctccttgctccttctctctatttctccttctgtgagctgctagtgtgaccagggcagcagggtactcccct

SEQ ID NO: 70900 - DNA, 1207 bp, Oryza sativa
ccacaaatttgccgatgaaatgatgtattgggtgtactccctccgtcccaaaatataaacatttttagcatagtgacaaatcaaacatttttaactttgactattaataaaaaaataaaaatgatcaattatgtaaaattgatgttgctagatttattattaaaatactatcataatatgcaacttttttatttaaaacatgttacttttatagatattgttagtcaaaatagtatctcggagacctgatcagagtttaaaaatacttatattttgagacgagggagtaacttcttccaacaagaaaactgaaattaattatggtcgactccgactcgttaaccacatgttttgcacaatgtcacaagccattttggtggaccggatcgacctgactgaatccctaacacccaagcgccaagccaggcagctgagtcaaacatacgcggtcctcactataaccacgtcatcttgttataaaaccatatcaatttgcagagtatttaaattttcaggacccttctctgtgaccaagccacgcagcctcagtttattatgacaaactcccaaggactcgttcccgcccgtaatgtcaacttggattaatatatagtaactgggtgttacgtacgttacgttgcacctatcgcttctctgcaacttgacacaatacaacacctcaccagacacttgttctttacctacgccctcgcgccttccgggaaccgctactagttataaactgacgatttattatacgtgtccacacgtgatggaagcagctctcgtggagcgtataaaaggagggctggtgatcgatcagctcaagtgctcaaaccctctcaagtttcatcatcacccaacacaatcgcaaggggatcctcaacagggccaacccgacgaacgtgagatggcggcagccgtagaggaagccttcccgatcgggttcacgaaggggataccgtcctactggcgaagccgcaagtaccatagcgtggacagcagcgcggcgggccgcggcacgagcaacctggtgcggctcgggggcggaagcggcaacggcagcgacggcggggcgtgggccgtgcggctgggaggcatgttccgcacgcgcgtcaaggcggcggcgcccgcggcgacgacgaccgccgtggcgaaggtacccgcgcgcgtgctggggcgggtacgggacgcgtacgtggacgcc

SEQ ID NO: 70901 - DNA, 16424 bp, Oryza sativa
aaaattacaaaaggggctgtagcatagcggttacagtgctatgtagcacctctagtcctgggtttggctcccaagggagcaaaattttggcttaatcgaagaaaaaaaaataccgtgggatctccctcactttttcctgtaaaaaacattttagaaaattagtgcatacaacaaatgtagagcgaaatttagaaatttacataagaatcttttaaattaaaataatttagagaaaacgactagcgcgatccactaggtgcgttagcggatagctatttatggcccagacctataggcatctgcataactgcattccctcttaagaggttaggaaggtgcacaagaaaagaaataacaaaattacttaggggtgtttaaatccagtggtgtaaaattttggcgtgtcacatcggatatacatacacacatttaaagtattaaagatagactaataacaaaacaaattatatattccgcatgtaaactacgagatgaatttattaagcctaattaatctattattagcagcgccacattgttaaattatggactaattaggtttaaaaaattcctctcgcaatttacacgcaaattatgtaattagtttttttatctatgtttaatactccatacatgtgtccaaacgttcaatgtgatagggtgtaaaatttttttatggaaactattttaccttggggttgcaatgaatttgtcgtaattattttttatctctcttctcgtgcctggatcgcagcacatatgcacggtccaatgcgcattagccaaatatatatttttaaagaaaaagtctctataccccatttatctgaaatacaaagaacatatttatatgcattttatgtactatttatttggttttccttatgcttttttctcgttttgtgtgttatgttttgaaaccattgaattggaggacctagagtccttcatcggtgattcacaaccgttcgttgatggcaagtcacaaaatgcacttccttgatactgtttgtaactttatttgcaaacaattttttattttaagggttaagtctgaaattatagttagctagttactccaacatagtcttttctttaacaaggtaagagtggcttggctttaaaaaagctaaataaaaatgttgcttatttgtttatgcttaaacttcttagcttataaatcagtttatataagcctaaacaaagaggtgttattataatatgaaatggagggagtactatttaggagaacatttgttgaaactcttcaaactttaatgacaaatatttttttcaaatgcttagttgaaaagaggcatgcgtagatttgctttggtgaacactatcagaatattataaacctatatatattagaatttacagatttattttaatgtaaaattgatggtcaaagttttgaaagtttcacttttctaaatatcaattattcattaagagaggaagtatcggtatcttaccgctgctatgctcacctagggcgtatcggccagaatatatttgtgctcggacaatgcagatgagatttgctcgatccaagaaaaaatatctcgttggatgtaacaatgcacatcggaaacgatttagtaccgtgaggtaccagtacttcaacatacattttgctggaccagagcaaatctcggatggagatactgttgcaactgtctgattctttacagtttgtagcatttcaaaatatattctcaaagcgtgtttaccatggattgtgtttatgagctatttttcagaattgttttttaatagggtcaattgtgttattacccctactctcatgtgcaattgtgattgatccctgttttttagggtttgtgattttacccctgtttatttgaaatgaagctatggtttacccctgttatgttaagtcatccaaacggtgttaaatttgtcaaaaatgacatgtatgcccttgcaaaattgccccatgctctactgagaactttgcaattttactcttttttttttacatcaagaacagaagttaataggattcactggatggaaaaaattcaccaaaattattcatcaatacagtcatgcaccgggaaaaaaaatcatcgtgcaaattcctggcaaatagtactacagtactgagaccggaaaaagaaaaaaaaagaaaagaaaaacagaggcctcgctgttgttatttggttcaagggtataatggtccatccacacttttttcagtaatttaatctatttttttactctcttattttagggccaccaaacgtccatccaaagcaagggtaaacggaagcttcgtttcgaaaaagtagaggtaaaatcacaaaccctgaaaaacaagagtaaaattataattgtatatgaaagtaggggtaagaacacaattgcccctttttaatatagaatcattaaaatcttgtgaattttatggaacttgtgggaaaaaaattcagatcatcatccagatacatgatgaaaaagagaaatgtatgaagaagacgatgaaaaaggcgatgaaaaaggcggctagtgtcaccggtacgcacataccttcacaatatatatgctagtctgaaattgtagttgttcttccgtttttcttcgcgaacatcattccgttgattcgagaggtagcgttttgatgcaggcgtgcaatcggtgacgctgtgtggcggcaacaggaacctgctgatggtgatcggtgagggtgtggacaccaacaagctcctgaagaaactcagaaacaatgtaggcgccgctgatatcgtggagacgatgccggcggaggccgaagagttcgaggcagcagcagcagtctccggaagcaagaacttcatgaagatgatgccgcggtggccgaagagctggtcgtttgtgaaacaagaaagcttggtcgatcaacttaacttcccacgccacagtttaggcgtgtgctaaagttgtggcatggctagtcttatggtgaaaatagggttgttctttttaataatgaaaaactagcatggtagcccatacagattacgcggctagcattattatattttctcttatataatagcatatatgttttctcattatattattcaaatatattaaaatgacaacataattctaaattttgcaataactttacaaaactactaatgtgtaatattcatattgtattttatatacgtgttagttattaattatttttaatatcaaattttagttaattttctgtaaattgtatttctatatagactctatgctcttgtttcaatattatttatttttatttctgaatttttattatttctaattatatttctatgtggactctaaactcatctttcaatattctttaatttttaatttcgaatttcagttacttctaaattgtgttccttcatcgactttaaactcttcttcccatgtttttcttaattttgaattttagttatttgtaaattgtatttttatacggactctaaactctactttttaattttattatatttattccaaattttagttagttttaaattcctatatggactctatactctacttctaatattccttatttttaattccaaatttctattttttttcttaattgcatttctatatggtctatatactctacttctaatattccttattttaattccaaatttcagtcatttcctaattgtatttttatatggactctatactctacttctaatatttattattttaatttcaaattgctgttattttctaattgtatatctatatggactctatactctacttctaatattccttatttaattccgaatttcagttatttcctaattgtatttatatatggactctatactctacttctaatattccttatttttaattccaaatttcagttattttctaattgtatttctatatggattctactctcctcttctaatattccttattttttaattccgaatttcaactatttctaaattgtatatctatatggactctagtctcctcttctaatatttcttattttttaattccgaatttcagctatttttaaattgtatttctatatggactctgttttttctttttctctgattaatgtgagaatttttaggccatgagagcaaatgtggaggcttttttttctattcctttaataatataatagatagcattgtttggttgttagtaactttgtgttgtggcaaattgaactaggcggatgtctggattattgccactgaacttgccacaagctttagcaattgtggcgaatttttgtgttttgtagacaaactttgaatattgttaccctaatataacaaaagaggagagatcatctaaacccaacatgtattgcgaaaatactatgcaatagtgtcaatttgtaaaataatatattagcgatacaaataacgtaaaaccaaaaaaaagatgtaatactccttccgtattttaatgcacgacgctgttgatttttttatcaatatttgaccatttattttatttaaattttttttgcaaatataaaaatatctatgtcatgcttaaagaatatttgataataaatcaaatcatattaaaataaatgataattatatatatatttttaaataagatgaatagtaaaacgacgtcgtataataaaatacggagcgagtaatacatatgtatcctcaggacgagcgagcttagctcgtcgacagcggccgccctcaccccattgccggcttgccgcatctcctctccagtcgcacagccacccactccctgaatccggcgctgcctgcgctatatatatctccattcgtccagtggcttaattaactgctccggctgttacatctaccccgagtgtgagcctcccgcttccgtgctccgctcctctccactccgtcagctcagctcatccgtctgcccgacgtacggtgacgcccacctctgctaggctagggagcgacagcacgtaggaagaatcgacaagtcgaaggcgcggtacgtgttcttttctgccgagtagagctgctatgtcatgttggagttcaaattatatcttattactttagcctgtaaaacaatcaccttctctaattgcaaaatattaatcgatccactgacatgtttttaaagccattgaaattgattgctctggtcttcttcttttcttctcttcttcctcttttgcttcttcttttgcttctttcttcttcttgcgtgagatacctcacgaacccttagtagcgtcaaaattgatcggacgattagtttagggttttagggttagagagaattcgggttaaccttttgcttcttcttcctttttcttttatagtgacactcgtggttcgggggtttgtcttcaattaaaattcaaatatgttttgtacgataaaaaaatattttttatctcttagtttatttcttgttaggaaagaaaaaaaggtaggattttcccttctctaattttatcggcactaataaaccgataaatcaacctaacatgtcaacgccacgtctcttctcaactgagctgcgcgttctcaccacatcacatcattatattaggtaattgagggaaaatgaaatagatacattagttttctattcatgacccatacagtagcagaaaccattagaaggatatgataatagagctaaaatgtctcatagatgaacgatacgagtatatctgtgacgacaactcgagcctgatcttgcctaccagccccttctatgttcttcagcgcgtattgaaatttcctgctgcttcattcgcatgtactctatttgtgtgttttagccttagttattttttggccatgataattcggactggcattgttggaccacatagtgaatccgtacatacttggattggcctgagaaataaatatagttagttaatgagggtaggtattgttggtagtcttaagatcacagataagtacttaaccacaccgttatagcacttccccttagagtattctaagggtatcgaacacgaggaacgatctataatcagcattcaatccaaggacaacagtctagaataaattggctagagaggattactatgtcttttaattagttaattaagttaacagtaaaagaaaaaaaagtacgaattacccccatggagtattgaatgagtatgaattacaccctaaacctgaaaactagtcatttttcactctcaactatcgataccggatgaaaaagccctcgagcagctttgcaagcggttttggtctacgtgacagtccagttaacaattcttttcattttaaatcagtgggccccacatgtcagtctctcacactcttttaccctcacctctctatttctctccaaaatcctctctcttctccctcccttacctcgaggatgacaacgagcagagctcggggcgatgaagggggcagtagaactcgggacgatggcaggcggagtgggcggcggcgaagagggggcccacagccaccagcgcttgggacggcggtgagggcgaagtgggaggcggcgaagagggctcccgcagccacggcgctcaggacggtggtgagggcggagtgggcggcggcgaagagggcgctcacagccaccggcgctcaggacggcaatgagggcggagtgggcggcgacgaagagggctcccgcaaccactgttgcttgggacggcgttgagggctgagtggacggcggcgaagagggcgttgcaatcaccagcgctcgggacggcgattagggcggagtgggtggcggcaaagaggaggttcgttgccaccgacgctcgggacggcggtgagcggaacttagggacaagggggcagcggagctcgggggcagcggagagaacggcggaggatggagctcggggcggcgggaggagggggcggtggagctcggagcggcgggaggagggggcgacggagtacggaactccgagcggcggagggagcacccgtagccggcagcgcgtggcttgtcaaggcaacagaggggccacccacaaccagtgacgctcagggaagtggaggggggcggcggagcgagccgcgaggacagctgcggaggaggcacccgctgccgctgacgcgcgagccgcagcctccggcatctaacgagagagagagggggtgagagggaaagtgatagatagaagagatatctgataggtgggccctatcttttttaataaaaaaacttgctgactggcctgccacatagaccaaaaccgcttgcaaagttgcttggggtttttttatctggtatcggtagttgagggtggaaaattactagttttcgggtttacggggttaattcgtactcacccaatagtccggggggtaattcgtactttttccaaggtaaaactccatcgaatgcttcgggaaccgaccctcctctggtctgccaggctgagtccggccattgtcacaccctgaagttctccccctaagcctaaaattgaatttataaatcaccctaagaaaatgccggtgcaaatcaagagaaaaccctaagaaagtaatacaaataataatcgaatctgacatgtggaatttttcttgagttctacatgtcgaaattcactaacaggatttttagtggaattttcagagccctagaaataattttaaccaattaaaattgagcataagcaatatttaaatccctggaaattcctttcttcctttttcttttttctttttccttttcccttagtgggccgccggcccacttcccctcctctctccccgtgccttgctgggccggccggaggccacgccccagctcagcccgcgccccctcctctctcccggggtcaccgacaggtggggcccacctgtcggacccgtctcccacctcgcgccgcgctgccgcgcccgtaaccgccgccgcgcccacgcctccacctcctctgtcacgcccggaaattcactagtaatttccgaacttatttgtgcataaaatcctcgtctaggaatcaaccgaggtacacaaactgacaatttaatatacagattcatcaaactaactaaaacgataaatacttacttaagaggcacttagtcctcaccatgaagaaaactgcagcggaaaataaaatctagcgaagctccggctccactcccacaggcagctcaactggggtataagccaaacgtcttccccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgaacagatctaactccaaatcaggagctaagcaaattattacccggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcaccccctcataaaacaaggcatggactccccagcgacccccgtgggcttatctccgccacttctcagtctggtgctccgaaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtaagtcataagttatcccaatagtgtgccaatgtttctaagcatggctaagcaattatatctagtatctagttgaaccaatatatataaagctcaactagtccaattataatcacccaaggtatcaaggaataaagtaatcaagatcaaaagggccataacaaagaataggttaattccacccaatgacattcgaaaataaatgcacagttgaaataaatagagaatttaaatataggatcaacatgctcaaaggattgtgtttaggatctgtgtgacttaccttgcaataatcggtcttcaattaatcttctcgaatacttccggcgcactcgcgaaccttcgcaacgacggaaacgacaagctatcacgcaaaacgaggaaaaagactaataaaaaccaaataaacaatacatataaagtaaacaaacatgtaggtcatgattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataatttttcaacttgaaccacattaaactgagttcaaatgaattagttatgaatttttaaagattaaatcggattaaaacacttatatggatttttattgaattatgacgcaataatgaattatttttgaaaaggaaaagaaagattattgcgtcagcggctagggtttgcggtggaccgagcgcacggcaacggttcacgggtacggacggccgagatcgatcctatccaaaacagacggccgagatcaaccggtccacgaccggctcacgggagagggcgacgatgacgtcaccaccggcggcggcggctcggcggctcgggcttgcatgctcgccggcgaacgacggcacggcggcgcgaacggaaggcaccaacgggtagagcgcaacgcggcgaactcaccggtgaccaaaacggcggcggaaaagcaacggacggcgccggcgacgaggaagaagcggcggcggagatcgggtcgacggcggcgacggtgctccggcggtcttcggcgggggcgaaacagtggacggggacggcggcgacttggcgatcccgacggtggccttcccgagtgacgacgacgaccgtagcgacggcggcgcacggcagaacgaacggcggcgacggcggcgcaaaagctcacgaggctagggcgctacacacgacggcgggcgaaggcgagagaggcggcgggtagcggagacaccgggggtgcttttaaaggggcaaggaggcggcggcggaggcccacggcgaccggcggcgggatggaaaggttgggaaaaacgaatccgaattaaactcgaatccgcctatttccaaagggaattgatcggagtttctataagagaaaaggaagaggagatcgaggagattatttcccctcaatcgatttcaccggagaaggaaagacgcggccaaattggaaagcggcggcggcgcggctcggctagggtttcgggcggcggcggccgaaggaggaagacggctccgacaggtggggcccacctgtcagcgacagagagaagagagcggcggctcggcggactgggccggactgggccgagggagagagaaagagaggttttgggccggctttcggcccaaagccaaaagagacttttaaaaacctttttcaatttaaattattcatgaaatgcaattccatttattaacaatacttccttagctcaaataagtcccagaaaaatctaggaattatagaattaagcaaagtatttaacaaaattttatctagcccaattttatattgagatttaacaaattaaaattatatcttttcttttaggcttttaaaatcatttctaataattccttttaaacaacaatttataatttacggatttttaaacaagaaaagctcctaacaattataattagatcattaatgatcaaataattactgaactgttctttgtatcatttaggaattgagctgtgaaaaatccgagaaaatttcagagagttgacttaatcatggagaatttaataaaaattaaatccatccatgctttatatttaggaaattttatttcccacatttaacttcacttgtaaattaaagaacatttaatataaattctattaataatttattaaataatttataaatcctaaaacgaaaatcaggatgtgacatcctctgggccacgttggccacgcccgcgcgtgcgccgcgtctcccacgcccacttccccctcgctgccgctcgcccgcgctcccgagacggtcgggattcgattttcgaatcccgcctctctctctcctctcccactcccccacattggccggcggaatctcgcccctaccggccacgtccgagactcccctcccctatttaagctctgccgtcgtcctctctctctttttccccatttcgccgaactcccttgtgctccccatcgctcccgcgccgtgcacccactcgccgccgcctttcccgccgctccggccgccgctagtcgccgctaggctcgccgccgcaccgcgccgttgccgccgtcgggttcgcaaggatgaactccaccccgtccgcctttcctccgtcaggattcgtcgccggaattcgcatcccctcgcgctacggtgagttctacctctaccgccgccttcggccatggatgccggccgccgtggttcatcttcctctctctaatctctctctcctccttccttagggcaccccgaagcccgtccgctggttgtcgtcgtcctcccgtggcttgccgtcgccgttcgccatcgtcttcctccgcgccggccaccctcggtgaggcgtcctctcccctctactcccctccctctccttcctagccaccgcttagcgccgccgccttcacgtcgcctttgcgccgccgcctccgccgccggttgccgtcgccggcaacgcgtgcgcgcgcgccgtcgccatcgtcgtggccggtcggccggccttgagccgagccaagccgggtcgccgccgcccgtccgatcaaccccgggggtgatctgggccgttggtcccgtggaccggcggtggaccacccgcgtggtcccggtccacggtggaccgcccccccttgagccgctgccgtgtggggcctgtgtgccggcgccccttttccctctctcccgagccgctgactagtgggccccgcatgtcggcgccgcgccccccttgatgacgtcagccctgggatttattgctcaataaatgatttaaggactttttgttatagtaataaacacagtgaatcttctaaaattcataactaattcatccgagctccgtttaagcccattcaagtctcagtaaatcaagaaaaatgtgtagaatccattaaaaatggttttgttccatgtttcagtagtcttatagcctatttgcaatgtttgccttgtatgtcgctagattccggttcttccgacgctccggtgtacttcgaaatagtcgccgaggttcctccagcagcagagcaaggcaagtcatggctgtcacttgaacatgttgatcctatattgcaaatgctctattgtttttcttcaaatattgcattgttttataatgttactatggggtgtttacctattggttacagccatgccattttgatatcatgctcctttgttagcttgggttataacatgaatagattttggactaggaattgcttagccatgcttagttccactagcacacaatggggaaagctcactaaaatatagcctttaggttcaattggtaaggttggtttagtaccaccgttttggtgttggttaattaaaatgaatcacatggtgggctgtgggtgcatggttttgctagtcgcacccatggcagttaaggatcggttcgcgtgatgccctggaagaacttatcgtacttaccacaagctagcgtgggcaacggctgggcttgtagtgtagcttttctctagctgacgcatccaggcaagggttgggcctgttgcaacgtgggatagcgttggacagcggatgatcaatattaattaattattgcaactgtttaattctttcaacttctgtttataaatgctcgcttcatgcaaatgaaccactctagctctcctttgataattccctgcatcatacccctattccagtatgacttgctgagtacagtgggtagtactcagtcttgctctatttttcccaaccccagagtgcgagtatgtgtccgatggcgggttctccgaggagtaggcttcgtccgtgctgtcgagggtgcctgtggagtggtgttcccgctgcagttcaagtccaggcttagccccagttatcttttgtttttccgctgcatttgtgtaagacttttatgatgtttgtaagacgtggatctgaatgtcaacattgtcgtttgtgtaccccggccggtcctggacgatgattttaatgcacattctgcttggaattctattcgggaatttttgggcgtgacagccatgagccctacgatgtacccgaacatggaggaatacgaaggacggacatggctgtcaccacctgtcgtctacctcacttttttggagcacagaacaaaccaagataatttttaacctagacacaacacctaagttattaattactagctactctagccttgcacaagaacttctttctttatctagagtcctaatactagggcactcatttgcacactaagcaaaaatctgtactgatgagaatatctcacttaaataaactaaacataaaggaactcaaacacttactttgataaaggaagcatccgccgaggtacaaagcgagagaagaaggccgacaattccggctttttctccagaactccattggaagaatgcagacactccgattgtaacaccctgaaaattcgaccgacaaaatcaaaactctaaaaatgcggattttcaaaaactttttaaattaattgcatcatgccgatcttattcgtctattttatctggatttgatctcgaagattattaatcatgagtaaagaatagttaattaggaataaaccttaaaaacaaattggtaaaataaatacaaattaaaataaagattaggtgtggatagaaataaataaaatattatcgcgaccatatttggatcaattaaatttaaatatgacggaataagaattaaccctaattaaaactcaaataaattatataaaaataaaatatgggtaatattaatctagggtgaattcattagttaagataacacaaatattgagtaaaatgcatatatgcaaaattaggaattgtggaatcaaatttatatggaaaatacactaaaatcgggataaataggaaaagtcactattcatcggccgccaggtgttcgacgtggtcccctaacccagctcctccttttcccccctctctctgtcgccaccgtcaccacgcgccgccgcctcgcgcccccagccgccgcgcgccgtcgccatcgtcgcctgccgccgcgccgccgtcaccactgccgcgccgtcgccgtcgccatcccgtcgccgcgtgcgcgttccatcgccgcctcgagccgtgccgctgccgcgccgcgcgccgtcccgtcgcctcgcgccgcgcgcccgctgcctcgcgccccgcgccgctgccacgtgccgcgccgccttgtgccccgagccgcgccgcgccgtcgtcatctccgcccgcgcgccgcgcgccgtcacatcgccgccgtcgcctcacccccctccaccgcccttcccttctcttccctctcccccttatcctctctttcccctataaaagcccaacattctcccctctccccactccatcccctcctcctctcccttttccctccccttctccacgcgtcgccgtcgtcgtgccgccgcgccgccgtcttcgagccgccgcgccgccgccacgaagccgccgtgtgtgccgcgccgtgcgccgtcgtcgtcgccgccgccgtcggtgagccgctaccttccccccctgtttgtcgctgtgccgccgggtagagagagagccgagagagagggaggaagggagaagccgagggagagaaagaaggaaggaggagagaaactgggagggagagagagaaggaaaaagaaaagaaaagggagagagagaaggaaaaagaaaataaaggagagagagaaagaaaaaaaaaagaaaagaaaaagaaaggaaggaaaaagaaaaagaagggaagaaaaagaaaagggaaataaataggaaattagagggagattagggaagtttagaaaatttaaaataattagaatttagttatagattagttatagtcgtagaattgtgaaatttaatataaattatggattattcttggtaatttctacaagaaatcaattcgcggtagtagtttaaatgtaattaagaactaaacgattagatgaattcttatagactgttatagattattttgggtaatctctataagtaattgattcacggtagaaattcagacttaatcactaggaattttagacgtatattatatttagtcgtttagtcctagactaaaattaaatcgtataatattataagataatttttggattccgtccgatatttagcttgcgatagaaatttccaacctattatatggatataacgatcgggtagattaaattaaaaacttatgataacaaaatatttatacccacaaaatagtttaggatatataaatcgaaattgggtttgccctagtacgcgaatagtaaagttaatataaaagaatcgaccttgagcccgagggagttgcagatccaagtgaaggccaagacccccaagaccttgagcaaggcaagtcatcactattccttgaacatgttgatcctaattgcgaaattattttgtttataaataaaattgcatgcaatgatgaacatcctacttgtgattatgccatgccttgattattgtttatccgttattccttcgtaaccatgtttacgtatgagtccctagtcaattatgacaattgcttagaaatgctattctaggatcatgcatactcatatttatcaaatgctaaatgcttgggcaattacctttgggaaggtaattgagatgcggcatgtggagacatgagcgccacattgccatgaaattgataacatgatttgtgaaaggaaaataaagcgaaaacaactgttttcgactggggcggacggatgatttgggtggtatctgggaaaggctagtaccgtccccggtcaattaaggaccgagccatgaagttaagcatgaaacgacccccgtacaacc

SEQ ID NO: 70902 - DNA, 1196 bp, Oryza sativa
aaaattggcacagctgagcgaaacacgatgaaagtgtccacattggcatggagtagaagttcactgttttgtgaagatggagatgtagaacatcaccgcagcaggcaagaacttccacatggtcctcaaattaaggccatcatgctcaataagctttagttgtccacataagagaactccaacaacactagtgaagtactgtaaagctgtcaatgctccagggtatggaaatttcatgactgcccatttgttgataatggagagcagggatgctgacaggcaataaccagcagccacaccatagactgaagcttgttgcagaagaatgttcaacgtgttactccatgctccagttttctggacagcacttgaatcatcagctgatgcagcttcttttgagggctctgatagattagacatctggcaatgtaaagaaaaaaattcaataaaaagttacctcacaaaaaccatactgaagctgccaaaaaacaaatggaacaaaccaaaatacttagaaactttaatcgatcttggtgtttgtaacatggtgaaatatttggcattgctggaacctatttgatctttagcccttatcttgctcttagagttaatagcaatgtgacaatataccatggtactggacaaagcagaggaacacttaaaaaatgtttactaacaataattatctaatttcttgatagaccccatgcacctgattccacccatggattttcacatcccaatcaaagcttcatactacaccatactcatcattttagctccactcacacagttatatagacttggcttattaaaaagatctctactttggactagaaatagtacaaaaattgttagcagaaagctaaaatgtacatcaacataatagtgctctgaacaccagctaaatatagctgtagacatatccaatactgagtgatcaatatgcttttttttatttccatatttgtacataggaattatgataaataagggagataattgagtctcatcagaacaaatcagaaactaggaattgagctttaacaccttcatgtttctcatttattttcccttctttctccaatagtttgagcgtgtgacgaacaattgattcttgaaccgctctttacagtatcacctattgtcttgaacctcatcgccgttctatttgttcaacttttttgtagatttct

SEQ ID NO: 70903 - DNA, 5597 bp, Oryza sativa
ataaaattaatcagaagcgggagatgaagcttcggaggatccctatgcctactaccaggagggagatgaagacgatgacgctcagtaggtcttagtacggtcgttgcctgtggcaatggcatgccgctgcctgaattccgctgccttatctatttctgcttttggatgtattccggaccgctcggtccgatgatttaagacaatgcctacgggcttatgatgtaataattagcactagactctcgtgtatgtgcttttggtatttcagctatgaactcgtgtgtaccagactacttgatccagggaaatggtattgtttacacgaatgattcctgttataaaaacaggggtccacagagctggcatcagagccatacgactgtaggaaaagaccaaaaggcgccccaccccttttctaatttggccaagggagaaattcccatttagtaatactttcaaaaataaaaacgctatgtttacaaaactcggtacgattttcatcttactcttaactattttctttacaaaacaagttttactctcaactgactttgggtttttcttaaaattagatggcagatccggattcacccgctacctgggagttgagcttacctcaatcagaggggtatgtcattgagctgcatcggatgttgaggcgtctgcgatactctgggttcccgtcataccgagtgagacagtgtggctcagtttgggaggctcgggtcgaggttcacccctgagtcccttccgagttggactacagctttcagacacgtcaccaccgagacctgccagagaccgcgatgcaggatgcagcccgggaggccttcctccgactcagctctatccaccgagctgagttagcgagtaccgagtttgctcatcacccgttccgggaggagagcaactcagtttgcacagttcaggacacgccctgctgctacaacccgatggtgactcggttgtcacgatgggctgaggcagtaggtgactactacgaggaggctctgttggagattgacgaccaccagagacgtatgggagagctggagactgagttgactgacctctcagtgcagcagcttcagttggaggaggagcaccaggcttggggcagtgagatagactcactgaagacacagctccaggtccacggcgaccagttccagcagttatttgaccagtacaacgatcgccgcgggatgatggatactcttgaggaacagctgagagagagtcaggagcacgtcagccagctggaggagcagcttcgagcagccaagatcagcaccacaggggcttctacttccacagcagtaggccgtgaccgctacttcttcctcacctcgccgtacccaccggcgttccacgctcttctgggagaggctagtatgctagctaccgagtcagcaccttacctagtggtcccgacagcgacaaagccacctgtcccggagatggtgcacactccactgatccctacaccttctccgcagctgggttccagtttggagactccgatccaggttgactccgagacagaggggaccgacaccgagccagagatcgagccagacatcactgatccttcagaggctgagacccctgttccccgcatcaccttcctcggaggccctcgcaccctcagcactgctcgcaagagcacacgacctccgggcaagaggcccaagccagatccagaggccactacttctgagccgtggggactcaggtttgcgcgtgctagcgaccaccctctacctgccccaggatcctgcggatggctggaggactagactgacagactccttgcagcttcgatctcgtatcagatggtttttggatagcatgcgagacacacccccctcttacctagattgacgagtagattgatgattagtttgatgtatcttttggatgaaccttatttggactgcgtatgtatgcagtcgattgcatcatgatttatgtaccatttgtgaaactctgtgatgttatttatgatatctattgttgttgtgttatgacggagcgtggggctcctcaccgggagaccgcgcaggcccccctttgccggttcggtcgggggcgctaagtgaggttcttcgccctcgatctgaggaacgtcagcgagagatgaagcgcacaagacacgggtgacgtagacaggttcgggccgctgagaagcgtaacaccctactcctgtgttctggtggatctgtttgtgaaggaatacagagagctcgagagcgagagagagttcaggctctagaacccattcgccagagtcccaaccccccttcccctaggcctgggcctcctttttatctggtcaggggtcaccacatgggcctctagctgcctaagaaaggaaacatgctttttacaatcagggctagtctacagcaggaagtgacctctgacaagcagagcacacgcctcctgccccgctcgccagcttttccggtggacgcccatttcaaccttcattcaatggccagcgacttccttgccatgcttgcgctgaagcctggaatggatttgaccgggactgacataccaactccaggagttagcacgccggctccggctagggacgagagccaggaagctctcatcattccgacgggacggggcgaggcgtgtgacaggccgcctgttgccacctaacccgagatctgaccggtctgtgaccggtcacacaccacgaccggtcacagaccggataagcgtgcgctgcgccgcattaaatgcggtgtggcgcgctcgtccaacccgctataaatgcggttaggtgagtcccgctgtgctcacctaacccacacacgtggcgccaaaaccacagggggtcggggcgccccagcccccggggccgaaacgggggcgcccgagccctcggggccgaaacgggagcggcccgacccctcggggagacagagggaggggtggccacgtcaccctcgggcccgaccccccccgagggggtcaggccacgtgggcgaccgcggctacccaatcctctagtcacgatacccccggccccatgtcaccgacagtaacccccggcgttacgccagggcgatcgcccccctcgagggaagcgctcgggcgtgacgccactccttaggcctggtgacaggtggggccggtccctacaggcgggcagaaacccagcggtcgcaaatcgcgcgcattggcaagggaaaaccgaccgacaataatgagcggcctctttaagaccgctacatcactcgagcagcgcgcgaatcgggacgagccggttcgtttcgcctggagacatgatgatggcgcttttcgcggttggcgagcgtagttaatgcgcgcacaatctgccccatctcaaccgccacggccgcacatctgccgcgtgcgccgcaaacgggcgagtggggttagtggaggcgtgggcgcgagaaacgagggggcgaggtagtgggcacgggaagcgaggagccgggcacagcgttggcaagggtgtaaagatgccgaggaagggattcgtttccttcctctcgccactcttccccttgccttcgccatttgtgctctaactcttcgtttcctgtgccctacccttgccgcactcgctcgctctcaagctcctcctccgccggcgtcatggcacggggctccgcaccgctcgacggtagcgtgcttccgccttcccgcatcgtgagcgagaggcaggccgggctgccgcgccgattcatgccggaatctgccaccggccggggctggtcccgccattctctattttcttcttcctctctattttatgatctccagatggcgcacctcacccccaatgcgataatgacgttggccatcttcgcgcacctgtgcgagatgtttataggggtgcgtccatctctccggctgttccggtggttcttcaccgtacagccggtgtcgccgccgacggtagtcggtgactgttacttccagccgcgggggcaggtgctgaactgctacattccctgcgtcctccgcaaaaagtgggacgactggaagagcgattggttctacacccccctcgccgacgaagcgcgcctccgacttccgagctagcccccggcgcaggcctccagctggcgggcggcggtagatctgggagacggctacgacgccgttcttgaccgcctagcgggtctgcgatcccaggggctcacgggggccatggtgttcagcgactaccttcgtctccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggccccccgaggccacgatggcacgggcgggagccgcaggggggaacaatctaccccgggaaggggtcgtgcttctgggccccgcgatgggggcccgggaggcagccgccctgccgacgcccggggaagaggaagcaggagggtacccctcccccatctcctccccgagggggcggggcggtgcgtgccaacagcaggcgcccggagggcgccgtgccgacgccgcagcccaagggggagcgaaagaagaaacggctccgcaagatggggggaccaagccatgccgggggaacctcatctcgccctcgaggtggttgtttagccgacctccccgcaggttcgtccccgcgcccaccgcggccgtattcattctcccatcccccaaggcgagttttcactcacccgtttctttttgtcttctggtttttcttctgcctcagcgagatcccgtcgcgcccctcccgccattccaagtccggccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggccagactccgccgggccggggagcctgtccgagaggcagaggcggcgcgcgcacgccaggcggcctgccaagcccccgacccgactccgccggaggcgacgacgacttccgaggccacccacgacgaggccgcgggcgcgccgctcgggcccgacccctcgggcgacgcttgggacgagccagcttcgggggacgcccccaagtccggcacgtcgatcggcgggccgagccgcgcagcacccacctccgggaagccgaggaggctgcccaggaggccgtccgggttcgcaggctgaggaggccgctcgggaggaggccagactccgccgggccggggagtccgtccgggaggcagaggcggcgtgcgcacgccaggcggcctgccaagtccccgacccgactccgcccgaggcgacgacgacttccgaggccacccacgacgaggccgcgggcgtgccgctcgggcccgacccctcgggcaacgcttggga

SEQ ID NO: 70904 - DNA, 20880 bp, Oryza sativa
agcacggtgctagacaggttaagtgcccagatggaggccctgcaggcggagcgggcggagctcgacgcggcgtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagtgggagactgccctcatcgccaccgccgtgctcgacgaggcgcgggacgacctccgcctccaatacgggagccgggcggcggagctagaggagaagctcgacgccgcccggggagtccttgacgccgccgctgcccgggaacggcgggcggcggagaacgaggcggcgtcccggcagcgcgaagaggcccttgaggctcgcgccacggcgctggaggagcgtgcccgcgccctggacgcgaaggagagagacctggcggaccgcgaggccgctgtcgccacccgggaggcaacactggcggcgcacgaggccgcctgcgccgaagaggagtccgcactccgcctccgcgaggacgagctcaccgagcgggggcgagctctcgaggaggccgaggccgcggcgcagcggctggcggacagcctgttcctccgcgaggcagcgcggggggagcgggcgcgccgcaatctggaaggcgcccgcgccgagagggccgcactggatcagcgggccgcagagcttgaggcgcgggcgaaggagctggacgcgagagcgcacagcggcggggcggccgcgggcgacggcgacctagccgcctgcctcgcagctgccgaacacaccatcgccgagctgcagggcgcgctggactcgtccgccggggaggtcgaggccctccgcttggcgagcgaggtagggcctggcatgcttcgggatgccgtctcccgtctagaccgcgccgggcggcaggcgggcctctggggcgggcggtacgcgaagtacgccgccaaccaggggggcatcgcccagcgcctctcagagatggccgggaccctcaagcggctccccgaggagctcgaggagacgatcaagtcatcctcgagggacctcgcccggggggcggtggagctcgtactggcaagttaccaggccagggaccctgacttctccccgtgggcagcgctggaagagttccctcccggaaccgaggacggcgcgcgcgcgcaggtctgggacgccgttgaccacattgtccacagcttcgagggtacggcccctcggctcgcgttcgcccttgactccgacgaggagggcggtgatgacggtgcggacggcagcgatgacgaggccggtgacccaggcgcgttggagtgagcccccaggcccccgccaatattaataacttttccttcttcttccgaggccttcgggcccccttcttgtatagactgatttattctgcaatcaagtaaagaggaaatttctgcgtcagttctgtttgttgtgtgtatgagacgaggatggtctgtgccgcggtccttctgtgtcttggcttgaacaagggctcgtgcccaggccccagcctcaaacggcgcgggtcggggctagttgtcacgtcctgataaattcatcccgaaataaaaatcattttctaaaaggaataatagaattaattaaaattcgaaaagaaattgacaaacactaaaatacgtaccagaaaaattcgaatgtggcccggagaatttttgttaaattctccttggtctaaaaggagccctcaaattttacttgaattttcagagcaccggaaataattattaagcaacaaagacaattatcaaagtttaataaaaagaaaacctaaaaataaccctctccttccctttggaccaagtctggcccaaggttcctctctctctctcggcccgcggccaaagtctccctctcctccctctctttccctcctctcccgggcctctcctccttctcccggcccactctacctctcggcccactccctcctcctccctctccctcccgggccgcctctccctcctctcctcctgggccgcctcggcttcgcccggcccaagccgagccgcgcctccctcccgtgccgtgcacgtgtgcgtgcgtgcgcgccgttgccgcgcgctgacgacgcgcgcctgaccggtgggtcccacccgcccggtcgtctccttcctcccgcccggcctcctcctctctcctccgtgaaccctagccatttcctccctcaaatccgcttgattcatttggctaattccaaaattgattagggggttttaatccccattgattcctcttcaattccccccaatttcccccttgaatggcgcccccaatcgtcgggaacagacgcgtctttcccggccgccttccatggccgccggctgtgtttcccgtcgtcgttccgccctctcccatgcccggcttgcttccctctgctataaaatggaaccccctccgtgcgttctctcgttttagccccttcccgagctcccccgtggccgcaccacctctccccgccttctccttctctctctccggtgccggccggcctccagccgcctctccctcctcgcccgagcgccgtccggccgtgccgtcgcctcctccagcgtcgcagccgcctcctctcccacggcctgccctccgtttcgcgcggtgaccaccggaggcgcgttcctgccgtcgcccttctctttcctccgcgccggccgcctccagccgcctctcccgcctcgcccgcgcgccgttcggccgtgccgtcgcctccctcggctctgcaacaccgtccccttcaccggtctcaccgtttcctcgccggaaactcgccgtaacggtgcccccgccggcaaccagtggcattggtgccactgtactccctccagccggctactgtccctcatcggtgcggcagccgtcgtcgtcaccatcctccctcgaatcaccgcgccatcctcttccccggccaagccacggcgtcgcccgtatttcgccggaacgccgtcgcccgcgccgcgtctccctcggtctcgtcggcacccactccggcagcccctttcgccgtgccagtgcgccggcggacgtcgccgtctccacctccggcatcgcagcggcaaggtcgccctcggcctcgcctcagcttcgaccgaaccccgccggtgttcgtcgtcgtcgtcatcgttcctcctcgccggctcgtcgtctcgcggcgccgcctccatcgtgggcatcgctgcggcgtgtcccacgccgtcctcacctccgtgcagctgctgccggctgccctcgtcgcctcctcaccggccccagtcgtcgtcgtcgtcgtcctctcgtcgttccaggtcgttgtggcgttcgtccctccgtcgagccgtcctcgtccgtcctcggtgtttcgtcaaggtcgctgcagcccccgtcgtcgtcttcgtcctcggctccgcgtcgtcaagcctcgtgccagccgcgtctcgccttcatccaaggatcgccgccgaagtcgttccctcgccatccgtctccgccgcgcccgttcgtcgttgtcgttccctcgcctcgtcgcgtggtggtaaggatctctcctctcgctgccccgtcctcgtcctttcggtgtcgcccgtgcccgttgtgcggttgttgaccccggtacctgtgtaccggtgtcggtagtcgttcgcttgtgcgggtggtgaccctgttagtgtgccgctcggtggccgcgtggtttcacatgtgcagcccgcgtggtgtctagtggggtccgtttgtcggccactcgcctcggttgacacacggggtccgcttccgtcgacccgtggaccgtctctgtgtactaggtctaccgcagtcctttaggttggcatgtggggtccgcatgtcaacggcgcagccttcctgtcttttccaggctagcgcttccacatgttttatagttgcaaagcttaattataataatccgcaaatctccatgtaaacagcattaaacttcagatgatcatatcttggtcatacgagctccgaatcgatctgttcaagtctcctaatgtttgttataacctaaagaaccctgtgctttctttttatgtattgttattgcttctttataggcttgtagctttgcttgtgtgcttcgcgtagcttctgtcgttccggaggttctcgaagcgtggtttgcggtcgtcgccgaaggttcggaaggccgttctctctgagtaaggcaagtcacatcatccttgaacatattgaatcctagtttataaaattattttgatttaaattattgcattatcgctttatttaaatttccgcgttatcactgttttatctagccatgcctatttacttttgttatgaccttattattgctattgttattattatcttgttcaccctaggaaaataaaaccccaactagtgggtactctattcatggttccactagtatgaatttaggtagatgcttcgctgattaataggacaacattaggtggtttttataactttagactttgggaatattcatatctcttggatactatggaatgggtggcttatggtggaattggacatacccctctcttcctctttcaaagcccctaaaacctgtttttcgatggggtttgggtgcatgccagttgtgggaagtagcaccccgaccaatataaggactaagctcgggcctctgttgcaaagcactatcgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttctggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctggattggcttgggacgagctgggacccagggtcgggttgccagttcggtctgaatcatcgtaggccttgggttaaggcaggttcgtgagggttcatggccttgattaataacactgtgtaactctaggatcgtctttataaaatggctttaggcaactaagtgacttttaaatgctgtttactgcaaaacttaacccctatattattatccccttgtactcccttgcattaattatgcatcttcggtgtggcttgctgagtactatggttgtactcattcttgctcaatctttcccccccttcagtaagagaagctttggagaagaagtcttaggtggagtcctggcttataccccagttgagcgcctgtgaagatggagccgtaggcccgctagtccgctgctgtttattttttattgtcgggctttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacaagctggtatcagagccatctcgactgtaggatgagccaagtggataaaacctaaggacatattttataaataaaactatttgcgaaagttcctttttttttctccttcccctaatgctatttgaaaaaggtttactcccttcttccttcttcagatttcaactagtactagttggtcagctttgtgaagaagcaaatgtcgtcaattgtctgccgaagctccagaaggctgcaggattcgctagcgaagtggaggaagcagtgaagccagctgtgaagccgaagctaagatcttggagaacccgccgcagaacctaagccaccctctagggtagagtcgttagtcgcgtgtttccttgcttgtgtgtgtagcgcgtggtttgcatcagtggggtgtgatgtaaccatgctaggttgtttgcttaatcaacttgcagaataagtaaaacaaacaacacatcaacaagaagagttagttcctttaaggtcctgtctctagttctggtctattctttcctggcttgtttcctctctcacctcaatccctgtcacagatgtttaacagagaaaaaggaaagaatgtcagcgggtatgcctcaagaaactcaagttttcaactcaatccaccactggcctcaagagagttagcaagggcacacccttggtccattccaagcatgctgcttagttcacagctaccattggttggaagtcaagaccaaaatcagtatgtgtttgatcgagcatttgccacccaggtcaatgagcttccaatgccagaagagcatgtccccttttgtcatgattgtagagagcaaggacactatgccctgaattgtccatgggtatatgccaaagaagccccttcctttggtttaacagggcagacatcgctaaaccagcctcctcgcaccaagtcaagcttgcagcctagtgtacaaagtagagagcccaatggagagaatccattgaatcccgggaaatgctttcctcctagcctttcgtaccacgtggggtcacgtactaagcaagccaaaggcaagaagagtaagaatcataagagaaaagcgccgatgcgaactgaagaagaagtacgtaagatgactattaccagcaccgaatggcctccagcagggataactattcctagacgtcaaagaggaaataccttccgaggtgcacgacggttgacccagcacctcctaagccatggtggcagagtgtctgatagtgaagggtcagatcaagtctcctcggatgatgaagatgagtctccccgacatctcggcgaggaagagatggaatcaaaggcatgcacccgttgtggagaaattggacacagtgctagcaggtgtctcacactctgccctcattgtgaagaagaccatccaccaagggagtgtcccacccgcaaggtgacatgttttctgtgcgaaggtacaaaccatgtgcccaaggattgccaactcaatgtgttgttgaccaagaccgcagaaatccaacgaacaaccctacgattgtctcatcagctagtcagctccaacaacaacatcgacgatatcatccacagcaccaatgctcctcctgctgcacctgactctgcaataaatcatagcaataataccttcagcaccaaccattctctgcaccgacagcctcagcaaagaattgtcgtcgatggaagaagttgtgtctctccccgacctactccaggccgagcaaagggcaatcaatctcaggagggcgatagcaagcagaagaccattctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgcaagtttgcagcaatcatgtaataaataaatatatttatgtctataaacagtgagcttgctatgtttatggacgattcatgttgaggatacaatgtaccgatgttaagcaccttccctttttgtttaaggcagtgcctcgtattcatgtaatatgggagaaatgggtaataaaaacaagttctatgaggaatctttcagaagatgctgatatgggattatgtgtataattgtttactgtcaaaggagacctagggtctcatttcagaggaactatgttctaaccttgagttaataaccaacctgatgacggaaaagaaaatcaagtgattaaccaaagagacatttgtttggactaagagtttcagatgtgtctttttcggatcaaaggcaacgacagttagtatagcttttggcgaaacacttcaaggtttcactgaaaggcagcaagccaaaggacctcatcgtcaccagaagcatccacaactctcggagtgaacagtacttggttgacaaagttcaaaaggttattgatagaagataccagcaaaggtgtttattaccgggcaaagaagtaggtcgaaaggtgattgataagagaaatctgaaaagaacacatcaaggttgaatgtgtaaaggaatactttgaatgctaaatgatgacaacatgaagagaatagtggaaagtaaactgaacataaagaaagtgaatccgagttgcttgttcgtgggagctattcccagttatgaaccaagtgatatgttcgaggatagtctacagaggtcagattaaaatcacatctaacaacgaagcttcaaatttggcaggataacgatcagacaataagaagtccagtagtaaagccatttgggaagacgtcaaagcatgtcaagtgggataagttggttctgttgagaaacataattcaaaggcaaagttatcgacccttgcatcaaatagcagaaatagctagcacccggagaccaggaaagctaatatgaggcagttggtggcaagttagaagtaaatgacaagcatgatattcttatgatgacaaacatggtatcctagtaatgacaagctagtgttgacgcatgacatgaagtggtaacttgtatgaggttgactccaagatatgagttataagaagttctggaactgaagccccatcttccaatgtcgcagcccagtcgaagtcagctagaggtgcaaccagggaaaagtcatgtgaagagaagattccatctataacaggagatcgagccaagcagtccagagtggagaagttttgctaggcaagtttgttatagaagacgcgacggaagaagtcagacaagaagagaagaccgcccaacctatcttcttgctagcctcctcgaatctcggggatgagattcttgtaagggggtggatttgtcacgtcctgataaattcatcccgaaataaaaatcattccctaaaaggaataatagaattaattagaattcgaaaagaatttggcaagcactaaaatgcgtacaagaaaaattcgaatgtggcccggagaatttttgttaaattctccttggtctaaaaggagccctcaaattttacttgaattttcagagcaccggaaataattattaagcaacaaaaacaattatcaaagtttaataaaaagaaaatctaaaaataatcctccttttcttttgggccaaatttggcccaaagtcctccctctctctctcccggcccgcggccaaagtctccccctcctccctctctttccctcctctcccgggcctcccctcatcctcccggcccactccctcctccctttccctcccgggctgcctctccctcctctcctcctgggccggccgcccggcccaagccgcgccccccctccaggccgagccgcgcctccttcccgtgccgcgcacatgcgcgcgctgacgacgcacgcctgaccggtgggtcccacccgcccggtcgtctccttcctcccgcccggctcctctctctcccgtgaaatcctagctcgctccctcctccaaatccgcctcattcaaaccggggattccaaaattaagtggggggttttaatccccattgattcctcttcaattcccccttaattcccccttgaatggcacccccaatcgtcgggaacggacgcgtcttctccggccaccttccatggccgccggccgtgtttcccgtcgccgttccgccctctcccgtgcccggctccctcccccatcctataaaacggaatcccctcgctccgttctatcgttttagccccctcccgcgatctcccgtggtccctagccacctccccgccgtcgtcccctctctcccgtgccgccggccgtcttcagccgcccctgccgccgcgttagcacgccggccggccgtgccgttgcctcctccagcgtcgccgccacctcctcttcgccggcctgccctccatttcgcgcggtgaccgccggaggcgcgtccccgccgtcgtccagtggcgttgccgccactgtaccacctccagccgcccctgccgcgccgttcaggtgcgggccggctgcgccgtctcctccttcgtcgtcgccgcgtcgacctccaccccggcctgctctctgattcgtccggagaccgccgtcgccgcgccggcttctccatcctcttcatcgccggcgtcctttcggccgccccttcctcctccccagctcgtcggcttgctgcaccaccaccacccccggcattgcagcggcaaggtcgccctcgccctcgccctcgcccccccttcacccgaacgccgccggtgtccgtcgtcgtcttcaccgttcattctcgccggctcgtcgtctcgcggtgccgcctccgtcgtcggcatcgcagcggcgaggtccgcgccgtcctcgtctccgtgcagccgctgccggctgccctcgtcacctcctcgccggtcccggtcgtcgtcgtcgtcgtcgtcctctcgtcgttcccggtcgttgtggcgttcgtccctccgtcaagccgttcttgtccgtcgtccgcgtccatcaagtgtgccgctgcagccccgtcgtcgtcttcgtcctcgcctccgcgtcgccaagcgttgcgccggccacgtctcgccttcgtccaaggatcgccgccgaagtcgtcccctcgccgttcgtctccgtagttcccggccgcctccgccgtgctcgttgtgcggttgtcggccccggtacccgtgtaccggtgtcggtagtcgttcgcttgtgcgtgtggtgaccgtgttaatgtgcccgctcggtagcagcgtggtttctacgggtgcagcccgtgtggtgtctagtggagtccgtttgttggccactcgcctcggttgacacacgggatctgcttccgtcgacccgtggaccgtctctgtgtactcggtctaccgcggtcctttaggttgacatgtggggtccgcatgtcaacggcgcagccctcctgtcttttccaggctagcgcttacacatgttttataattacaaagcttaattataataatccgcaaatctccatataacagcattaaacttcagatgatcatatcttggtcatacgagctccgaatcgacccgttcaagtctcttaatgtttgttataacctaaagaactgtgtgctttctttttatgtgttgttattacttctttataggcttgtagctttgcttgtgtgcttcgcgtagctttcatcgttccggaggttcccgaagcgtggttcgtggtcgtcgccgaaggttcggaaggccgttctctctgagcaaggcaagtcacatcatccttgagcatattgaatcccagtttataaaattattttaatttaaattaatgcattaccgctttatttaaattcccgcgttatcactgttttatttagccatgcctatttacctttgttaagacattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattgggcacaaacctccccctctattcaaaacccccaaaatggttttaggctgggctcgaggtgcgtggttgggttttgttagtcgtacctcgggtactataaggattaagctcgggcctctattgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttctggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctggattggcttgggacgagctaggacccagggtcgggttgccagttcggtctgaatcatcgtaggccttgggttaaggcaggttcgtgtgggttcatggccttgattaataacactgtgtaactctaggatcgtctttataaaatggctttaggcaactaagtgacttttaaatgctgtttactgcaaaacttaaatgcttgggcaattacctttgggaaggtaattgagatgcggcatgtggagacatgagcgccacattgccatgaaattgataacatgatttgtgaaaggaaaataaagcgaaaacaactgttttcgactggggcggacggatgatttgggtggtatctgggaaaggctagtaccatccccggtcaattaaggaccgagccatgaagttaagcatgaaacgacccccgtacaaccgtacttctcgaatgggtatagacctagcggattagatagccgagcggagacattatccctacatagatggttcacccctgagtgagacaggtgcgctacgatgggacagccgttgaggtagagccgagaggcgtgccctacattggtgtcgccattggtaggactgccatgagtgtgtgagagagagaacttaacttgaaccataatttaatatgtgtgagacttctctttcccgggagcgccagaactcctcacactgctagaaacatggacgcctagagtgcatgaggatttaagttcatggagcggatactgccaatgcgaggttatcgaaaagctttgccgtgacgcgcctcatgtgttgagacgaggctcatgtgttgggcagtcgcggagtgcgagtaaagtgtacatccactgcagtgtgagtgaaccaaatctattcgaatagccgtgctcgcggttattgagcaccgggacatgtattacacttggctagtctctaaattcttaacttgtgtgggatgcgttgttgcatgacgaatttttatgctgttggagccacttcctgagaagggggaaggtgggcgtccttagaaaaccattactcaatggcgggaagctatccttaggatcacaatggatggtggacagaaccgtcgttgtttaaatacaaacactggtactaaaatttgatcagtcaatgctaggttttaggtttgtgaaaagaattacaaaactggcttagcgcaaaagagccatagccatcctttgaaatacctctttcatatgcattgttgctgtggtgacttgctgagtacggttagtactcacccttgcaaatataaaattaatcagaagcgggagatgaagcttcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagacaatgcctacgggcttatgatgtaataattagcactagactctcgtgtatgtgcttttggtatttcagctatgaactcgtgtgtactagactacttgatccagggaaatggtactgtttacacgaatgataatttttggaggaactctgatatttcggagcacttcttccggagcttccgctcactctctaccaagctaacatactaaatattaaactacaagtgagttctctacttgagctcaaagttgtgtgttcttccaagtgagtgaggacctccttttatagtgtgtcaataacgtttgtaggcggctgtaaatgttggtaacaccccttaatcgtcattgagaaccaatggggacttgccacgtgcaaggtgggagccgagggtgccaaggttggttcggccgaaccagggcagcctcccctggccaccgcctttctccagtctctgacaggtgggcccctatggtgattgaggatggtttggtctcatattaagtcggtctcgactgacttctgggccctccaatccttgtactcgcgcatgattggccggaggttcattttcgtcgcatgtcgggtgtattttctccttaaataacctgcatacatatatttaccaaaactagtggaagtgattagtagtaagctcctaccactaaattttgatagtacatttgatatcttttatgcagaacttgacggttaaagtttgccattaacgatcatcaacaacatacccacacttatcctttattggttcctgagtaaagctcatgaatccactagagcaatgacttctacttaatgaaatggcataccaaatatgtcaaaacatacctaagtctatgaaccttgatgtgtctactatgccatcttgagcgattgaagaatgtaatggtcctcgaatcaagttccctttactcctcatgatgaattaccttgggattttctttgatgctcttaaaaacataaattttactatactcctcatttgattcttttgaatcactcaaattgttttatttctcaccaaggcattgatgttgccttttcttatcctacctttctaataaggcttatgtggagcttagggtagggaataagaatgacatacttgcatcagatatattgtaaagtccaatgtaagatccaagaagataactaatcatataaccatgaccaagcttgtgcacctaagtttataagtgaaaatgagatggtgggaaaataaaaaaaaatagaatgatgactcatttttttccatatgatcctcctcgcactttattttagagaacatggcaatactttttttttcatcatgctcgagaacattttgatcattctctttcgagcataatctctttttttttagctcatgtctcatttggcatagatcattggagaagagaccacatatttttggagtctttatttggtggatgcatgacttttggtgtagaagcttagcatatggaaatgaatggaaaaattttggataatcctacagcgtatagaaagagcaatattttttgtggctaaatgcacatgactttgttcatgagaatatgaaaagaatctaacaagaatcacaaccacttggcaaaattcaaaatgatagcaaaccaacatatgtataaggtttcatcattgagatcgatatatggctttggtaggaagggaacatcatgaggagtatgtaaaattatttcattttgtttttataaaatttccaagggttcaacatcaagagcaaggttcatatcatcagactatctctcattaatcaataacttagataacatgtggtcctaagaatatgattcacaagcaacaggtgtgtgcaggaaataaaaggtatgtaagtcattttaccagaaaagtcagaaattctagttgatcatgtcaatacttattttaaatcttgagttaattatactggccattttattctaaaaggtttgtcactgtcacgaccggaaataacccaacgggagttccttacgtgcgtgcattattccttgtcccaggaggcaagatacaccaaagttgatacaattcagagtttaacaagcggaagcgtaattaattaatttattacatgggcggcgaagacccagcacacacaaagacaaacgggaaacagcggaagactagggcgacgaccacaggcgcttgacgacaggcacgagctagacaccaaagccttcatcttccaggaactcctcttctgggtttgggaaaaattgagcaagactgagtacaacaaccgtactcaacaagacacacccacaagtgcagaataaatgtaagggagtacaagggggttataatataagggttagggtttgcagtaaacagcattaaaagacacttagttgctcaaagctattttgtgaacatggtcctagagctatacaatattattaaccaaggccgtaaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctcggcttgcccataaccgagggcgcgcctattcgaatagattatactctgatcagaggtgtacatctttacccacaagacacatcttcctcacgtgtaaccacgtgccacataccaccacggtatacggacggaagacatgacatagtttccaacccatcctagccataaacaagagtaccgacccaaccccacctacggccggaacccccgggaaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacagtagtgctttgcaacagagtcccgaagaccggtccttataaggccgaggtgctactgtcaaaaccatgcaccccgagcccagcccaaaaccattttgagggttttgaatagagggggaggtgtgaatccaattccacaataatccaaccattccatagtgtccaggtgataagagtattcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataacaaggtcataacaaaggtaaataggcatggctagataaaacagtgataacgcgggaatttaaataaagcgataatgcaataatttaaatcaaaataattttataaactggaattcaatatgttcaaggatgatgtgacttgccttgctcgctttcccaaacgtcggcttcaacctccacgaagagcagatcttccgaagctgcagtgtctacatgaccaacagaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcattttaaaatttaatttaaaaagggtttattgcgtcagctgaggggagggggcgcgcggactgggtccacgggagtggggcccacgcggcagcctcacggtccacggtggaccgggtgcacctgggctcacaccggtcggcgccgtgggtcccacgcgtcagctgcacccgagggcgcgggcggctgacggccgggccccacgcggcagccattcggcgcgcccgagggcggccacgccggcgcggtcggcgggaggcggcgcgcccgcgccccgatggtcgccgccggtgacgaccggcgcggcggagcggcgccgagagaggggagggaagggggaaaggaggcgacggtccacggctcaccccggggcgacggcggcgacggagaaggcggccggagcggagggaggcggcggcgcggctcgggtcgacggggtcgacggcgttccggcggtcggcgaccgacacggagaggtggacgaggttggcgaggatgcggcgaacccgaaggaggcggcgccgaggtgggaggtggtccggggcgacgacggcggcggaccggagctcggcagcgacggtggagagagagagcaacgtcgcgagctcgaatctggcgaggaggaagggcggcgagaggcggaaacggacggacgaggtgcggggagggtttaaatagggttggaagggggagagagcggccggaggggaaggaaaccggcgcgggaggtccagccaccatcaatggcgccggcgagatttgcgggggcaaatccacccgtttgaacgcgagagagagagggaaaaatggggggaaagggagaggggatcacggggagtaattccccctactttattgcacgcggggatggcgggaggcggcgggattcgcggcggcggcggcgctagggcgcgggggaggcggcgggagaggcgggatgaaggggatgacgggtgggccccacccgtcagcggcgcgcgcgcggggagaggccggatgggctgcggggagaggagagagagagaggggggaggagagatgggccgggccggcccaagggagggaaaggggactttttagggtttttctttttataaaatcattttaactttgtttatttcttaacaattattatttgtgctctgaaaattccactaaaatttatttacgcattttaagcttttaggaaatatacaaaaatcctctaagccttatttgacttttaactttgcacattttaattgttagaggctttcacacggattttaattattctaggcataatttagaggatatattttagggtcgttttggaacgtgacaggcactgtttcacatttttaccaataatgatattggtttagtgctgtcacattattgcttctaagtctcaatttttatatgtgcaaaattttatccaaaaccattggcttagcgatgtatatggtattttgcattggcggttggtaaatcatttgagcattagtactcagaattttacaccatgtatgccatatatttttcaggtgcggcctaacacgtgccttaaggacttgagcgtatttgtttttggcaatatgcgcgcgcttaagtgcccaatacctttaaaatcctttatttagctgttaaaatattttttaggagatggtacaatgcaatttaaaacgtggcaaacagtgaagctttatacatagctatagtattaactttttattatgagcttttcttaagtgtggtcggcataaagctgcataaaggtaggcgctaccaatgagggatcgccacctgtcagctgagtaaataatggggttaatttattcgaggggtatgacggtcatttggacaccagcgtaaactctaatcgttagtttactcaagtcgtgattccataccgaaggaacgtatgcagtgttagagttggccgaagaggacaaaggaatccccggaaagctaagaggcgagtggaaagttcaattacgttctagtttttatggtttacacagtgttagagtttgccggagaggacaaagtaatccccgaaaagctaagaggcgagtgcaaagaaaaattacgtcctagtttttatggtttacgctctatatcgcgccactactgtagatcgcgtttagagaaagccattgtatcggcacacataaataatggtacaaatgatttgatgtagaagatcctagctaaaaccaagcgattgggttacatccggtttacgttggtctacaaatagaaaatacaaagtacatagccacataagatcgatagcactcctctggtatacgctgagaatgaaaaaaatttatggtgggccaggcccacctaaatttagcaggtaatcctctcaaccatgtacggaatagcgataggagtaaatcccaatgtcagtccattatgaagcccattttggcagaaactgttttatataatagtcctttatattttaactattatgagccaaacacagcatcaattgttagccccttattattatccaaaatattgaaaatgtgatatatatatatatatatatatatataattttgtaaaggtcttgtcctcggggcaccaccgtcctcggattgcggacataaacacatcgattctactcatacgttcgacgtgcctgtttatgtgcgctatcccattgtgtgcgtaaaccatccacgtgctccgtgaacgcctagcgtacagtggtttgcgagttgcgttaaagcattattggcacgggcaggggtgaaccttgtaggcacctagcaatctccgcgtacgcgtagagcatgcacgactcacgaaatagcatatcagccatcacatacgcataaaccgtgttgtaggcggtacgctctatgtacgtgtttacatccgaaatctcgacttaggcgtaatgcacacacctcgatcgggcatagtgctggtgtacgcgcgagacgtgcgtgaaggtttatgtgcacgcgggggatcatatcgcgagttgcctacatatggtccacgcttgcccgtggatcgtggacgtaaactcatccttcgtgcgcgtaaatttacgtcccaagggaaaattaataaaattttgatgtggaatggtacgttgtgcaaattaaaacgcggttaacgaacctttagacctaaggggatttttgacgtgaaccttta

SEQ ID NO: 70905 - DNA, 14170 bp, Oryza sativa
agtggaaagagaccttaggagcagtttaataacattttaagtacaagactcttcatataaatgaactataatgaaaagtgcaaaaacaaaataattgagttcctaatatgtcataaaccatgtcatatacggatatgttgctagcagttgagttggtactaaacattcgatgtaaggaatttaagcaagaagtgtcatgcaactaaactagcagaaagaaacttcataccaagtactacaaaatacatgtatgccatacacaaaggaagaatgatgcatgagctataggataatagttgtactctgatccctcttaacttgaagccacatacaagaaaagcatttcttttttgtgctcctatagtctttctagcatttcaacagttgtaaagttgaactttgaaatcttgaccactatgaataaagatcaaggtagacctaccgtgtgactagaacgcagccactatacgaacagggttgagttcaattttggaataaatataatgtttgtgtttgttaagaagaatgaactagtaaataaatacaggctagcactagatgttcttagatgttcttttcttatgaaataaatacaggctagcactagaagaaaataatataaggttgacaattgtcctatggacaaaataaaggttttgcaaaacttactgtcgtttggcttcaatatccttgttaaaatcaatgtcatgttcgcagtcgaggaccagagcaggaacctgattgagaagaaatttcgttcatttaaccaaacaaaccttactaatttcttttgaaactaaggagaacattaccttctggatactagaatgcatatgatctccttctaagtagaatactcgttctcttatatccggaggcaaagagccctccatatggactggaacttgactgaccgataatacaccaggaccttgtcctttggaaggaagcagccagctctcatgtttctcatgcaaacctcgaaggtaatcaagagtaacaccaccctcttcagatcttttccgaaccatcattcttttgtggcaagtgtcgggactagctcttagataaataaaaccatctggaataagtcctgggagtgatgacaccactgggtcaaaccaggagtcatagatgctgatctccatctcgttcatccagttggcttcatggacagcacgaacaaaaaccttcaaaaatttaactttgaaaattttaactaggagaagaaaataacaatgggaaatataaagactgcaatcgtatcaaagctctagattcacaatccaagcggactttgacggaaagatttacctaccattctatcactgaaaacacttctttccatcaacctgagaggctttatgccacttgaagattccttctcttgcatgacccttgtaacaaacacataattctggaaagtgtatgcatacctctgtggctcagcatagaaagcatcaagtatgttgaagtgatcagggccaacatcttgccatttagcaataggttcaggcactatctctacaaggtcacgtaattcgatggtctcattggcaattctttgaaggaatgtagtttttccgacactgatgttcccttccacacaaaaggtcagcctcttatttttggaaacatttggtgagtcagttcctttcagctcttcatcaacactttctttaatgaacaaagttatactctcagcatgattcttgtgtatgatgccaacagaactttgcaagaactcaaccattttctcattggacttgccaaagaactgcaaaaactcatgaagtgtcagtgtcaggtatgcggaaattaggataaataaagagggaaaaagacatctaatattcgtgcagtaaggtcgccacaatgaaataaatatcacaaatcaggcctggaggagaacccacaattgtactctgttcttttcctgacactaaggtttttcttttcaggatcttagttgtgttacaacaagaaaattaactttcacccaaaacagtttcaacacaaaatttgacatatatgttgaacacgggcatcaatttcaccaattcttctgtcatctctcctagcgagcacaagaatgcaagatctcctatgatgcagaattggacatcagcatggatcaataattcaccaatgaccacgaaacacacagttgcttgcaagcgcaacacaacacctacagtatccttatgtgtcagtcgactcacttacatacaggtatgtgagtgtaggcaaaggcatgcaaagtacttgacttaagtgactacaactaagcatatatatttctcacatgtttaataaacaacaacaaaacagatatagtactactccctccaggttgataatatttattgttttgaacaagaatgatgttatgattttggatatgaatcatttctaaaatatttgtcagaccatatgcacagattagttttaaaaagtactctaatcaaagtatatatttgttgatactatatatattatagtagaaaataaaggttatgattgtttcctagagaccgtgctcttgttgaaaacgataagtattatcgatctgaaggagtacaagctaatatttcacagttcacacacacacacaccttatccctgtacagctgcttgagctgtgccacgccatcgaatcccttgtccacgagcttcctcaggttgcgcggcccgactccaggaatcgcgagcagctcgccgctccccatcgccgcatcgccccgacttctctgcctcctatccaccaccggacggctcccacctcccccggcgacgctctgctcgccatcctcctcggcatcatcatccccgcacctcttcgccgcatcggcggagcaggagagccccctcctcgagcgcagcagccgccacggggagaggcggaggcggaggcggctagggtttggtgggcccgaacgcgcggcgagaagcgggcccgcctgggtggtgagcagcggcggggcgccgaggaaggaggcggcggcgcggggtacgagcctgtgcatcgctgcccgcggcgtcggctgcagggctcatcaatcgcgcctccagcacccccagtaggccgccggccaacgtggctgcggcggcggcggaattgcggctgcggtggttggaggggttcagggttttgctggcgctatcacctcgctgacttcactgaggttgccgcgaaaagtgaggagaaggaaggggaggaaggggaagcggtgcacgagcggtccacgggattttttttttagtaaattacagattggaccatgtattttttgaccgtagtttcacattgaactggttcaacattttcatttaacaccagatctttttacccaaaattacaatttggactagtggcccacctatcaatgacgattgaggatgaaaagagaaaattggagctaccgatagagcaacaggaaaaggacaaatgcactgatccatttctgaccactctcaccagctccgtagtttgcgtttgtggttgtgagtatggtgttagatgctagggccatgctgccggcgacgacggcgacggtgaccgtctctgctatcgatgttggcgacggcgaggaactaggaacgacagcagttgtggcgggccgacggcaactcatcgccaacgatggccgtggtgtcggtggacttgccgatgatgtgggggggacgagagtaggatgaagcgggaggccgggagctaatcgtctaggcaaaggccgtggcatccatggccatcaggggttgatgcaattcaaatgtactgcacctatctaattcctgagccatttctatttgcagagtgagatccatgttttttaaagcagctcgtatagtctgcttgaatcttaatcgatccattgattgatgaatcggcctctgcatgccccctttcttttttcttttctcctgcaaaggactctaatctcgtagtaatgcaggtggagagatgtagagagtcgtaggcgctagtaagtgtgccactagtccaatttgtaactttaggtaaaaagatctggtgttaagtgaaaatgttgaaccatatgtggttcaatgtggaacaatggtaaagatatatgtcccaatatgcaatttactctttttttaagaaaggtccacggaaattgtactctgttctgcgctggtttttcccctatgctcgtgcagcatggaccggaccaatgaggtggagaattttatttatttatatatttttatatattctaaaaagttacaaaatccatttttgtttccaaaaattacatgaatgtagtactcctgtaaatttctgtaatttttaaaaacaaatatatatttctgtaaatttaaaaaataaataaatatataaattcaaaaaattgaggtgcgggacttaggttgtatgggcccatctctcgtatgactcgtgtggtgggctgtggtctagaaacggggatgcgaagggctattgcacctttcggccctaaatcgttaatacggcccatcaggggaaacagcggtccacgaacaaatctacgcaatagcccataaatacccgtgcatgactgcatgtgaactttgttttaaaaaatctccttttttttttaaaaaaaagaggaaaacttacgaacgaacagtcgaacatattgtgcatgacgtgccatttttttgcatgatcgtccaggtaaatcctggtgcaaactggagttactgaatttgacaatctcagaaaaactgagtctcacatgaactgaatattttgactctctcttgtagcagcctcaccgacccaggagtatccgtgttttctttttttactctttttagacagggattcagtggactctgaccgtacgtcgtcggtacgtatttctctgaacgattctggtaaatggcatatctatcagccaatcaggtaaggcaggacaccgtccaaatcagatgacgtattaagaaaacgaatgaagcttcacgtgccgatggctttgacggcaccgttcacctatcaggaattcaggatacaatactcagaattcaggagcgtggaaaacggagtagtaaaacgcctgtagattacacccaaaaaaaactgcacgagttgactcgttgatcttgcagaaaatcagacatagaatctccagctgttttcagagcctcttgctgaaagagtcagttcagttaggctagctctgactagttaactacccttacatactgtaatcactaatctcttctcagtcattcagctgagcttgcaagcgtgcgtgtgggaaatgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaagacagaggttccggagacctgctctcccgatcgccggtgcacgccggcgagcgggatggagtagtctacgagcgacgacgcagtacagagtaggagacaaaccctagattgatctcgcaaatattgcgtgaagatggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggatgccaatttttcggaccattcgacgcgtacgtcgtgcacgcgcgccgcctgccctgccaggcgagacgagcgagcgcgcgcatgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaggaaaaagtacacccataagatacgactcggtttatgaaaaaaacagcattcttaatcatcctgcacacgctttgctgttctttggaaagtcttaacaaatctgtcaacgtttgggtgaaagccatggccgaactgcaacacgttaaactatgggaatgaaagctacagaggtagaacaggtcgtcttacgatattaacgcagcctgttttttgttttttcagatgtgtctggcacgagctgtttttatggtagctctgactagtattactagtaattaatcatcagccatccaactggtccttgcatacacgttgaattgttcgtattttctcgttagcccttgctcctaatgttgggttcttatagtctttcttttgtttactgtactaagatcaatgctgataggaaagcaggtagagatcaaataatgcgagttgaaagaatcggcttgaagaccttgcgatgcaaaaagaccttatctaaagtctctctatattttggtgagatcattgcaaagaagataggaaggaaaaagagtatatattggcaataggtaaggtggttatgagctcccatttcccatacgaaatactcttctatactcatatcatcatggatttaaaacaactgcaacattaaactagaaaatgttgttaataaacaaaagaacaaaaccagcatatacgaaaggttgttcaccaaattctatttaattacatgcataagcagatctttccatccaactatacttaaaaccttcacttgtaatgaagcaaccaaaccattaattcaagccatcattatactagaattttgtaggacctggatgcattcagtatgaataaatataagtagctggcctagcggaaactaaacaatgtaactggtatatctgattaatttggtgaagatgaactgtcacacgtcctgcatatgtaggacagccttacctgcatcatcccaaatatgagttcgagccaacgaaacaaacaaaattccatcagcatctagctaataagattgattagagagcttccatgagaggaaaattaataccggcagtgctttactggtgcagaaagattcttggaacagaacatttctttttcatttgagcaggggaatcagtattatctttgccaatttatgtcacacactgtactatcctaccaattaagaattaacacttatcaattattctctattaaacctgaaaagttcagggaatatttattgctgagagattaactaattcactagtcataacataatcatagataaggcgcaagttgtgaggacaacatcaggtaggttcggcaggctgtgctgcgaagcacgaacggagaaaagatggatggattaattgtcattagctgccatacaggtcggtaggccttaacatcctccacagtccatactaatcacattatcagaggctatgtagcgcctccatttgcagatatcattatggatcaagacatatgctgctggctagggatgaaaacgatcggaaatcaaaaaaacagcctcaaccatttccgtaaccatatttttctcggaaacgaaatcggaaacggtaaagtcggaaacgaaaacgatatcggaaatatcggaaaaccggaaacggaacaatacggacggaaacatgtcggtacagatcggaaaccgataacaaatacggaaacattaaactataaaaacatatatttaactttacataagtatgttatatatatacataaattcaagcttatactatataaattataaattaacttcattttagccatgtacaaaagttagagattttattgaagagtcattcaatctataagctgtgggtcaagtatagacatgtcctataatatcgacatatttagaatacggtaattaccatattataagaaacggtaatttccgcgagaatacggtaaatacggaaatgatcggtataacagcaaaaccatttccgttttcattttcatattttttatcatttccatttttgtttcggttgattaccatttccatatggctcggccggtagaaagtcgaaaacgaacgccggtcggccggtaattaccgttaccgttttcacccctactgctggcgacttgccactcgccataattcttaattccatttccgagctgtacgcatgcgatcgaatccttacaaaaaaaaatgatgtggtagctacaaggtaggaggatgtatttttgcattcacgttccaacaactgttgcctcacgtgttgtttcaaactaaagtacttaatgatctttcatgagaagaagaaaaaaatgctttgtgtacttaatcactgtgaggtggcccaggcgcagggacaactctagctcatcttacctgatgtctaaagtgtctaacgatagagagtggagatataacacaccattcctctcctaattaagcaaagcatatgcgtgcatctagatcgagcaattggttaaaccaagctagtgggaaacaaagggaaggaaaagaacatcataccatttcatgacttcttgcaaacgtaccttcagtgcagctgcatggctgcgattgacaccgagaaaattaagaaaacccacccacgtacgtctatatcgagcccgattcatgcatctcaaaaccgtatgtttctcgatcaatccttgacaattacgccaaactcaaggcaaactgtacatgaatccccaccccgtacaagaggaatttttggagctaatccacacattcatccagaaaaattaaacaagtctggttcgatcgatcagggagaagaatgaggacaatggtgtggcggtagaggagatagcgtatcggctctgtccgccgtggacagtggacttcctctgtctgcacatggtgatggcgaccttaattaacccgttgatgatccatgtcagccgcgttgcttaattcctccgtggaattctggaggttccggcccggactcccggtcgggtcctgcatttcatccgcggctgctaatgtgcatgtcatcctgtggttgcgttcgtgacatgacacatctgcagcttagctagctagcattttgttgtcaaaactacaaccacatacgtccaaagacgtggtcactcaacaatggttggaaaaaaagtagagtgtattaaattgagaattttactgatccccctattacatggccctatggggctatttatagcctactagggttttggttatacaggggaatttacatggttgcccttgtgaaagggaaatttacatagatacatagcgtaatcgcggtctatgggcccttagcgggccgatgggttattgtcgacccaattgacccctaggcttgatgggccaggatagcttcttcggccctcccggagccgaacttgctacggcgaagtcatcccccttcggcttatgctcttcgccttgcccccttcgcccaggaggcctctagcttggttgtgattccctgcctctcgccgtccttgctctatagtcttcgctattggggggggttcgtcttgactaaccctgacgtctcgggcttgaatcctcatcggtcgcatgctttcggcaggtttggtcgaagggccccatgccatatcgccaacacatttgatcgatcgtcggtggagatcaagtgccaaatctagctaggtcgtgtttagttccaaattttttcttcaaattttcaacttttccatcacatcaaaatttttccacgcacacaaattttcaacttttccatcacatcgtttcaatttcaaccaaactttcaattttaacgtgaactaaatacgcccctgtgtcggcatatcaaacttcatcataggatccatggatgcatgcatgctttcatgcggtacagtgctagagctgtacagtgcacccctcgacgtggaggtggaggtacgtacgcaggcacgcgggactcggcaacaaccaccaccaccccgaccagtcgagatcgactccgtaccagcctcctctgactgcatgcgagcatgcgactgctcctagcatagcaccagtagaagtctagaacgtacggccgcgtcgtgtggcggcagttggtgcggggtacggggggcggcgtcgccgtcggcgcaacagtgtcacgcacagtgatatctcctcgcgcacgcggtcgcgggcgtacgagcgcggcgcgagctgagctgctcccttgttggggagggggccccggcgttcacggggcgcgcgcgcggcgcggggcctgacaccgtaccaacccgccaccaccgagcgcgcgaacgcctcacctacctatacacaccgcggggtggtggtggtggacgcggcggtggctcgctagctcgcgcttcggctggcgatcactttagctagcgatcgaagtgcatgcacggatgcacttcggtgagagcaacgtccgaccggcaaatggatccgaccggaatccattgaagaccgggagttgactggcgcgcactgtacacgtggataacgcatgcctttcgggccgttggatggaatgcaagcgcatcaaaagtagagtgagtaattgggagtgtaatgtaaactctggatgggacattgtaaactctcgatagaatattctctcgttatttacatgcattgaaatggttataatttttcttaaagaaattaactagatagattaatatgtgatatattacttaacaagcatgcaggttaaaattcagcttttacattttaaaaaaataaattatgactagttaacgtatattaatagtcaaatttgtttttttcgttacaacttgtagattttaaatttgactttacatatttatgaagtgaattatcagttatcacatattaatctatcttgatagttttttttaaaaaaaaactcataaccatttagatgatatgcaaataaacgaggggatgtcaccaaagagagtttagctagaatagtttcccgtgagtagttgttgctagattgtggcattgagcttgagccactactagatctttatggttttggacgatacggttgctagctaggcctaacagctgcaagccaccattttatatgctgtatatataggtcactttcagctccaatctcagcaatctgaccacataattccatgaaaacgaaaacatattttttttaatactatgaaaattcgtacgggcaaaataaggtgcacagatcagtgtcggtgcagacgcaatgaaggactgatggcgaattggccatcacaccacacagcactctctagtgacaaagaaggaattgtcgccgcagagttcagccctctagctagccctctcgtaattgaatggaaagaaaagaaggtttcttcaggggcatttaacttcttcagaccgcatctaatccgtctaaacgcggcaaaaggctaattcatcgtataatctagctagacctgactcgcgcgcactgttccaggccaatggcgctcgctaacctggacactgccgagaacacgtgagtaccttgcagtgcaaatactagtactagaagtacgtagaaccctagaaccacggaccatgtgtgggttcgtgttcaagaaagacgagagggagaaagattttggacccatgctgtggccctgtttagttataaagtttttttttccaaacttttaactttccatcacatcaaacttttcatatacacataacttgcatggtggtccgcgcagattgcgcggctagcatcattatattttctcttatataaaatcatatatgttttctcattatattattaaaatatattacaatgacaacataattttgaattttgcaataacttttcaaaactactaatgtgtaataactactctagtctcctcttctaattttccttattttttaattctgaatttcagctatttctaaattgtatttctatatggactctgctttttttttctctgattaatgtgagaatttataggcaatgagagcgaacgtgtaggctcctttttattccgaatttcagttggttttaattcaaatatgaactctatattctacttctaatattccttattttttaattccaaatttctatttttttttcttaattgtatttctatatggactctatactctacttctaatatttcttaattttaattccgaatttcggttatttcctaattgtatttctatatggactctatactctacttctaatattctttatttttaattccgaatttcagttatttcctaattgtatttctatatggactctctagtctcctcttctaatattccttattttttaattccgaatttcaactatttctaaattgtatttctatatggactctagtctcctcttctaatattcattattttttaattccgaatttcagctatttctaaattgtatttctatatggactctgttttttctttttctccgattaatgtgagaatttctaggtcatgagagcgaacgtggagggtctttttttttccaaattttagttagttttaaattcctatatggactctaaactctacttctaatatttcttattttttaattccgaatttctattttttttcttaattgtatttctatatggattctatactctacttttaatattccttatttttaattcagaatttctattatttcctaattgtatttctatatagaatctatactctacttctaatattccttatttttaattccgaatttctattatttcctaattgtatttctatatggactctatactcctcttctaatattccttatttttaattccgaatttcaactatttctaaagtgtatttctatatggactctagtctcctcttttaatattccttattttttaatttcgaatttcagctatttctaaattgtatttatatatggactctgttttttttttctccgattaatgtgagaatttcgaggccatgagagcgaacgtggaggctcctttttctattcctttaattatataatagatttttctatcacatcgtaccaatttcaaataaactttcaaatttagtgtgatctaaacttcagtgtggatgaaagatcagccacaggttctctccttcatcaaggcgtagcactatccaggttgacgcttgacatgacaagcattcactccgccgtacaccgactctctgtgtgtgttcagcacgcggatcccccggacgcgctgactccacctgcaaatcctcaacagtgcaagggggatcgctctagatgcgaccgcaatctaccacactgacgacgacgccattgctgccatcaaagagatagcttaattaaaaacagtaaccactcataaatggatgtgtttcagcttagcttcttgctgcagaatcgtctgaacgagaaggaaaaatgtccaatttgatcatcgcttcagtgaactttggaaataaactcgagacttgttagctcgtgtttacacctgcgccacacgtacactagcctctgcctttttgcactgatcaaatctcatcgaatagccgaccccaacactatcaatccttttccgttgtcaaaccgtgcagattcaatcgactgccgctgctacttgctaactacttccaacgatccaaggcaggcacgcgcaagagcaagcatgcctggagatctcttcttggtagttagcttggttgacccattaataccggccatttgtgccccccaaaagtgctcgatctcttcattagtgactagtacttggccacgacaaccatctttagatctgtaactacttctataaagtgttcaacttcttctgtctcgatcgatagcaacgtcgagttcgatggcctgttcaccagaaatcaattaatatgagaggttggccgccaaactggaaggaaggttaagagagtatagtttaataggagtacgctacgattcggtatacgctactcgtctatacgcctctc

SEQ ID NO: 70906 - DNA, 31101 bp, Oryza sativa
aacgaaaatcttcgggcacagtgccgtcgttgtcctatgatcctatcatcctacccccaatctagcgagtggtactatccctgttccgacaagtgaaaacgactcgatttgatccaaaaagatgaacttttctcgaccagctagctcatcagccacgaggtatacgtccaaccaagcgggtgtgtctagttcacgctaaaattaaaaattaaaagtttagttgaaatttaaacgatgtgatagaaaaattagaagtttatgtgtgtagaaaagttttgatgtaagttgaaagtttgaagaaaaagtttagaactaaactcggccaatattgaacaaaaacatttggacggtggatgttgcgtcggagctggtccaatattgaatccgagtagttcccaacgcaaaggggaactaggcatgttagttttgaccatgagacaccttgccccaattcgttaattaacatatggctaatcaaaactcgtaaggcccagcgtgtgcagtgcagtgcagtgaggcagcaagctaaggcatgcaactacctaatcagtgctattaaattgtggccatgtggcaaataagacaggggaaggaggattagagaaaacggtggttagtcacgcacacatgacaaaacgcaagagacacgagagacagagaacagctcagagggtagctagccaatcagtggcggttgctccaccaaactttggaaacgagtaccaaaaactggtcgatgattccgtttcgctcatcatcaccggcttattttaatgggacattcccccactaaaaagctgagcggctttctccgatcgctaactacaatcaggcatccagaacgagtcgttgataactttaaaaaactactcctagtgccgtgctgtgctaccactgtaaaccctaaaaaaaaatgccacgctgtaacaaagttgttaccggttacttgaactgagtaaaagaaaagggaattgctatacgttatttgaatgaaatttgaatataaaatcttctagattttggttcattggatccatactaagattcatgcatcggcttctcttctctaactgtagtgggctccctttcttctccggtaccggcgacactcccaactccgatagggaatatacggattagggtttagggttggggtcaggataggagaggaggttggggagggggaagagcgggtttcctcggggcttaaagggatggcagtgggcggtggacttcggcgggcggcgaggtggtggcggcaccgccgaagccgtagggatggagaagggcggtgggccggcgttggcggcaggggcaaagcaagcatgcgattaggaggcgacgactaggtgatggtggatccggcagctgggagccgccggagacagggaagatgatggggcgggggcatctcgccatcaccaccttgagaagaaagagagggaggaagggggagcggggagggggagggggctcatcgaggggcccttatcggcgccgttgactcctttcggccagtcggcgaggcgggtgatagcgcggtggggcggtggcggcggtggattgggcggtaacgcgatggcaatggtggatcggaatgctcgaggaagcaaagggaacatgagaagaagaggtagggttaagggcttgcacaaaacttaaagcaaatttgatggtctaaaaatcgaatgatataaggtgggattttatattagaagaggtataggcatcaaagaaaaaaaattggtaaattttgtactcgtagctagtactggttccaaaatttaactgtcaaggcaagtacaagggaggtcggggaggatgattgggttgggtagagcggccacactattgcggaatttcgcgaggccaagtgagggtacaccaggacaccaggtactacaccagtactgggtctcacggcatctcgcatcgcgatcagcggtcaaatcccacacacacgccgtaggatccagtcaatggagagaggaaaagaaaaccaaccaacacaacaacacagaaaagcttcgccaagtgaatcacccaaaaaaaaaaaactcctctctacgactctaccaacacgccgccgtcgccggctcgctcgctcgctgcccatatatacgcgcgcctcgcgtctccacttcccctgctattactactagtacaaaaccaacgcgaagctctcgtcgcgcacaaccaactcgacaccgcggcgaggcgaaccaacgcgcggcgtgggcatggggaggtcgccatgctgcgagaaggcgcacacgaacaagggggcgtggacgaaggaggaggaccagcggctgatcgcctacatcaaggcgcacggcgagggttgctggcggtcgctgcccaaggcggcggggctcctccgctgcggcaagagctgccgcctccgctggatgaactacctccgccccgacctcaagcgcggcaacttcaccgacgacgacgacgagctcatcatcaagctccacgcccttctcggcaacaagtaagttgtaaacggatttcaatgcgctgtcatctgttcttgtgttcttggtgctgatcgatcgtttggttggttggcgcaggtggtcgttgattgcggggcagctgccggggaggacggacaacgagatcaagaactactggaacacgcacatcaagcgcaagctcctgagccggggcatcgacccgcagacgcaccggccggtcagcgccgggagcagcgccgccgcggcgagcgggctgaccacgacggccagcaccgccgcctttccgtcccttgcgccggcgccgccgccgcagcagcacaggctacacaacccggtgcacgccgcggcgccgagcaatgcgagcttcgccaggtccgcggcgtccccgccgtcggaggacggccacagcagcagcggcggcagctcggacgcgccgcggtgccccgacctcaacctcgacctcgacctcgacctgtccatgagcctgccgagctcgccgcccaagacgccggccgccgcgtcgtccacgaccgcgtcgcgccaccatcaccaccagcagcagaagaccatctgcctctgctaccacctcggcgtccgcaacggcgacgtctgcagctgcaaggcggccgcgccatcgccggccggcccacgcgcgttccggtttctcaggccactggaggagggccagtacatatagcacagcaggctttagggaaaaaaaacctgtaaaaaacacaaaaaaaaacggtgggcaatagagttttttctaagttctaatggagatgactgatgttgattagtttgattcttgatgtttatcattaaccaaaaatctgattcttttcctcttcccaattttctgatttgatttagcagaatcttacaaaaagtaattggagatcataaaacaaaactaaaatggaaattataatgagcgagactgtgagaaaatataaagtattgctgggttgcgcatccagttcgggcgtcccaagtgccgtttgtgtcatttgggacatatcgcgagaatacagcatgtggtgtgttttcggtaggtaggtacaaactactcctgcttgggttatccgatagcaaataaaatccattaatgactcatggtggttaggcaccggagaaagtgagactgacaatgttacattttggtgttaaggtttggctgttcgtttaacaatgacaacgacatgagattctaaacgtggtgatatatagtggtagttagccaaccaaccttagaaacctatattggtggtggtaactaaaatttacttttgtttctattggaatagcatgccttaaaaaatactctctctgtctcaaaatataatacttcctccatctatttttgatagtcatatttctaaatctgaaaaatttatttttgaatgacatatttcaatccaacaacctatcatcttaatgattttcttggatttaatgcgtgactctccattcttccacacaagattggctacatgggcatcgagaaatgtaaatattaatgaatcgcttatttacaaagaatgactagtaacatatttaaatagatgataagtagaattgcttatttttggtctgtgtgccaagatgaaatatgactgtcaaaagtagatggagggagtaacttgtagctctcaagatttatcctaaaatataacaatatctccaccaacattatcttcccaactaatcacaactctctaccattcacttctacctactttcttaataaccgtgtctaactctaaaacttcttagagcaggtacaaaagtaaactattagccagctgcaaacatattttaatgagataaaagatgagtgagaagagcagcgggctacagatctatagccagttgcagcacggactccaagacgcaatgtgtgtatgacatgggggactatatattaatagtatagtaagcaactattatatgaattggctataaatgaattggaggcagtagtaggctatattattaaacttgctcttatattataggacggatggagtaggcagcaacatcatactccctccatactcattaaggaggtcgtttaggacagcgacacggtcttcaaaacacaattgacttcttgtttctataaaaatatttattgaaaagtgatatatttatatttttatgaaagtatttttcaagacaaatctatacatataatttttacattttcaaactcaacagcttgagagttatttatgatttatattcccaaggttcgacttaaacattgtgataaacgattttttttatgagtacggagggagtatttctaaaataaacaattaaaatcgggtataggttggtcagtacagagcatcaattatgttgcatatctgttttccatctgatatataaaaagaaacaattatacatgtttttggctagaaaagatttcgttcacaagtaatactaataagaaagctataaaaagagccattatatttgagcaaaatggctccttctcgttaattgctaccatcgataatcttgatagggtgtttgatatagttggtaggaaatgtccaaactacgtatctctctcatctctcactattctttttctcaaatttagccatagtcttaccaaaacccatatcttgtgctttctctgtcaaaaaatattgcaacttaggatagagtttatattcctattcatattctatgtttcaatatttttagatagaggtagtaacattttatagtagtttcctgagcaatatgtactttatgtagataatacatggaagtctggaaccaagagatcgatataaagtcttggcatgcttggcctaatgtgtctcatgaaacacatggcttatggaaaatagctgaataatcattcgaaacttcttatgtttttgttacttttgtcaaaactacgaaaaggagttccttgcaggtaagttcgacatggacatggatatgtttattcttctcgtgactatggatatccactcgattaccctgagtccctgatccactctttctgcgctaatgtttgagggtatctggtttaattttctactttgtcaaatgaatcaaaagaaattaggcaacttttaacatgacgaggcaattcgttgattcataaccgatttttttgttcggcaacttcttaatactgcagcccaatgtggcgaatacttagccaaacacgtgcttatttttttccgagctggcatgtgtcaagtacccagtggatcttcttagttttgggaagatggaccaactccacagatacctggaagtttcgtgtcagatttgtagtgtgacacctgaagcaggaaagattgattatggagtccccatctttaaattccattaattatagtaatgctagtatgtgtcaatgtgtgtaaggtcaatgtttgattcatttgccatcatatttgaaacgagaatatttgaagtcagacgccgaatcgattgcccccaatacaaaaacggtcagagcatagatgatggtccgtggccggcgacacgtatgctgtccgtctcgtgactttaccaaccacctgtaccttgttgctgctgctcgttacgcttccttgttgcaagtacgcgaaatgatctgtcagtgtgatctctctcgtggcgcggctgcaatgtgaacctacgaacaagggagatgattgcctgattacctcgttccggattcagctaaaaacgtggttttcaagactatatgctgttgacaaaagagtgcagaaactaaaactgtatagtcatgttactacctcacgaacccgtaaaatctgcaagcttcctttccagatcagtggactttcatggctaccgggaggatttttctctcgaggttccgtaccatctactcccacaaaccacaagttgtttgcatatactcatcacgggttaactaaccaagggggcacacgttcttttccgacgttttttttattcttctcccccttgttcttctccatgtttatctgcagcaacaagctgtagataccgtcacaagtgcgtgacagattccgttacgtgacctcatgggataactccctgtaccaaaccgctttttttcttccttttttttttttttgccttcaccaaaagtcatcgtcgtcatcgccttgtttgcccatgatggcttacgtacgcctcggtggcgaccggcgccccggggttcctcgcgccgtggcgcgtctctcgccacgtacgtctcgtcgatcgcgccccgcggaaactttgagagattttacgttctctccctagccggaatcggctgtcgccgtcgggcgcggctagcgatcgagagataccatcgcggagatggcagtggcacgcgcgagccgcaaggtggatttggatgaggggggaaacgtgtgcgcgaatgcgcgatcgcggcaaaagctgcggcgcagtgcgtgacacatgcgcgataatcgttggagactggctggccggtgctgtgcgcgagcgggatcgtgaaaggtttccgcgtgttacaaaagttagttgtagttgatacgttgaaacgacgactaacctttctaatcattttagtcattaatcaccaaacatatattagacgaagacatacgttgtttagataataaaatgacaacacacgttatatatcgttaataaatattgtgtgttttatatcatcatctgacgtgttttaggtgatcaatgactaaagtgatggggaagatgaactgtcgttccggactaacttctccaacatcgcagaaatcgtctcttctaccgttcaccgccgtccggaatgcgtaatccttgcttgaaccgaactgaaaaacgtcgcccgtcatccgaccgaagggacccaaggtttggtatcttcgtttgaacttttggcatgcttttatgtcttatgctaacagaagatagccatcgcgtcgaatcaagaaaccaaaaatatcggctcatggtgggctaataccaaaaccgctaccaccacagtactactacctagtatttagtatcacttgactgtcaagacatgaaagcaggaacagcgactcatcctcggggggtgatctgatctcatctcatctctaggccggcagcaagtggtactactaactgatgcgaccccacgcggaggcgcaaagtgctgctccttgtgctgctgggcgtcgtggcgccgtgaatccccacacaaaacaccgttcaaatcagcgagcttttagctttggaggcgatcgcatctgtgtgctgtgcgtggggggaaaagaacaacgtgggatcgatgtggttgttgctggttggtggggcgatgacatcaccgacgaccgcctcgcaccggcgcgccgcacctaaccgggcaatccaccggtggatccatcgaaatcgcgagctgtagctgttcccggcacgcgttcggccttgggccccggcccccgcgacggcacgcgatttccgggtcgcgtttggccttggcacgctgtaacttggaaaaagaaaaccggccacttgggcacggatgatgcatgcatggatggaggagtagtgatctaatgatctaatccatatcgccaacctaatcgtcatcttcttgatgaaggccgcaactggctaattagctcgtgacaggaaagaatgttcagataacaggtgatagatgcgagaagggtccagcaggtcatcaggtttgcaagtttgttttctccagctcagtttgtaatttggtcgagaattatatgtcgagtttatcatcagtttaataaatgtcctttgaacatagtacagtggccggtcgggccaagaaaactggctttcgaaacgaattgcttcacgctggtgccgaggcaaagcatcatggtcatggaaaggtgcctgcccggctgtcctactgcgtttgtgttgtttcttgatggatggatcatgatcactcccttttcagtttagaatcatacgtgcaggcgtccgagaagagaatttagttctttgattagtttaggccttttcaaatactgcacagtactagtttccacacaaactgatggagttggcagcaccaatgtcaaaaaggaagtctatgcactttgatagtatccgttttttcatatttaaggataatctctgtcttgatcaatcattgactgaaaaaacaaaggtgaaaggatcattagtactagctttctaataaaatcagctaataaagctcccaagtcgacgtgtgcatgcttaacagaaacaaaatcagctaaaagcacttcttgtttaatagaggttggtcatacctactcctaccattttgcccaaacagtgagctgtggtaggccataagcccatgataagcagcctgtcctcttctccgcatcttcctggtcatgtgactttgggacctcttctcagaagtttcaacattctttaatcacaaccgccagtgagttaatggcagatggcaacaaacagaatttgggcttaactgaaggcatttggttgcagaggtaagccatgtgctttgaagggggcaaaaccggcaaagactatgctgaaaccaggctaacctgctgatatctgaccatttttagagtgtttgatactcctacttgactgtcatttgcagcgacggtccatttggacaaagaaatgctcctagagtgtttgactacttgttgtaggagtatgtatgtaactgtataagaatgtgcaactgcagatcttgtggaagctggaacaaataataaggcgtggaattggccgtcttgcttctgcattacaggaatatggaggccgttacagcgtcgacaacagacactttgcagcgacatctgcaatgtcccatgacaagtggaagaacacactgtagaaattcctgtgatgaaggctccagactggagtactctgttaaaaaaaaagccaaattaggtgaggattttacatcacatagtacaactaatcaggatataaggttgtccagttttgttgtttcagactttcaggtgatatcaaatccccatgtaaagtcccttttgattcgtagcaatgaaaaaaaatgaaggaacagaaaaagacgtgattctgacaggaatataagtgtaaaatagggagattgcaaaacacagaaaaaacataaaaatgatcgtttaattgagccgtaggaaaaatataagaatcaaataagagagataaactcaaagattttttttttcaaaaggttggacctcttgcaatgaaccattccacaggaattacttagaatttggaaaactccaatcttttgattcaaatagaaaaaattttaataggatttcaatcgtataaaattcctctgtaaattcttagattcaaatgggtctaaattgttttttctgtgatggagcgagtatagaccagtcggagtcaacaagtcagcttgcagttagcggcatttaatcggaccagtcctaaaattccaacgtttcaccggcattgtgcagtgcagcgctgtgtcgcagagggagcatatcaaatccttcttggaggtgctatactgcgatgcagcagcggcccctcttcaaaagttcaaacctgatgagatgggagtgctgtgccagcatttatttcctctgtttacaaaatcaaatcagtatagaacgtgacatatttaaatacaatgagccctctttgattcaaaggaaattcatataaattttagaggatttcattcctataggaattttttctatatatccctttgaatcaaagtaatggattttatagaatcctatgaaattcctatggattgcctaatgccatgcaagttttggaggaattctaacatgaggtaaaacctcttgaaaacttttctttgagtctttatctctcttctaattcctgtttttttcctgcggtccaatcaaacgaccattcctgtattttgcaatcatctgttttacacttacattcctatcaaaatcctgcgttttttctattcctatattttctcatttctgcgattcaaaggggccttcaatctgaatagatatgttcagattcatagtactaggatgtatcacatccagtacattgattttttatgggacgaagggagtagtatggttctcatcagacaagaaacacttaggccccctttgattcaaaggaaattcataggaattttaaagtatttcatttctataggaatttttcctatatagccatttgaatcaaaggaatgaatcctatagaatcctatgaaattcctatgaaacgcctctttccatgcaagttttggaggaaatttagcatgaggtagaacctcatgttaagaatcctttgattctttatctctcctcaaattcatatatttttcctacggctcaatcaaacggtcattcttatgtttttcctgtgttttgtaattctctgttttacacttgtattcttgtgagaatcatatgtttttcctattcctccgaattttcattcatgtgaagtactccctccatccaaaaaaaagacaaaccctaggtttccgtgtccaactttgactgtccgtcttatatgaattttttttataattcgtattttcattgttgttagatgataaaacatgattaatattttatgcgtgacttgtctttttaatttttttcataattttttcaaataaaacggagggtcaaacgttaaacacagaaaccaggtttgtctttttttttatttttgagacggagggagtaggagtaaaatgggactttggaagtagaggtaaaatggtcagatgctcgaaaagctgggacatcataggtagagtctgccaaaaagagtgggctagtactcttttgacgcactccagtcctttggtgtcagttggaccggtatgtataggagctggtacaccatggtagaatgacacccatttattccttttcagtttatggaaaaggctgtgtttagttagcgaaaaaagttgaaagtttagactgtatttagttcgttgaaagtttgagaaaagttgaaagtttgaaaaaaaatttagaagtttatgtgtacataaaagttttagatgtgataaaaagttggaagtttggggtagttagggtgaactaaacacggccaaaaaaaacttctattacatgttacctccttcaaaaaaacgaatttagaataggatgtataaacacaccctacagaaactaggtgccgtgtgaatacattttcttttttcttttgttgaagacgtgaatacttttgtcttggcaaaatgcaaacaaactaatgagtagaccgtatggttttcagacttcaggctagtatgccctttctactccttccatgtttctcactatccttgccgtgccaatgtggtcactgtctatggcatgtgcggacgtgccgattaaccgggccacagtgccattttgttaactgaatcaggtcggcgcgatataaagtcttgctctccccatggattcacggtacagcgatggctccacgtcgccgtcgtttcgtgccacgcgacgcgacacgcatcgccggctgctaacctcgagattgccttggccgcggtcagctctccagctgctttcagtttaatcctgcaaattttcgtcggggtgtggtgcagccgtgcaggttaggttcgcgggaacatgccctcattgactcttgcgagtatcatggcactgtgtgttttctacacatgtgtttctattgtcgtttccgtgtctggataccagctcgttgcttgacttgctaggatcccttcttgtctgctggttgaggcagggaaagatgccaccaagttttgcctaccggagtactcctatactgtaccttgtcaaacctactgtctgacgacaacgtcgttgttatgtactccgcgtcagtagtgctggtgcacaacgctctgctcctttcgtcaaataccgacctgtttttattcctcacggcagggaacggagcagtaatggtccagtacagtgttgcattgactcccttgaaaacttggacgagcccgtgacctcgcgtgacgctgacggctgaaacctgcaggctttgggcacgccgcccttgaaccaatctccgttattccccatgagaaaaagattagaggtgatttattctacacttattatggagtgaaattattctcctcaattatctcctctccaaatcgaaccaggccaatttaagtactaccttgtattagtcgtattcgtacagtactcctgtataatacggagtacgggtaagtagcacgcgtactcgcggcctgcatcctcttcgggctttggtgcatcctcttcggcctgcatcctcgcgtaccaatatgtggcctgctggaccacacacggacctagcaatcacagtgcagaccaattattgtgggccgcatattggtcacaaggccgacaaataatacggccctcaagtaagtagcaatgcggagagacaccgttgtttacgggctcttcatgccgctggaaatctggtccgaactgaaggtgaggggttgggccacaagacggcggcgtaactcggtaattgagctttcgagagggtggcgatgtacgtttgggctgtgtgatttacacaagacagtttttcctttttaggagaaaggctttgtgtacttggcgagtgggctggatttccaccggtggtttccttttgtttttgcctttttttttttatcatggtgtccttttgttttttttgggaataagtttattttagatcccttaacttgacagcaacttcgattttcgtccttgaagaaaaaacaagtacaacgggacccaccgttgtcaaaattggtgcaatataggttccatgacagtatagtgggtgttttttatctgatgtggcaatttgacccgagtcaaccgtgccgagtcaatgtgggtcccacattggccacagttcagttgttggaggacttggagctggagtaggccaattgcgtcgttgtgggcggttgcggcgaaaggttgggacatcgggcggcggcgagctcactcgtgacaggcggaggtgatggcacgttcactagtagaggtggggacgacttcacaggtgtttgggtcgatgtcagtggaggcggtgaaggcgtcactagagaaggacaacgtgcaatgaggtggacgacaaccggcatccatgaaccgttgtgccccctactccagcggccaccacggtcgcctcactccagcaactcctccgctagtcctcgctcccgccgcatctcatcgctgacaagctctcttcatcctcctcctctgtgtggccgacacagtggcaatggggatatggggttgcgccattgtgtgggagattgtgacgagacaagccaacgatgacgacgtcaggcgcgaggaagatgacgacgtcggagaggaacgatagcgagagaggggcctacagccaccgccagcctagccgccaccggggaccagcttcgtctagggcgatgctgacatcctccccctccccgacaagcgtccctcaaccctgcttcatcggctggcgggattggactcataaaaagaaggggagagaaaagggcaaagtgaaagagagagggggaagaacaagctaggggaaccctgacatgtaaggcccacgctgatttagattgccacatcggacgaaatcaaatcgaactgactgtcaagttaagggacctaaaataaacttattcctttgttttccgtaacacgtatgtgcaactggttcttctagtttgcagtttgagacaactcaaaagcttagaagtccgagtacagcggaaatagaaatatgaacagaggaacaatcgtatgcaaacataggtgatgttcttttctttttttttcttttgaagataaagatgagaataaagattaagtttttttactaaaacaatatggtattaacatatgattgattgagttttaattattataaacttgaaaaatatattattatgatattttagagcaactttcatatagaaagttttcacacgaagcgcaccgtttagcagtttgaaaagtgtgccacgaaaatttttatcctcacttttgttggagaaaaaaaagacctatgaaaagaaaagtatatgaaattgtgcagccttgttgcaggtgttaatatcgcatcaggcactggcagtacagctactccataccatgaccgtttcccatctatgattatcccataaatatatgcatgtcaagttgacatttgacaacccaagtttgttcccacccaacgcggaccaatcaaataaggccatgtttaattcgcgaaatgaaaatttttagatgttacattgggcgtttgattcgatgttggaaggggttttcggacacgaataaaaatactaatttcataactcgtctgaaaaccgcgagacgaatttattaagcctaattaatccgtcattagcacatatgggttactgtagcacttatggctaattatagactaattaggctcaaaagattcatctcgcgatttccatacaaactgtgcaattagttttttattttatatctaatgttctatgtatgtgtctagagattcgatgtgatttttttttaaaaaaattggaaactaaacaaagcaacaagacataaacaaaggcagaacaaaagaaagctacgccaggtcgctcgactccatggctgtgtaagaggtcgaatttatcctattttctaaaagaaagaagatcaacttcgacaagttgatatgtggtaggaccctagttatcaacggatcaaccctacacagatcacctcgaccaatcgataagtccgacgacacggcaacacggctacttgttcccagactggcacgacgactgtataatatatgcgaccgtataacgtgcgtaattgatgctcaattcggcgaggaaacagaagaaaaaaaagaaacaaaaacgaatggaatccagatgggataccgatcatgtgccggccgtataatcttcagacttgaggacaaacacgacacatgaacacagagacgttagaggcaccatgcatctccaggtcccacgttttcaggaatccaatcagggatggccgagtcagtcagtagtggaggtcacattttcagtttcaggttagagacttcattttatttttcttttcattttgattagttgaggtagttcagtgctcaattaagtcatttacgattaaattaactatgcatcaactactactaatctatcaccaattggagctttggaaaaggagaggaaatgctagtacgatatcgaagaatgatgtggtcaggttggtaatggttgtctacagaaaagaaaagagaaaagaaaacgaaaagggttggtgatggtttgtctgtcccagccatgagcgagctgtacaccgcctaatcacacctccaaacaccggtttaattcaatcgttgtcccaatcaatcatcctgggggaccttaattgcagcattggtttatgcctggatcaatcatcgatccattttctctgtattagttgggagctaatccatctcatcttgggacttaatttggagcaaagctccaaaaatatattccatgcatggggtattatattattgaattgtgctactgcaaatgaggccatttttctgagcatggaactgaaaccatcatgtagaaggggacctggctcttttatggataccaatggttgatcacatcctacaggtgcccgtgtcacccccggaaatgagggattagctttgctaattaggtgttgcttttggtggtacgacattgttgccgtgcatgcaggtaagcgtcgtggaaatgaatgcgctgagttagtggcatgcatatgcatatgtactgcaaaatgctagtatatatttttgtatatgatgattgttcagttgccaaccaacagttggttgcataaagaacagtacatgatatgacactgacacgcgagattgcagttagattttcggttcgatgggttgtcacagagattccgtttagtttaggcgttgtcaaatgttctagttctaccaacattattccccttttatttgaggtttcaatgtctgaatgtctgaatgcgtgcttcaaaattgcccatgtttgtgccgttgatttggtagaggaattcgcatcggttgtgacgaagaaaacatggtcgagatggttaaaacgacaataggatccggtagccttgatccgtcggtttcatagaaaatgaccacgtggaacttagggaaatacggatcatcctccaacgtctagatcagcagcggctttgcataggattctcatggcgaagagataccttctctgtttctttaccaggtgagaaaaaaataaaggtacataggatccgtgcaagtttcggtcatgcatttgacatgtcagtgagccagtcttacatgtacaaagatgggttttctgcctctaaaaatacagttctatttcgtcagttgcagagatagcagccaatcggactgcaataagacgcctggtcggttgcccaacgggcggtgaagtgaatctcctccatgaaagtatccatgtgatcgaatagaaacagatttgtcgattgggtatttggattctttttaaagatgatatttgaactagtgacagtagtagatagagagtcgaaccaaatttgtgaagtctagatgaaactcaatacagttattacatgcctattctatttcgcactcctggggagtatggctgtatgggtgactgcctagagtgatggcgtacattagacatccaatgttagagactcagaggtcactagatcagtacattggacgaacaggtttcattagcaacttggttagttggtctccatccgaacgtgttgaaatattacagtgaaatatctaaagtagtgaaaacactaatgtttctccaatcctgattgagccacgttatccgttcactatgaatattacattggagtatgcatatgcatgcgttctatataattcaacaaatattaagttcatttccaacgttaacttttaaatcgtatgaatacatataaaaaatttacccctaaactacttttcattgattcggtttttttttcagccttggagcaacgatgacgctgcatgtgatggagggaggacggaaatttcgagcggtagagtcgggtaagattggctaaacctgattgcgacttgctaatacaatatttcttgggtctcgtcttcgtttccttctctttggccgagtcactaacaccagtggcgctaaagtctgcagctgcagagactatggcacactgtcttgggttaaaatatcatggcacctagacacctgtttccaaagttaagatcttaggaagaatccaagatggtttagaaaacgctaattataagaaaaaaaaaccgttctttctagaactcatctgcttgtcctgtgcgatggatcgagatgagatgacggagagtttctgatcgatcgatgtggccctgcatttctggtgaacaccaatggatgcctggcaactctactggagtgcttccaaaatggtgttgacaagaatacgttgattagttcatgtttgctttcttaatcgagatcagatcacagagctttcgatccgttaggtacaaagcatgctgagcataactctatggccgtcatttgaactgaactttaaaactgaacagacagtcagatttgcaatatattcaaccatgccaagttatgctagctctgaattcctattgcttcttcagctgaaaataaatcagatctctctcctgagaaattcagctatcagggacctgcagcatgtaaggctgcgtttgttccttcagtatgatacgtaaaacgaaaagctcatcaacatataattgattaaatattaattataacaaacttaaaaatttatttgattattcaaaaagttatatagatttttttaaaatatattgttttatagtttaaaaacgtgttaacaggaaacgagaaaattatactacggagttgaaaaaaaagaacatgcactaaatcctccttattccaatataaatctaatcgtatgcattcaaaactacatttcagtttttgtattttgtagtttctatcagcattggattctgctaaagtgctataaatcggcagcccccttccgatttccgccgtccatttcatttttacccaaagaaacaaaaaaaagtacaaacagaaattcttaaaaaaaaacccagcaaataacacgtcattaaacggaaactaatccgttacatgacgtgggccccacccagccgcgccagcccacctattcgttcggcttctcccccgcccccgccgcccgcctcgttcgcttctctcttccccttccttccattccagctagcaaccgcaagtccgcaacgcgagaaacgcaggcagcaaagcaagcgaacccaaagctggcctcgcactcacactgacagccttgctctcctcctccccctatatctctcctccctccctcgccgcctcctccccaatcctccaaaccctaatcccccacctcactctctctcgatctcgtgctctcctcctttcgcgagcgcgttctttggaggggagatggcggaggagccacagccagaggccgcgcccgccgcggtggcggcgacgaccgaggtggcggtggcggagaaggcgcccgtggaggcggagaaggagaagaaggtggaggaggagacgccggcggtggaggccgaggcgaaggaggagaagaaggatgaggcggcggcggcggcggcggcgggaggtgatgaggccggggcgatagaggggaccggatcgttcaaggaggagagcaacctggtggcggacttgcctgacccggagaagaaggcgctcgatgagttcaagcagctgatcgccgccgccctcgccgcctgtgagttcaatctgcctccccctccgccgcctcccaaggcgaaggttgaagccgccgttgaggagaccaaggcggaggagaccaaggccgaggaggaacccaaggctgaggagccggccaaggaggaggagcccaaggccgaggtggcggcggcggcggcggcgccgccggaggcaggaaccgaggagccgaaggcggaggcgtcgtccgaagaggccaagaccgaggagccgaaggccgaggcggcggccgacgagccggccaaggaggagtccaaagctgaggcggcgccggctgaggaagccaagccggccgagccggagccggaggagaagaccgtcgtggtcaccgaggaagaggcggccaccaagacggtggaagcgatcgaggaaaccgtcgtgcccgctgctgctgcgcctgctgccgccgccacggaggaagccgcggcgccggaaccggaggtgcaggcggcggcggcgcctgagcccgtgttgatctggggcgtgcccctggtaggcgacgacgagcgcaccgacacggtgctcctcaagttcctgcgcgcgcgcgagttcaaggtgaaggaggccatggcgatgctcaggtcggccgtgctgtggcgcaagcgcttcggcatcgagtccctcctcgacgccgacctcgccctgccggagctcgacagcgtggtgttctaccgcggcgccgaccgcgagggccaccccgtgtgctacaacgtctacggcgaattccaggacaaggacctgtacgagaaggcattcggcgacgaggagaagcgggagcgcttcctcaagtggcgcatccagctgctggagcgcggcatcctgtcgcagctcgacttctcgcccagtggcatctgctccatggttcaggtcacagacctcaagaactcgccacctatgctcggcaagcaccgcgccgtcacccgccaggccgttgctctgctccaggacaactaccccgagttcatcgccaagaaggtactaatgatttcactgccattgattagtgctatttgcgtagctatttctttgcaactgaagcaattttagagtagctatttgtgtttgtaggattcaattcttaattaatgcatttgtagtttaacgttgcaagtgaatgattgggctaaaactttgttctttaggcaatgtgataaaggttggaacttttagggtgtcactgctagctcttttgcaccaattttagtactggcctgagttgactgttgtcttttggcgtgtgctttgttgttaatcatagcgcgagctgggatcttttccttttgttctatctttttctggtacgatcagatgagggagttctgtaaggctgttaatataccaatttgtagttcattccaatagtttcagttaatgaaatgtgatcaaatgtttttggttgggtcatggtgtgcaggtgttcatcaatgtgccatggtggtatctcgctgccaacaaaatgatgagcccgttcctcacgcagcgtaccaagagcaagttcatttttgccagcccagccaaatcagctgagaccctcttcaggttttgcacacagaaaccattgagaatcaatgcttttggtattttcgatcttccaagtttaatttgctcatgtattgctatctaaacgcagatatatcgcaccagagcaagtccctgtccaattcggaggtctcttcaaggaagatgatcctgagttcaccacctcagacgccgttaccgagctcactatcaaaccttcatcgaaagaaaccgttgagattcctgtcactgaggttggtccttgtgtacgtgccaaattacctagaacaatctttagatgcactgatcgctgatactgattatttccctatatatgaaatttgcaacctttgtagaattccacgattggatgggagctccgggtgcttggatgggaggtgagctacggagcagagttcactcctgatgccgagggtggatacacagtcatcgtgcagaaaacgaggaaggtgcctgcaaatgaggaaccaatcatgaaaggcagcttcaaggttggcgagccaggaaagattgtgctaacgatcaacaaccctgcatcaaagaagaagaagctcctctacagatccaaggtcaagagcaccagtgagtccgtttgaggttgcagctgcctgatcaccagattcaccacaatggcagctgaactcattccctgatggaagagaaaccttttggttttggttctttaatttattggttttgctgttttggttcacattttgtatttgtttaattaaaaaccaaagtgagcttgtttttgtgatagttggaaggagagggttgatatgatataatgacatcgtgatggtttgttgagggcagaggacaaaaattgtggaaggactgaagaatatctgctgctttgtatatctgtctgtacattgcatctctggattctcatggacatgttaaatttagaagtacttgtcatcattcaccaatccatgttaccctttatatttctcctcttaatttccttgtctctcagaatctgagggaattatataatcttgatttccattctctaaccttttgcttgcccatttcctgcaagtaaggatcaattgcaaaatgatcatggtttcacttgcaaaatgagaactaccctccatccatttcttttctgtatctcctgttgactgaaaagaaaacatgttttttgacttctcccttttgtaaattacttactgcctgacttgccttaaacgaacaaacagcatgaggacaagatgtgcaggccaagcaggaaagcgattaggcatcttccaggtgtttgtgctgctaatgatggccataaactaagcgtgggtggagcaacatccagaaccttgttccaaggctgtcatcgtgtccctcaaaacaatccgccagcgccaatcagccacaggagaaacagctgttgcagataaacaaggcaaaagaacaatgcagcagtgcaagaaactctctcctctcctcctttgaccacgacagcaaaggaaagaataaaaaaaacatagggccaaaaggcctcatatccagtttggccatgtgcagtgcaagggagctttgaaaaaaattcccttggaggacgagcagaagagagctttcagctttgtgtgtgtgcgcccgggcattccggccagccatttcgacaggtttggttttgagtctcaagtgttgacaccctgtgtgttgccctcttgtctttgcttgaaccaatgagactggctagaggcaaaggtcccatacctgcatggctgcatatggctgtgtttttaatggcgagaggaagaagaagaagacgacctgatgattgatgattagtggtggcaaggcaatggcatcgacatgcaccatttgtcatgtttgacgtttgcgtgcccatttattcagcggccacaggacgtgtctccggttgtaagaaaggttgccagtatcaagatactactaggtagcatcgttttgcttaaatagtatcatatcgtagaatcatatcggaatattatgagattttctttttttacgtttaattaatacttaaattaattgcatatagccattctatataaaaaatatagtaataatatatgtcatgcaaatatagacatttatcaagagaaaccacgttggttttgatatatttaactgatttctatataaacttgagcatatttatttacattatttttaaaccatcttattttaaataatattttgtagtatcgtagggatcgtacaatcgggatatcacctaagatttcgtaggatcgtatagtaatgaatagtaggatcgagatactatgaaatttaggatactatgtgggatcggtatcgttttcacatggtagaatcgtagtatcgtaatatactattataataatcgggatattgaaaaccttgtgtaagtagggactcgcccatatgccagacagacagcaccatgagtttatttcttcctccgtgtcaaccggctgacggctggcctcaacctcacctcgcttgaggagtacttcctcctttcaaaatgtaaagtggcccactttacattttgaaaatgaaacggagtgagtgctactgataggagttgagatgagcacggtggaagcctcagtaattccgtcctcgcgcgcgcgcatgtctgggtccccgccggcggcggcggcggcggcggagatcgctctcgcgtcgtgggctaataaattggaacgcgacagagttgcaacaaggcggtgggaagtgcgcatccatgggggcagttggaacgatacttggaccagtgaccagtccggattgggctcgccgcggtgcagggaccagctatagctaagccagcgacaatctgggggccaccgattaggcgccggtccacggccacggccgtccagactgccgtacgtacaccggactccccctcccgtccccgacgaggacatggtcggtgagacgctaatagtaataacttttgaggtattttgtagtactacgttctcagtgacagtgcatttgagtagcgggttgatgcgtttgcccgtacacggacacagctcgtgcatgcgtgcgtgcgtgctgctcgctcccaactggcgtccgcgcggaccggtcacgccgcacgcgcaaccggggagacggacggacagagcggcaaggcggatctgacacgcgagcacgcgtgaggacggcgcgcgattaaaacggctccgattccttcctccctcctgcgttttttttggtcgttctccgctgctcgtctcgtcctcccgcgcgcgccgcagagggtatcatgtggccgcggactcgcggtcctcctaaccgggcgccgggcgcgtgaggcgacggggtcgcgcacgcatctcgccttgggctgggctgggcttcgcttgcagctcgaacgtgttggtgtgtgctgcggggggtttcgtgactgaggtgtccctgtcgtttctccagttcagctacacgacggatgccgcggctccactcgctggtgctggtcagtccagccaatgcttgcaggattgcggccgtgaatcacgcgcggcgtatcggcaatcaaaagactcgtactcctactctgccacgctgcccgcacgcgtacgcgatccacagcgcggtcggtggcctgagcagtgtaatcgtggatgggattcctccgtaacttggcgatgcaggtaaattaaacctgtgttggttggtgaccccatatcgtgtggctacaaagctgtttggtttatgatttgtgcaggattaggcgtgtctggtttatgcttcgtgctgcagcagcagcagcagcatcggtgcttcgtcagttcaacacaatgcctgacttgtgcaatgtccagagagcatatgagcagatccagtgctatgtcgtctagagattaatgtgctctagtacctttttttccccaagatatgacatgaaagtcacacagactgtttgccagccggtcggctgcgtgcttgcattgcaccacaaacccgtactgttaattgctaacagatgtaaggtgagcagaagccagcaattggcaatctggcatgacaaaggagagcgtcgagttatttcggctgccatcaaacacaagagctaaaaacacagcacatgatgaggataagtgagccacttcatttcaactatcagtagaccaggtacaaccagatacatttgggtacccaaatctgccagccagaccgccaacaagtagcgtgtttcgcattatgcataggtgctaaaggagatgttttcagtgctactcctgctcccaattaggcaaccgcaattaggattagcactccatttggcgaggtataaaggcgagaatataacagctaggaaatgaaagtgaatcgttttgtactccagctccaaagttgtactagtagtgagtgaagaaagaaagcagggaaaggcgaaaacctaaagcataccatgttttcgggaactgcaaaagttctgttcggtgctcgctcgctctccagttcaactcttgcatcctcactgcagattgatcatcatgaccgattgtaaatcctaaatctcctgtcgttaattatgtacctgcagatttgacagtactatattttgtgccagagcaacagaagtaccactcatcgactcaagagctgggttaagttagacagtaaaacaacattctgaaacaggctgaaaaaaactgactcacgattgcccgagaaagtgaggaaacagttgaaacctgaaagcgctgaattctgtatacacaagtagtagtactggagtactctactgaagatgggcatgacttgaaggctgaacctcggattccatttcatggcaacggttgcaaaaccgatgcccactatttgggctattaaccctttttggagccttgtatgagtatacgcgaccaaagtcaccgagattcaggccacgtgtctcggggcaacgagatgctctttcgaaaaccctttacaacgttcggtgttcatccgttgattatccttgcaacgtttaaggttgcagaattaggatatccaatgatctttttttagataatgtggttgattaataaaagaagaagcgacattagtcgcttaatgatgacagttcctgttgaagaaaaataaagggttctctgtccatgggtgttagcagatttcacaagccaaacatattactctttattatctaaaaaaacaagcatattactccggtcatacataagtgacattttagataatgacacaatcatcaatgcacttgttttacaatatagaacttatactacaacaagtatagcaaagttataatattttgaaaatatttttgagacgagtctaaccatattacttttgaatgctgaattgaaatatttaaacagaaattgacaatcaaggtttaaacatattggttgtacgcatttcaaaatgttatttatttgtgaccggagggagtagtaccctaaactgccgctacaccttaataacattgcagaatgccagaaagaaaaaaccctgaagatccaattctcactaaaagcatcggaggacacttcatatcaatatatcatcacgactgcccttcagaatgcacactttgctacttcttgaatcttcttggtttaagctatgttgatagtgtgacagacgagaagaattgagtaggcagctgtttgatgactcagtatagcttgcacataaccacgcacttggtatcaaaatgtgggttggtacttggttagatactactccttgctcttctagaaccttgaacggctactgatacaaaattacagtcctagcactagactacaacattaaccaaactgaagaggcagtacatctcacgtatgctatatctagcccagggcatgagtgacttgggggaaaacgactgtaatgctggcaatgcgatttctactctgcatctataatgaactgcatttctgaaatgatactacaacaataggccgctaaaagaagaataacttatcaggaatcccgtagcaaggagttatttgatggatccaagaatacactaatttcctctgcaaaaagaagaagaatatactaatttcagtttactcctagaaccaaccacaccaaaaagattgacttcacaagtttctgcatatagccaaggtgatccaggtactctgagttgggcaagtaaattcatctatttaatggccagtgtagaaagatttccattttcatatttttaccagaaaggatatgttacaaaattctctgaaaaaaaaactaaaaaaataccaaaacaagtgaacggcacaatcagagtgacaggaactagctatttctaactaatatttcaactaccaactcctcgtttttattgaatttacatagagattgtgatgaagaaacatggtcggtacagaatttgagttttacctgatattctgcccttcgttaaatttaaggatgaagtcagacaaaacactgctgtcgttgcaagagtcccttgtggataaccatctgtcatcaagctgaacttttacatccctgtgctaggagaaagcataagttcatttgctattaggagtgctacctacacttcaagatagacttgataaaagaaactgtaggtaagctctgcagctcagtagggcattaaaccatctatatggcaacaaagaatgaagacattaagtacttataacaatgtaggacaaccagacataagatttgaatattcatgattactgaaaaaagcatacctcttcaagctgagaacttcataatttttccgcaggtaatctgcatgcttaactagagcatcctgggcatagtccttgccaacagttctaactgcagctgtattaagcaaattttccaatgaaccatgtttctttagaagtttcactgcagttttccgaccaaaaccaggaacaaggtgctgtattcctggaataccatctgcttcatcacctatgaagcaccctgtgcagaatagcttcgatgcatcagttagctagatttcctaataatgataaaattaactttacattgtaggataatacataaaatatagacatatactcactgaggctcaaatctgcggttgggtcacacttgtactgtgcaacataatgcctcagcgtataaaaggaccaacggccaatctcaggaatgggcataactaactgaacatcttcagatatcagctgcttgaagtctttatctggtgagccaatgacaactctaaaacctttctgtaaaacttgctctgttaaggtagccactacatcatctgcctcatacccatcgactctgacgacctgaatttgccgtttgcagatttgttcagcgtcagaaactcagagctctacctaagaaaacgttgccgatttctcgattttagtaatctgtatataaaagatctggttcacctaccggaacattgcactcgcgaagaacatcgataacgcgcgaatcggcgcctgtaccagggccacgaggtcggtgcgccttgtaggacggtagcagccgccgccggtactcgttcccgccctccccgtccaaaacctaacacgaagcagagataatttcataagtgactagctgagaggagcatgtaaggacgattccttcgttggggtctgggagtgcgtgctcacggcgacgacggggtcgcggaggctgacgtgcgcgaagaagagcgcgagccagcgcgcgaaggcgccgaggctgcgctgggatccgcggaagcagagagggttgacgtcgaggaagaacacccgaggtttcgcgggcttcgcgggggcgccgtccctgcccaccagctgcttgcgggaatgcctcgctggaggcggcggtgggatggagacggcgaaggtggaaggggaggacgacgaggatacggaggcgtacggggtcacgcggaggcggagcgagcgaggtctacggggcgccgccgccgccgccgatgacgacgacgcgacgaccggagctaccggcgccgtgctcacggcgggaggtggcatcgcgatggcgctcggtttggtgggaagcggagatggggatgtggataaagggggctgaaataaaaaaataaaaaaaaggagagatccaaatattgctgggctttttactaaacttcatctaagttatgggccaaaagcccatttgctaataagctctcaaggccatgatgtatttggcccagtactgcttcctaaatacctacttcttccgtcccaaaatataactacctagtacatgatgagacattatcgtagtactaggtaatgtcccatcacgaatctggagtccagattcgtagtactagataatgtcccatcatgtaataggtagctatattttggaacggagaaagtagtataaacaaggctgagtaagttgagttgagtgagagatgtgcatgtgtgtacaaggaagatcacggcacagcagggatcaagacatgagtgaatttatgtaaataagtccaacagtgtatttacaaacagaaaataatatgtgaataaatcttttatatatgtgttcttagcaatctaaaagtaaaggctgaaaaataaacttcaatgagaaaaccctaaaatcaactacaaatttaaggttaaaaaaatcaaattttgcatgataagcataagcataagcgaaaagatgaagcttttagataaaatgaataagttctctctctaggtccctcaatttatcgtccaatatgatttttttttgtcctcggtctagaaaataggatacaaagcatcttccaacttataaaactgtacaaacgagtttcctcatcagtattgactccggttttagctaacgtggcgcatacatggatcatttgactagtttttcgttgccacgtggcattaacatagtgtttgcatggcaattcaatgcggaaaaataataaaatatgtggggcccacatatcggttacacaaacaaaacaaaaaaacaagtgggcccatgtggccacacatgtcatcatcactacttccctcttctctctatatttctagttttcttttcctttttgttttttcttgcttcttccccgatggcatccggcggctagccgtgagcagcaaagagaagggcggccaatgggagcgccgcgccgccggagtgggagatgtcacgtggaggtcggtgttggtgtcagccatggagcgcgcaagctcggtggcaaagatgaagccgttgtcatcgcggtcaaaggcccttcctgtcaacgatgtcatcgccgctaccgacctcccaaccccctcaccagcctcgccaagaggaggtcgagcgagtggatccgcgacgattaggtgtgaattttttgcgcgtgacgtgtgtgaaaatttctttctagcaatttttcccttcatgcataaatttcaggatgatccgatgatcacaaatctaaaagtttcgagggtaaaaaacttgcgaaagttttctagcaatatatggaccgccataaagtatatgggtcgaaacctttattctcatctctaacctaccccgtcccaaaaaaaaaagactaaccctagtatgtgtccggatttgtttgctaggattgggttttttatgggacggaacagtaaaaactttgcaaccatgtacctctactagtgaaagtattcagagggagacatatcacggcgtgacaaaaccgacaagtattcatgtactatcttttgaaaataactttattcttttagacattgttattatcgtttcccggcttgaatccaaccagtaatacgctgaaatatcctagacttgatttgtggtacagattcactgaacctggactaggttgtctggctagcaacaacagggaaagttcagtgtatctatgacctgtgacagtgaagaccagaagctagacttcttttgatgcttatgctttgccggcaagtctcttttgcccgttttctgtggtaagtaggagtacaaaattctattaatgcttattttacgttacaattccattaattttagtagcgaaaaagattagtcctgataataaacattgtttgatgtaaacccagctggtacagtactgtactactgctaccacctttatcctaaaatatagaatgagactcactattggactatgaatctggatatactttatgtccgtattcatagtcgataggtctcatcgttactatattttgagtcggagggagtatttttgaaaggatccctcctggtacttctgttttcactgaagcggttggtacg

SEQ ID NO: 70907 - DNA, 4219 bp, Oryza sativa
aaaatgaatgcccgtagcgatgattaaccagcgacaaaataaatgctcatcgtcagcattggttgatttggctccactgctaaatccaacaaaattccctcattccacacgacggttttttagatttacttggaataacatctagccatacaaatgtgcagagaatactatgtcaaaaaaaaaaaagatgaaaatgagacagctaacatttcctttattgccacggcagttttttctccctattgcaaaccaagtggctgatggagaagaaattatgaattttctacgtccgtgcatggacagtgaatggcgtgtctcttctgcatgacgctcctggttgagtgtgcttccctgcgaccagatcaatggagtctggagttagaattctatggaggcgatacaagacaaatggatccatatgtccctgctatactactgctataaattatatatattgcttcattaggcacgcttttctatcatgcttccttgattggggagtttagttcgaagtgactattttcatcttaaaatataacaacggttagctatgtatttaatatacctttttttaatatagaacatactccttccgtcccaaaatataagcatttttactataatgacaagtcaaacattttttaattttaactattaataataataaatatcaatcatataaaattgatgttactagatttatcattaaacaaactatcataatatgcaactatttttatttaaaacaacttacttttatagatagcatctcggagaccgtgtcggagaccaaaattgcttatattttgggacggagtgagtatgtagtaattactacataagtttattttaaccaccactatatactccttccatattcgtaaaggaagtcgtttaggacaatgtttaagtcaaactttagaaatataaatcatgaataactctcaaattgttgagtttgaaaaatataaaaattatataaatagatttgtcttgaaaaatacattcataaaagtatacatatatcattttttaataaatatttttatagaaacaagaagtcaaagttgtattttggagatcatgtcactgtccaaaatgactttctttacgagtacggagggagtataagacatcggtttatgtgatccctttttataacaatggtgatacaacgacgattttgtagtaacggtgaaatgaggaccggtaggctttagattaagcacatacgtggactcttcagagtactaatagttaagaggggtaaatgaccaaatttgtacgttgatttggacgggtagatctaagacgttttaccgtagttctgatgtgcttctaaaaacaagtttaataatatagaaataattgacatatcgtctacgaccaacctaatatcccactcatatgatagttaataataaatatatactacattattaatatctggtccacctctctcatatagtttattataattcgtgtgcttaattttcttccctctcattttctatttcatccacgtaaatacaaataatatgatattattacaacctatataacccttctacatcatatttgtattccttgtaattattcattatagtggtaatcatgttttcgggcttttttcttttttctgctagtgttttacacgtaaaaccatatcatatcccagcacatccatgaccccttcacttggtattggcaacaccggtgatgctactacacggtagagcatccttcgccgccgtgtcagcatctcgccggcgatctccattccacccaaccgccagaacaccggcgaggtgatgcgctgccgatccctcgcatatcttcggtcttcaccgtcgcacgtatttgccaatggaaatatctagaaaactacagtaagttttaaggttctatgagtgaaaaacttatatatatatatatatatatatatatatatatatatatatatatatatatatatatatatatatatatgtaattatagtataattaaaataaaactacactataaatgcactctaactatactctgtactataattatgatataaattatataaaacgtatattcatctatggtttgtttggttagtactgggattttacggtaacatgtgtaaaaattttgttctagcaatttttttctcttcatacataaatctcaagatgatccaatgatcataaatttaaaagttttaagggaaaaaaaacttgtgaaaattttctaacaattccgtttgcggataccacacatgcgccgcgtacgttctggtcgtcagtgatctcgaacctgtcaatagtctgcacaccgaaccaagaaaccaacccgacaccctgctcgatcgttttggacttggtctgcgtccacagaaacaataatgcgatatgccacgcgacgcgacgcgatgcgctgcgcgctgcacatggcgccgtcgtcgtcgccgccatcgctgtctgatcgtcatccttgctccgggggagaaagaaaccgcatgatttggggggatccggaccggttcaaaggcagaggctaggagagggaggaccggttcaaaggtttggccgttctaacgaaaaaaattgtgctctgaatttgcagccagttgcaatcagtatcctagctgtggtggattttgaagagatcaaatttggagctattgctatactttaactccatgtgggaaacatcttctggcaacatattccttgagcttggcagaagctcaaggtgtcgctcttgtgacagccaagttcttgtttggaatggggcagacttttccccgttttctgcaggaactaaacatttactacggcgagaattcttgggtttcaaatgagccaagaaaggttttgctcaatgaattctgttcatggtacatagggcttgttatatagaaacagttggttggtagctagccaagaacctagaaaaccagcttctaatttctagtttgtttttttggtttcgtaactacagcttctcagttactgaacgtattgcttgttttgatggtcagaaattacatgctgctcagtgttctgctgtgatgcttatgttaaactgatcttgcctgacactgccagccaatcaactaacaacgcaacgaaattattcataaattggataattactgcaaatccactacaatcctaacaggaacaaggatttgacctgaatactttccaaccttgtttgcaaataaaaaatactactccctccgttttacaatgtaagtcattctagcattttctacattcatattgatactaataaatctagacatatacaatgtaagtcattctagcattttctacattcatattgatgtcattctagcattttctacattcatattgatgatctagagcatcaatatgaatgtagaaaatgctagaatgacttatattgtaaaacggaggaagtaacaagttgtcgcgtagaaagagttactactactgaagatatctgcttttcaccgaactgatgagcctctgaggccattggcactttggcggaaagaaagctacaatttgggactttgttgctcacttcagtcatgtccgtcactctctttgcaggggcaaaggggaaggcttgaagctaacgtttggaatcactgaccaagtgagtgtgttcagatcactgtaatttcacctgcttgtcttcaaaaggtcaatcttctttaagactaagcagaatctgcctcgtgatcttaagccggaaattttcggtatgcaacaggtgacctgtgatctctccttcttttcttgttcttctttacctccctcactttgtgtaagttgcattttttaatttagtgatcaaggtttttgctataataggttagttcaacgcggaataatgactactaactttaccgatctttcctactattgatctgctaagacatgtcggataacgacatagaaaacaatcatctttgtggccggattagtgtagcaacgactaaaaacttagccatgtttaccgtgttcgacagagaagctaaatgtgacaagtgcatccacttgctgtcaagtggcacgatggataaccagatataaacaaccaaggttctttcactagttatgttccttttcctacagggacaaattaaggaaatggctgggaaggctgacctggtacaagaaaaagacagcaaaaagagtagatatttatgttgactaggaaccatggatagct

SEQ ID NO: 70908 - DNA, 852 bp, Oryza sativa
tagcatgtgtatctcatcttctaaattctcatgtgaattgggtagcaaaaatgtcgaaacaagatttcggcaatacgaaaagagggtggctatcaagctggaaaagtgaatgggttaagaaacaaggaattttatacaagttcaggccctctctatgagaagtaataccatacttctgtccggggattgatccgccgagtatgttattgatcgtatgatctgggagaaaagttatatcctaagaggcacccagacccctccttatatagagggaggagtccgtattatattcttaacggaataggcaagtaaattttaaatacaatcgtaaacgactaggatcccgggtatttccttgatacacaagttaggaatttaacccgaatcccttaaagatattctatctacatatagtacccatatacccagtcggatatacatgccatgcgggtatggggtatccataatctccaaaaaaacaactagatgattagagaaaaaaaagtggctaatttgtttgtgtatttaaaatgtgtataataagtttttttttctaaaattcagttgtaacataccgacattcagctagtaattccttaaaaaaaattccaaccagcggtggatcccgctgttaggcgcctgcttcaggatccgccacaatgttgccactgtcaatcgctgaaattcctatgaacagttacggtaggaggttaggcagtagagtgatcttatcgttgggcttgttttttgggacaagttaaaggctgtatgatcccctgttattcttcaattcctaaaattatttccttctttcctacttggtgtggaatcttggatttaaggggtggacat

SEQ ID NO: 70909 - DNA, 4313 bp, Oryza sativa
ccgccgagggcgaggcggtgcctgcgcgcgctgatgatggagagcgggagcgacacggaggcggcaccgaagccgaagacgaagccaaagccgaagccgagctcgtgccggttccagtgcgtcgcggatcacaagccgccgccgccgccgccggcgacgaccagcaacggcggcggcggcggcggtggtggcgacgggaggagcggagaagaaggcgggaaagagaacacgaggtaaaaattgaaatgcgtgcgtaatttacgaaattgaagacagtgtgtgctttgatttgtaatggttttgtgtaaatttgaaatgaattcttctgggacaacgaaatgaaatcgcattaataataagctggtttgagatcagaagagcgagaaattaagctgcattcgttttgtaaaatgctgctatatcaatgattcaacagcaatggttatctcaatgtctgacaggctaacagcactaagatcaaatgatcattgatcaatggtaccttgtctatttcatatcagaaagtgagatacatttctgaataaatataagtatgtatcaacttttgagcgcttctttttcgaacatggagatattctcctattcctgcaacaattaaactgtaaaatatgaaattcatgtgaaaattcatcgaaatttctagatttcaaacaaatgccttagcattcaggtgagagcaggaatatgggagagaacagaaatacagaagatcgagaaaagaatcaaaagaaaatatgcgtggagatatcctccagccgaggcctttcagtcgttcaaaaggcatatcccagaataaatttgttcggaagggacaattgcattttgtgcctccctgaaggccacaaaaacatgctacgcgaagcatcaaggatcttctctacagacttggcctaggctcatgtgtgtgcttttgttaaagagacggagtagcatgccggtattgcacatttgctgatttgcacagttgctgtggttcatgagatgaaaagaaaagataactgaactgctctaacttacctacacatctatatttttaattgaattcggttggtaagaacttccagcttaaaaataatatgaacgcggtcaatctcgattgaaacatgcaagttcacttcctccgcctgatcacccggcgccatcgcccgacctcgccagcgcatgaaaaaggccaagagtgtcagcaaggcccaccataccccccctcctccgccttcttagctgtcctccttaagtcaacaacgctacccccatctcgtcgtcttccttgtcttcggcaactccctctcctcctaaccactctttttactttgccctcaccgctaatacaggtccaccgtttgccgcacatcacgcgtggaggcggatctgtagggtggttcgggtggtccctggatcataaaaaaaatcacaaccaacccctctactatatataatttcagaaaaaaaagaagaaaagaaaccaaaacaaagtgccgctacgtttaggtaattgcggcatcggcacatcgtgttggattggatgccacgtcttccgcgccccgcccgtgattccgcaccgcatcaaccaacaagtcgacccgtcgccgagtccgagactccgatcgccacctctcgccgtcgctgatttgacacgcaaccatgccagagtgggcgaataccatgctcctctctcttctcatgtgaggttgcaactcatgaactcagcaaagaggcggttgatctcttggcaccgatttctatctccgcggtgagcactaggtgcaaggccgaagcagtgctggcagcacctacaagtctccaaatctgcaggtacaagctcccgtgttctctctctctttctctttttcatatctcctttctacaatctgcattgttcttgcctgaaatccatgtgctctgctgtaatatatgcttctactgtgcaatagtaatacaacaccgaccagaactaatgccaaagagatcatagattcaaagttgatctcatgtcgctgctaggtaattcggttctgttttattaacgtgtgtgtactgattcggtgaaacaaccaccgagttgatctactgaaatgtagtgcttgttgatctgctgcagtgcagtgctaattgatctcacccttaaaatgaaattaattggtgtcgaaaaaaagaaattaattgtttatatgtacttctatacattttgtgagtcggaccacctataccctaaattttagatacatcactaatcacgttgcttcgatgacacctccttcttgttccgccgcctaacttccccctcttcctcctcccccaaccccccttcccccctaaccccaacctaagatgctaaccgatcggtttgccaccatcatgccgaaatccccattatctcatcggagctaaagccaaaatccccactattcatcttcctttgatctggtttagttcctaaaattttttttctcaaaaatatcacatcgaatctttggacacatgcatggagcattaaatatagataaaaacaaaaactaaattgcacagttcgcatggaaatcacaagacgaatattttgagcctaattagtccatgattaaccataagtgctacagtaacccacatgtgctaatgacggcttaattaagctcaaaagattcgtctcgcggtttccaagcgagttatgaaattatatttttcattctatccaaaaaccatttccaacatccagtcaaatatgcgatgtaacacacaaaaattttcttttcgcgaattaaatacacatttctttttttttttcaaaaaagaacatgaagaaaaggcacaatgatgacaacagacagtttcccacagaagatccaagacgcctgccactctaaactaggcaaaacacctccgaagtctcagctcagcttctcccctcctcaaccaagcagaaatggcggcttcttgcgcgctcaccctcccctccgccatctccgtctctgtctccgtctcctccaattcacctcgacggttcaggtactaatctctgtgcccctgacctgtactggttcaagtcgatctcctgtgcgtgcgaaggattgatccctggtggtggtgtctgtgttttttggggggcgttcttggatggatgcaggcgctctaggagggtggtggccatggccagcgtggggcagaggtgtacgcgcccggcgtggcggtctccgagggcaatggcgggctgccaaagatcgacctcaagtccccgcatgggaggtaattctaggtttggttgatttggggtttctttttattttaaggtgaaatatttggggtggataacttgtgtgagattcttggagggattgtggtagtttggtttgtgagtaggaatgttagatgtatggtgccaaaggtggaggaacttggttgtgtttgtttgcttgttttttttttttttttttgtagagatgggataaatatttgtactgcattgaactgggtaatgcagcatgagtagcagaagaactgattcggagaataatttaccattcggttgcttttagtttctggatatttctctggccagtactcaaaaactggaaaagaaatgaatttttagaatggtgattttgtatggtttggtcttcttattttctacaacgtacttgattgttggactgtgaagattacggaagtggtttcacaaggctggaatggaaggttcattgttcagaatttggcgctgtgagatggaactgtgcactacataatataatcatacagttgctatgatactgaaaagctttgagatatactgagagaacaaaatggtttcagtgaaaaatgaagcaggagcatttgccacgtgttttcaaaaacacacagatgtcacaatgatttattgtgcaacttgccattcaagtccaatcttttccattgtgctgtgtgattagtcagctagtacaaaataacactacgagccatgaattgctagagttggataatcttgaaataatattgaatggtccagatttgtataatttgggatcttgggtacctcctaacttacccttcaaagtttcaagttactatcggtttctttcaattgacacaacaaaggtgtgttatcaggttttgtactttttttcaatttgttaattatgtgctcattttatgcatgaagtgaggctgaaatttatctatttggagcctgcgtaacatcttggaaagtccccagtggaaaagacctcctatttgtcagaccagatgcggtgttcaacggccagaaacccatcaggttggcgctgaagtttaggataaattatctg

SEQ ID NO: 70910 - DNA, 11170 bp, Oryza sativa
aaagaaaaagaaaaaggaaaaaggattttccctggaataaaatattgcttgctcaattttaattggttgaaattatttctagagctctgaaaattccactaaaaatcctgttaatgaattttgacatgtagaactcaagaaaaattccacatgtcaagtccgattgttatttgcattactttcttaaggttttctcctgatttcacctgcattttcttggggtcatttgaaaattacaattttggcttgggaggaaaacttcggggtgtgacaaacctaccccccttaaacggaatctcggccccgagattcggaggagctggtgaagagatgcggatgggcggctttcaactcatcttccctttcccaggttgcttcctcttccgaatgatgactccactgaactcggcaaaaccgggtaaccttgtttctggttctcctttcgctggtatcaagtatgcgaaccggcttctccacataagttaggtcctcctggatattaatgtgttccgaatcagcctgttcttcaggtacccttaaacacttctttaattgggacacgtggaacacgtcatggatgccgatcatgttggatggaagttctagctgataagcaacttctccccttcgttccaagattttgtatggtcccacgaagcgtggtgccaacttgcctttcgtctgaaaacgatgtactccccggagcggagtgacacgaagatacacataatcccctgcttcgaaagtaagctctcttcggcggttatcagcataactcttttgccgagactgggcgattcgcagtcttttcctgacggtcctgactttctcctctgcttcggttaacacttctgtcccaaacagttggcgctcacctgtttgatcccagaaaagtggtgtgcggcactttcgtccgtacaatgcttcaaacggtgccatttgcaaactggactgttagctgttgttgtaagagaattccgcatacggtagacttttatcccaggctccaccaaagtcaagtgcacaagctctcaacatatcttccaagatttgatttactcgctcggtctgaccatctgtttgtggatgataagccgtgctgaaattcaaacgagtccccaattcttcttgcagtttctgccaaaactttgaagtgaattgacttcctcgatcagatacaatcttcttaggtaccccatgcaaacacatgattcttgaaagataaagctctgccaaccttttcccagtataggtagtgtgtactggaataaaatgagcaactttggtgagtcgatccacgaccacccagattgaatcgtgccccgacgatgttctgggcaaacctgttatgaaatccattccgatttcttcccatttccattccgggatctgaaggggttgtagcagtcctgcgggcctctgatgttctgctttgactcgctgacaaacatcgcagagtgcgacgaattcggctatctctcttctcatgctgacccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccatgctcatcctcatggaaatctcgggcttttccgaccctcatatttttttttagctcagctatttcaggatcatttacctgagctgctctgacttgatccacgagcgtaggccgggcctctagggcagctacgtatccgtgttctacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggcctcatgtggacgcaactgtcgcgaagcatatgcaaccactctgccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccatttgaatttttcatctttctttagcaactgtgtcatgggcctggcaatcttagagaaattttcgatgaaccgacggtaatagcccgcaagtccaagaaaactccggatctgagaaactgtctttggtggggtccactttgtaactgactccacatttgatggatccactgccacgccttgagcagaaatgatgtgacccagaaatttgacctccgataaccagaagtcacacttgctaaacttggcatatagctggtgctccttcaaaatctcgagtaccaggcggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgtgataatccacgcacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttctcccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctaactgaactgacacagctggcggatctgactgagctggtgccattagtgggggtggagtcgagttgtggttgtgctgcttactgttgttgtgactgccaccattgtaatcgttgttgaagttactcgggcgatagggacggtgctgacagacgatcagggtggaaggcccacctagctgtcccgtcatgaaacgaggcttctgattgttcccctgaggaaagctgatctgagctgtctttctttttcggtctattttgttgcgttgctcttcctggcggatagccttgtccacaagcttctcaaagtcctcatagactccggagattagttggttggtcaattcatcatcgagcccaaacaaaaacttctcctgcttctcagcatcggtgcgcacgtcctcgggagcgtagcgcgcgaggcggttgaactcgtgcaggtactctgtaaccgttctggttccttgttgcaatgcacggaactctctcttctgttgtgccataatcccttcgggaatctgtgccttcctgaagctttgacaaaactctgcccaagtaacctccgttgcatctggacgggtcaccacgtagtgatcccaccaagcagaagcaggaccttgcaactgatgtgtagcaaaagcaaccttctctcggtcgttacattgcagaaggatcagcttcttctcaatagcacgaagccagtcgttggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgccactggcgtcgttggagtcacggggatcgtcccttgtcttcaccatctggaggaggataggtagaaataagagaaaggaagaaaacagacggctcggaaactaatctttcttataagattaagtgcaatcatcttaatcttgattaaaacactgaaaaagaggcacacaactcctaataaaggctgtcataccactcacacatgatatcgactgccgactaacccacaagcaacaaacctaaacacaaaaactagcacgcaaacagactaagaagacgataaagctaagggtggcgactctgaagcttggagcggcgcttgcgatcggagaataggtctgacatctaaagagtacagagggataggaatcaatgcatgctcaaatccaaatttaaataaagcaataaaagactcaaataagggaaacgaataaaagcgaaattttatgcatagatcattttgcatgagagcgaataaataagacagactcacataatgacaaaataatgagaaattagatacatattaataataacaaacgaagcataaacaccttgcaacccatgttatagagctaggacctaatgcatttcacccatcaaaccccaactgtctgacgaataaatcccaataattttactaaaaccctagactgacttgttttgaaaaaccccacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgtataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccagagctattgccaataatcaagtctatgctttaatgtggtccccttttatgcactagttgaactaagcatggctaagcatctcctaaaccaacatctagtcattttaatacccaagttatcaatggcataaggaaaacaacatatagctgagtaataggacccatcccacatgatattgtaaaacaatgcaatatttaatagaaatgcgggacatttgtaaattaggtacaatatgatcaattgtattgcatgacttgccttgctctcgcaatgatggaaccacagcaacgtcttcgagaaaccacggatcgacgaaacggccgaaatctacgcgacaaacaaagcacacaagcaaaacatgctataagactactgaaacagataacaaagccatttttaatggattctacacatttttatgaatttactgagacttgaatggacttaatcggagctcggatgaattagttatgaattttagaagattcactgtgtttttactaataaagaaaaagtccttaattaattattgcgcaatatattccagggctgacgtcagcacaggcggctcggcgccgacatgcggggcccaccggtcagcgacacgggagatggaaggggcggcggctccacgtggcggccgaaccgacggccccgatctacccaagggtagatcggacggcggtgggagctcgcggccggggcgcgcgggcacggcgcaagccgaaccggcgaccatggcgccggcggcgcagcgctcacgcggcggcggtgcgcatgcggcagcggcgcaaggcgacggccgacggcgaccgaccggcggcggagagcggcggctagaggaggagcggcggctacgcagctaggcggcgacgcggcggctaaacggtgcgggagagagaaaacgaggaggagggcctcaccgacaacggtcgacgacggcgggcgacggaggacgatggcgacggcgggacgagctccggaacctcctaacgaacaaaaggagagggattagagggagagggaagagcgcgagagagcgagagcgccggccgaaggcggcggccatggcgtcactcaccggcgcacgacggggatgggtctccggcggcgaacctcaacggggaaggggcggacgaggtagatctcgaccccgcgaatctaacggcggcgacggcgcaagacggcggcgagcctagcggcggctagcggcgcccggagagcggaaaaaggcggcggcaaggggttgcacggcgcgggagcgatggggagctcgggagaggtcggcgaaatggggaaaaagcgagagggggtgccggcgatgcttaaatagggggagagggaaccggacgtggccgggagcggcgggaatcgccggccgacgcgggggagtggggaggagagagaggcgggattcggttttcgaatcccggccatctcgggcgcgggcgcgagcgggagagagaggggaatgggcgcgggagacgcggcgcacgcgcgggcgtggtcgacgtggcccgaggaaggcggagacgtgggcgcggcgacggttgcgggcgcggcggcgcgagcgggagaggcgggaggtgggagacgggtccgacaggtgggtcccacctgtcggcgaccccgggagggagggaggcgggcggccggctgccggctgggcctcggcctgcggccggcccaacagagaggagggggaggaaaaggagaaatgggccgacggcccatttgacaaaaaggaggaaaaagagaggaaaaagaaaaagaaaaaggaaaaaggattttccctggaataaaatattgcttgctcaattttaattggttgaaattatttctagagctctgaaaattccactaaaaatcctgttaatgaattttgacatgtagaactcaagaaaaattccacatgtcaagtccgattattatttgcattactttcttagggttttctcctgatttcacctgcattttcttggggtcatttgaaaattacaattttggcttgggaggaaaacttcggggtgtgacagctgcccaagccttggagttgatggatcgcatgctaaaactcaaagaacaaggcttacaaggagagcagattactcggcattttatcaaatgccgattggcaccaattaaagaaagatcccgtacggcattcgagtttgacggcaagcatgatcctaatcgtgaagaaccagactctctggattttaaaatcttgaaggagagaatgtataaaatcttctcaaacgctattgtcgtcagctactcacatcagctgccagttgtgccatataacgcattcaatccgcctccgcaggtatgtatccgaaatcttcaacccatgaccaaaacataatcttgtcttcatgttgagttaactaaccgtagaggtatcttattcaggaatatgtattgatgaagtctgaccccccaatcactcagcgccggtctcctcgccaacacaccgttcagggaggtggagggccaacaatcagatcagatccgcaacctcaaacctccaatccgactggacagacaggttctcgcaagagaaagctggtgcttaacgacgacgaaggcgacgacggcaacaaatctgggaacaaagacttgcccaaaaaactcccaaagcataccactcccaggaaaaaactggctggccgcccaatgccaaagattagaacatcttccaggtataaacctctcggtaccatttccctttgacatgcttctctcatagaaataatactgaatattgaaaggacactttgcaggaaaccatccgacatagatccaactggaaaagatcttgatccggctgtgacagagccaagttcatccaaggattctgagccgactgccgagagccagccgactggcgcccatacttcaggtgataaagccaatccgagtgaccagcctccaactggaaaccagtcggcagcaactgaaactacgacaactcaagagcccccgactggaaaccagtcggatgtaggtccagatcaagaaattcccgaagttgaagcgcagacgacgacttctcaaggacctgaggctggtaacgactcgatgattgggtctccaaataaagaacaaggatcacctcacgctcagctaggaacaccctcaggtaactcatcttctcaagtgatgccagtttgaacaactcttacttattcgcctaacgtcttggaaatacatcaggaccaccaggcgatgacgaagaagaaattccccgcataaaggcggctgacgactctcgccctcctatcttactcaaatggtgggacgagaactcacaagctgccggcatcgtcataaatcgtcaaaaagaagatgaggaagtgtgccagctgaagaaggcgcttggagaagccactcgtattgtgaatgtaaatcttccaggcgactgcctttgatgactttgttttctctttagcagaactaaaccatgaaccatcatgcagagaatccatcttcgcaatgaggccaagaccgcaactttagaaaagctggttcctcatttgggaactcttgaagcagttagggaccagctacatgaggccaaggagcttgccaaaaagacagagaaggaattaagggaccgaattgctcagctccaggattcaaacttcgagctgagtggttcatcaaaaggtaatctctagatctgtcccattaagttacgctgtcagaactatatcctcaaccgttcggattgcaaacagcgcaagccaccaggatggctcaaatggagaaacaaattgaagccttgaaaagagacaaagtagaactggctgcgcaaagggactcggccttgaaggaggttgaaggtaccgccagctgacaatctaaacttctctctttttaatgcagtagatttttaccataaatgtgttttgtagaccgcaaaatcaaatctcaagctcaatttgacgtcctggttggtaagatcaagaggcttgaaggagcaagagatgaagttgctaatgtcgctacaccacttgtccaagctatgttcctcaataacagtggtccgagtgcactcgacgcaaccgaaatcttcgacaagctgagagttgctccggatgtatatttcaagaatatcaagaaagctggaagtatgggagctagcatggcattggcgatgaccaaatccttgtacccaaggattgaaattgacgccattgatggctttgcagacgggacaagcgaagaagctgctcttgatcttatcagcaatgctcaaaacgcggctgacaagattgcaaatgacgttgtagaacaattccgcaataccgaccttcagccgagtagtaacaattctgatgatgaaaagactgattctgactgagtataaatgtaacaaatggaggctcaacttgtacaatactggtgtatttatgctgtgcttgataattctggccaagtcgttgatttcttaaaagctttta

SEQ ID NO: 70911 - DNA, 9307 bp, Oryza sativa
  unsure (1)..(9307): unsure at all n locations
ttctcagtgcttttctggatttcatcagagatatggtacgtacatcggtgtattgcagaccgcatgcgagcaatcctagtcattagaaggaattagttaaatattgcaagtaaaagaatttaaatatattaattgtgtggagcattaccggtcagtatatatgcactagcagcttctcccttatttgcagttgttctttaccatttatcttgtacgagttgtacgcgctgtaaggatattagcaattcatattaagtcgagatttaattataattcatcaaaagtacacatgcatggatcaaaatcacttactattgttagaaattatatgtacatcccgtgattataatcaagggtagataagaaacaaatctaatgatcaatacatagtaacgatgatgcagttagtcacggatgaagtaacacagatatgtaatctatgggacttacttaaaattgtatgcggccattatgacttttttgttgaaatttcaagaaagctcgtcccatgtactgcaccccagtaagcaacttagttttgtgcaagcccttgatgtattctgctatcttttcgggcctcttaaccatttcaattaatttaaatacttcatcccggtatgacggcaaaagcctcggcgtatgatacatccattggcgcatgtccttatctctagaaanaattatttataactatatntaaaaaaattcttaaacaacaaatatttgtaaacaaacttaagttcgccttaaaggatagagaaatattaataactaagggatgggaatctatgaatttctcgtaaatacaatacactttttttttacatagacctagggatgaaaaaaaatttcctctctcctatctagatctaggaaatgaggaaatggatgagaacaaaatacatcattttgggtaattaaattgtcgcattcaaccactagaggatgactgcgaccacatgccatcatatagtatacatagatccaacataattttttttacatagacctaggggatggaaagtaaacataatacacttatttttttacatagacctaggggatggaaaattttctctctcctatctgatataggaaatggatgggagcaaaatacatcattttgggaaaattcaaccactagaggatgagaggatcatagcatcaaggagtatacatgaacccaacacaatcatatcaaaggaaagtataggaaaaaaagaaaagaaaaaacatggtgcttttttttcactattttgcatgcacggatccatcacaaagggatgtttaaagggatgtttaaagttataaaaaaatgagtagtaagagtggaaaggcatatatctaaccaccgtagaaaaatcattcgaaaatttggagttcaaaaccttcccccctatattttgtttgttttcggagagaaaaacttcggaagaatgaacaagtgctcaaggagaaaaaaaggctatatagcctcatttttgcaggcggaccacataaggtggtgcctacaaagataaattttcgcaggtggaccacataaggcgtccgcctaaaattatcgcaggcggcgccttatgttgtccgcctaaaaaatctatcttcgcatgcgaacgacgatgtcgcccctggttactattttcgtagacagccatttcgctccgagagacctacccgcctagaaaaaaaatgccatcgtctgaaaaaaaatggtttttctagtagtgcttgttctcccttgctctcccccatcatcgatctcctatagtctctacttcgccgccaccgcgctggccacccactgcagggcgccactttcgccttcgcactgatgaacttcgagcagatgctgatccatatctattatatactaaaagtccattaaactctctacaaacgctctaaaaccgtcacgtggcactcctacaaacgttctcaagccgccacatggcacagtaatctcaccgtcgattttcacttaaattggtggacccgttattttacacaattagattagatttattattaaatataatagcttcctcctctatggaggatacaaacggtgtaggatcgtaaagggtaaagggtctttcccaccccaaaagctagccattgaggtgaggggctcctccacttatatcttaggtcctttgcccttcctaggggtggacaggaagctcatggctcgttagctcgctcggctcgtgacaggctcggctcggctcggctcggctcggctcgtttgaatttcctaacgagccgagctggcatttcagctcttagagataacgagccagctcgagctggctcgcgagccgctcgcgagccttaacgagccagagcagatgaggcccaggcgcctagcccagcccaacagcccatcacccagcccatcaccttgtgaaaaccctagagtcaatccccttctggcttgtccccatcctcaatccccacccaagccgccgccggcctcatggctgccgctcgcccgcgcctatcctccccggcgccgacgccgccgcccccgcctctcctccccgacgccgacgccgtcggccgtggacgccttcgcccgcgccgctccttcccgccaccgccgccaccgcccgcgcctctcctccccggcgccgacgcggccggccgtggacgccgccgcccgcgccgctcctccccagcaccgacgctgccgtggacgccgccgctcgcgccgctcctccccggcgctgacgcaaccaaccgtggacgccgccgcccgcggcagtcctccccggcgccgacaccgtcatggacgctgctggccgcgccgctcctccccggcgccccttctcggctcctccccttgttcgctttctctcttgtccccaaagctcacgagcctaacgagctggctcgagctttcaaacaagccgagccgagctgggtttctagctcgttaggataacgagccgagccgagctagctcgttatcctaacgagctagaccgagccgagccgagccgagccgagccagctcgacatccacccctagcccttccacaaccaatgtgggactattcaacaatctcccccttcacacattcaacaatctccactattcaacaatctcccccttcacatattggtgtcccttagcccttcaccgtgtatagaccccacagagcaggccaacggtccatcaggtatacgggccacgcaggcacccacggtccattagaccttcacacactgtgtccatcgggctagagatgttaacctagccaggctctgataccaattataggattgtaaagggcccactggtggagaaaccatctttggtcggtcggccaaaatccacaatagtcccggttgcaataaaaaccgggactaaaaatgatctttagtcccggttaaaaacatcacagctagtttatgaaccaaccgggactaaaaatcatctttactcccggttcatcccatgtcagtagtctgtcagggggccgaggatctttagtcccggttggtgacaccaaccaggagtaaagatcatctttatagtctcggttgataatacaaaccgagactaaaaattatattgatctttagtcccggttagtattaccaatcgagactaaaatttaatacgtagtatataatgcctatcccttatcctctcctacacttcatagatccgttccacttcctcttcacagatctaactcctcctcccctcctcacttcccatccgccccttctcctcctctcctcccttcccattcgatccggtggccggcggccggcggggccacggcggcgacggccgtgacgggcggcggctggaggggccgcgcccggcggcgaccatggcgggcggcggcggtgccacgcggggcggcggccatggcgggcagcggcggtgccgtgcgtggcggcggccggcggggccacgcccggcagcagaggcgggcggccggcgggggcgaaaaggatgttgagtgcactgccaccatcgatgagggatctgtgaagcttgacgttgtgaaccactaggtctagtaccagggggtaccgccccgggtggaccactcggtcaggatgatccgagcggtcaaacttaattgttgtctctaaccaccgaaagatattggggcatatcgggctggaacagcgttgatctcccgtttggtcagcttttgctttctcttagattcataagccaagggtcccccaaagatgtggttgagttccttgcggtggtcttgaaaaccagtcggggcatcaccttcatcatccttcttctttgacgtgctttgatctccgtcggaggccttacgtgcgttcttggtgtattgttttgcaaactgtttgtagacgaaacaatctttggccgcgtgattggaattgggatgatgcggatattgggagttcatgatcttgtcaaaagtgttgatgcgcgaatgttgtcgggaggatggtgtagtagttgccacaagttcctcgggcttacgcttgcgatccttgtgattggtacttccagtctcccctgtagtcggcgtatctttcttcggcttccaagtggtgcctgactgcttggacgcggtaatggcatcttcggctttggcatattcgttggctttttcggacatctgcttgactgtcttgggaggcttgcgcccgaacttgccgactaggtcttcgtggcgaatgcccttggtgaaggcggtgatgatgacgtcgtcggtaatgtcagagatcttgttacgttgctcggaaaagcgtcggatgtaatctcgaagggattctccagacttctgaatgacgttgtagagatcaaaatgtgtaccagggcgttcaaaggtaccctggaagttggcgatgaagtgttcgccaagtttcgcccatgatccgattgtaccacggggtaacccgtgaagacaggactgggcagaatccgctagggccataggcaaatagtttgccatggctttgctgtctcctcccgctacgcgaattgcgagaccgtagacggtgagccaggactccgggttagtggtgccgtcatacttctcgattccagtcggcttgaagccggctggtcaatccactcaacgcaggtcgcttgtgaaggcagtgactccatccacgtcgtcgtcgtagcgatctggtgaatggtggggagcgtagcctattgtcgcgcggcgctggttgatagtatcgcgaaaatcgacggggcgcttgcgaggtggggagcgtggtcgttcaactcgacgctccctgtgtagttcgggaagcgagtggacagatcgctcgtcatgacccctgctcctgcgactggatctcgcgccggcgacgctgaggcttggttggtgatagtcttgagatcgaagaggagaaactcggctgctagtcagcgtgctgacgcttgcagagttaaccgggaccgaggcggcgatcatggtcttggtctggttcaagatgttgacgacgtgattgggttgattgagtgcgtcttccttgaggagggtgtcgaggagggtgatcgctgcaaccgcgttctgttgaggggtgcgaaaaaccgcagtttcctcgacgtcttgctgcccgataagttctcgtgcttgtcacccggcttccaaggcctgttttcaccgatcctcagcctcctttgcagcccgttcgcattcctgttgctcacgctgcagccgttctcgctcttgtgcttggcgctcctcttccagtcggcgtcgttcgacttcctgttgtacgcgtagttcttctgcttctcgggctttacgttgttcttccgtctcgttgtcaaccatgaagatgccgaagtagggaggtgtgtagttgtcttcaaagccttcgtcgaagtcgtcgaggttgcggtagtcgtagcggtagcagaagtcatcgtactccacgatcttcgttggtcgcgagtcgacgccaggggagctgaggtagctgtccagttgttccgtcgaaaccgtgccgagaggctggagtatgacgccgacttccctggagctaggccgggccgaggctgaagccggatcccgcctaggcctatggggagaagacgcccttgtggtgaagacaacagccaaatcatcggggagtttcatcaggattggcggataggccccattgtcttgatcgggttgtgttgaagtagattgaatctcgtccgagtggtttgaagccaactcggtggagatgatcttggggtagacctcggtcgagttcgggataccgaacggggcggagatatggcctcttcccgactagtttgaatccgagtcgaggagagaaatcttgccgaagtcgttgttgatgaagtcgaggctgccgaatcggaacgcctgcctgggagggaagacgaagtcgtcgatgccggaaacgaaacccatcgcactagtcggcgaagaacttgacgctacccctacctggcgcgccaactgtcgaaacaagatttcggcaatactaaaagggggtggctatcaagctggaaaagtggatgggtttagagacaaggaattttatacaggttcaggccttcttaatcaagaagtaatactctactcctgtccggggattgatccgccgagtgtattattgatcgtatgatctaggaagaaatcgtgcccctaaagacacccggacccctccttatataggggaaggggtctgcattacaaaaaacaatccatatccctaacggaatatgtagctacagataaaaaacaatcataaccgactaggatcttgggtatttccttgacatacaagtttagaatttaacccgagtcctcttaaagatatcttatatacgatttcagggttacaatcctaccttttcattgggccacgtggcaccacaagcggaactcagcctggattctgggctctagagcagccacgtatttgcagcccacctgtagccgtttgattggaaatcaacgatggtggtgcagcgagcataattggaaatgcgttgcagactccgttaggggatcgaggataagatttttttatttttatattttgacaattccacatcggtgatttctagaagtgctctttgagctttgctggcatgggaaaaaacaacgtgggccaaaagcccaaagtgaggtagggatagatgtggcctttatttacttgatttgaattttttttcaatattttcaacaaataattgtaatcatgacgctatatgggcttttaaaaaattatacatacatggctaaaacgtaatttgatttatgggtctactgaacgttttacgtgcatgtatggtttaacgcaggcttgtcaaaccagttgtttataagctcgtattatcgaacatgcaatgaaaaatatttaacctacaatactgtaaatcttcacataaatatcacaccctctatattttaaacagacgacgccattgaattttgatttaatatttaaccacacatcatattgtaaaaataatgtgttatttattgtgactattttattatcgaacaccaaaatcaggaattaaaatatcgtcaaatgcgacgcatattcagagaagctaactagcaggctcgctcctcttttcaggagcatattatatttctcagtcaaaagtaaaagaacattaacttaaaaaaagaataagggaattaaatataccacaactactattggtaataccaaaaaaatggaaaaaaaaaggaactaaaacagtgttaaaatgcaccatatctacatacacatacacatccaaaatagtaggtgcacggtgcgcctattggcgcactgattttctagttctatctatacatggcaccccatacccagttggatatggggtatccataatctccacactagttgggataaatagcataaggggagaggtagagagaaggatacttactgacatgtgggttgtacaattattttttctgattttaaatgccacatcaatatcacatcagccaaaaccaccatccaaactatcttggtatcttatatgcactggtttgagagttgagggacacatcatatctggtattacggtttaggtatggatttcagactcgacgacaacgtgaggaacctgaaagtaataagttcactttggtccctctatttgtcgcccagtccgattttcgtcccttgaccacaaaaccgggtacgactcgtcccccaacttacaaaaaccggacaaacgaggtccctcggtggtttggaaggcggttttggctgatgtggtgcctacgtggcttatttgacgagttctccgttccacgtggcattgacgtgacaagtatatatcggaaaaataatataaagcgtggccccacatgtcagctgcacacaaaacataattttaaaatggtgggggccacgtgagccccacatgtcagcctcactcctctcttctttcctctcccttctctctcttcttccctttcccctctctctctccttcccgggcagcggacggcgcggatgggcggcggagcaggcgagcaaatagagggacccactttgcccgtcggcgggggcgaacggctcccgcgggggataacggcgacgcggtgcgcgtctccctgcgcctccatggcgcccactgtctccgcagctgccatcggcgctgggtggcaccccctgcacaagcgatgcggcgtctgttgagtcctcaatgcccgccagctcgtgcggctcaccgctgccgcgcgagtgccctgctactcccagatcggcgaggccgagacggagcacgcggctgcaataggcgtggcggtcgaggttgcggcaggtgttgttgtcggccgtcgcgctcgagagaggagaaggggggagtgagattgacatgtggccccaccttttattaattattgtttttaatgtaactgacatgtgggtcccacggggcttatttttttccaactcgaattgccacgtgagcaccacgtcagtgccacgtgggacggagacctagtcaaaccagctacgtaggcgccacgtcagccaaaaccgctatccaaaccaccttaggaccttatgtgcccggttttcataagttgggggacgggttgtacccggttttggggttaagggacgaaaattggactgggcgacaaatagagggacctaaagtgaacttattccaacctaaaatgaacctattccgagaaagaatagcctttccggcctgcaaatggcccatcgaacagcttcagccactaggacaacccgccttcctccggcgaaaatcctccatgggtttagggttccggccgccgtagaagcaagggggagagggggagggggggggggg

SEQ ID NO: 70912 - DNA, 13921 bp, Oryza sativa
  unsure (1)..(13921): unsure at all n locations
ccaccgccacacgcttgaggccatgagcctccgccgctgccaccgcaccgtcgagcaccgcaccacgccctccctgctcggcatgctcacccaggtcaagtgcctcgtcgtcgtcgagacccaggagatgtacgccgcgcggaggcaggccgaggaggaccgacgcgcccccaggcccccgctcatcgtctcccacacccgccgccgccgcggggagcgcccgccgcagaggcgcactagactcaagaagtaacttcctggagcctctagtttttctttcccccacatagtgattcgatctgcgtgattgattggttctccttgcacgttagctgtttgacgtaatgccccataagaaagagtgttccttttgcttctgtgcctggaaatgttcatctgattgtggatgtaacgtacatattcctcacattgttatttgttgtgcttgctttcgttctttacacgttagttgtgtgaacaaaataaattgtgcacttttccgttgcatctgtttgagctggaaatgttgacctgcttgtggatgtaatccacatgttcctctcttctaatgtggcaagaaatgtaacctgcatgtgattgttctagttcatggaatgccaatcgccaaaaccttcttttacattgtggaaactttttaataaaatctcttgatctttaaaatgaaacggaatgagtaaagtagatgcattggcttaacaaagctaaatttcatctgctctgtaaaacagtagctataattagattctttttttttgttcataacacattgtaaagaagatatcttgaaatgtctagctcactgaacaattcataattaactaacatttgtttttaacttgtgtcagtgctagcgacaaggattgctcaactcggtaagggttcatttagaaacaagcttgcgctgaccctagttcgttccttatatgatgtggtattatggtgggtaagatacgcattgctgccaacttaacacaggcattgccaacttaaaaaaaaaaaagctgtcataaagagtgttccctttgaaaatcaggaatgataggatgcacctcagtccgaatatgctacttacatagatgtacttgtgagattgttagaattatcctactcaaaacttccatattttttttaaaaaatgcgatcatgtagagtttccacaaaatcttcccacgtcttattcatccctgtcttttccccatgaatcccacccaagctcagtgacccattcgtttgattcctctccatttgtcacctcgattttgagagggagggacggacggacacggacgagaggcaattccaggctcaaacatttctgacaccagatacattgtaccgctgaactgtggcttgatgccttcggtccagcagttttatcatttgggcacgacatcctctctaacatcacgcagtcacagagtgctgcttcttgtatgcgaccactttctctctgacttcttgtctctttttctttgtttagttgaagaactgtatttgcctttttagacagatatattacttccttccagactttacagtgctaattcatgttatgctaaattagagcataaaaatctttgtgctgtatgacagccatgttttacaagtgtaaagaagatccttgaaatgttgttgatgaaaaacataccaaaattaaagtgattagtaatcaccagtgtatgctgttcctttgtctacgcatgagtaaggtcattattaagccaaaatagaaggccagggttacctgttgtggtgtttatttttcattcaactgccgttgaacttcggggattttcttgatagcattgatgtttgatctgcctattttcaccaaagtttattaagggttttatttatttatccagcatctaatttaaggcttttatttatttgtccagtatctaatttagtattggtttattatattttggatgaagggatgatagtttagtctttgtatatacataaagcgaacggtagaggcgttggcgtgtactactgctggcccaatgcgtagcccatgggcccagcggctcatgttgtaaattaactaaagcgatggatatgtatacgtgcctggcactatttaatttgtaacaagattgattcagcattgaaacaaccaaattaacataaatataggagtaaataataattaagtataatacactagttacaggataagaaaaacaatccatcgatctggctagctatctagaaaatcgatgacgatgacgatcacggatacgtataattaattagttgcctaatcgaagtgacagaggatgccatcgttgccgatgcggcgcttgatctcctcgtcatcctccggcctgaggacggagacgtcgtcgtcgcgcctgcggcgaacggcggcctcaagctccgcctcctccagtgtcaacggcggcagattgaacctcgcgtagctctcggcgcttgtcgccgccacccacgtggcgaactccctctcctcacgcggctcctcctcctccctcttctcccgctcgttcatctcctggagcagacggaaagctcaggctaccgccggaagccattccgccggctcagcccccgccaccgcctcctcccgcttcgcgttccggctatccatcatggattttgagcttacggttggctcgatcttgttcgttcttgctttgtcgatattaattagacgatttacgagagttacagtgtgccctgcctaataggatctgcttgtctcaatcccccaactattaataaaaaaaccccatactttttctccaaaaccgcggtcggacttctattcggactcctgcgaatttttttcgtttttagattttttttaatatttacagaaataatctatcgactaaaaaaattgcagaaatagctcctgccgccctaatggtgggcggcaagctgacgtggcagacggtgggtcgaccgcgccgtctgccgtcgtcggccaaaattgcgattaggcccttgccgtccatacagagggcggcaaggggctaattgcaattttggccgcccataaagagcttgcggccgtacttttttggggcggcaagggacccagatgaaaaaagtacggccaaaagattttttttatgttatgttaataataaataaagaagtatttattggtaaaacctgttaatattgttataaaaatgtattgaagttggttgttgcgcaatttcatatgttaagtgaggtattattttgtaccttattcgacgtattagtactcggataatttatataggcctatcgcagtctgggtcatagaaacattatatggacttaaacaaggaaaattatgtaacatgaagaaatagtagtacaatttgaacatgatacaactatttgcattgcgattacatagatgatattagattcgaactaggagggaggtagtgcaatagttgaacacaacgacaatgtagtaatgggacaaggaagcatgacagtagaaatttcaatatgctaagttctccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatattgtaggatttatggaacaaagaacttgacaacgatcaccacacctgtatcttggacgggcttcccatggagggagtgccatagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacgtgtgaacgtggtggggtatggtgggtacgcctgactggcgccgaaagatatatgcatgatcggcgccgaaagttacattggtcgtatgcgccaaatggcgggcaaatactcgtatcagacgcgaataaaggaggctgcatcggtgtggcagaaagtagttgtgcatgcgccgaaaggtatcgtgcacatataaaaacaacgttgtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgtggaggagtggcctgcgcctggtcctgcgtctgcaccggcggtgcgcctcccagctgtgaggggccgatgacgtcctctgtcgagcctaaagtgaagtcgaagtcagtgatgtcgaagagcaaggtggaaggcagcaagcggtccgacgaggtcccagcatggtccagtgatcgaccctgactcgacgtgccggctgcctgtgacgaagtcccggtgtactgccagaactgcgctgagtgcgaggtcgacacagctgcctgagacgctgaccctgcagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggatggcggggtgctgaacggtgcacgaaaccctgaagcaatcggcaagtgaaacggctcacttatatgtgcgaggcatgtacagaaataataataaaaatagaggtctcacagcacgtaaaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaagtcgccaacttggcgggccagtcgccagctgactgctgacccttgcgcgagtacctgcgaattaatgtgtaatattagtgtgaaacgacagatgttacaaattattgtgaacaggaagattttaatgcaacaacggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacgacgcacgagcctaggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcaatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcacgctgggatccgtcttcgtgcaagactcacaaagtgcacggtacagagacgccccaccgcggaaccccagctccactgaggcacctcgcctaccgcggagtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtaccgtcagatcgtcctgccagtccacagccgtggtcactggcccaacagcgtctcccgcgagcggtagccccaacaagtacgatacgtcatgtagggtaggggctacctcaccgcacggcatgtgaaaagtgtgcgtctctggcctccatcgatcgaccaaagctgctaggagggacctgtccacagtccatcgtctggccgggtccgcgtcgccggccgtagcctccaccagccgacacatcggtaggaggccgacctcacgtagcctgcaataacaaattaatatgtcattataacaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagattacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacatcacgtagccagacgtggcacgacgacgcctaggacgtggtcgagtggaggtagtgccttcacccgtagggcgagctccatctgctgctgatcctgatagtcctgcctccgcagcacttggtttctccttgtctttaggacaatgcttgtaggtgtgcccatgttcatcgcatttgctgcaacgcttcaccctaccagcctccgactcgtccatatcgttgcggatgcgacgagtcctcctccttccagccttgcctcggagcttcgatgggtcaggaatattgagtacttcatcgttagtctctgtgaactccccagctatgcagaacccataaatctcgccgctccatgtatgatatattgcttgcttactgaagtactgtgacacatatactgcatctagtatgccacactccgctgcggcagcaatgacatgggtgcatggcctgtggagcagcttcggctttgcacaagagtaatgacatgtgccatcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgttgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcctatttctcttttggttcatgcagaatccactgagaaaatttccgaatctccaatccagttcttctaaccaatgttggactatccgttgggagaggtccaagagcttgaggagggttagcaacggcggtcgatggagccgctgcacgctgatcactgcatttggctgtcaactcatctaatatcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcatacgaacaacttttgttttaaccaatttcaggaaccagtaccagctgtcggtattctcactctcaacaaaagcaaatgccaagggcaatacctgattgttcccatctacccctattgctgttagtatctggccccgatactttcctgccaagaatgtcccatcaatgcagagaacacgacgacagttcacgaatgccatcttgcatgcatgtagagctaagaacgccctttgcagcacactcttgctaggatgttcaattgaggggaatttcttcacttcgtaagagctcccagggtttctttcctctataacaccaagcaagcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgaaattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttactgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctgcatttcatccacaatggcaccgacagtctccccctcatcggccactccacctggttgaatgcccactggagctactacgcccccgtgctatcgtgcgttgaccccccccacagaagtctcgtttacctcagcacttggtccctcgccctcaccatgttcatncgcacacccggatccctcgggtgaacaaacggaaccaaagccagaggtcccccgcgttgcaatgcattttcccaataccatctnccaccccgagagttctaaactggaattagtttcccataaaaaccctcagttggcccgactaccataaccttgattgttatgtcacctgtctgtggatcaaccctcaagccccctcttaaccctccctttatagaaggtacccctcctctcagcccatccatcaattcctcttctcgataccataaaatctgaccgatcctacccagttggcccctaacggacctttcccggtccctggtaaacttggaatatttgtttgttcgacatatctgtcaacgaaataactagatcatattactctttcatgcaataaacatctacaacgtaatatcttcttgtgtaagccaatgcaactgtaatgtattgattccaaactagcagatctatgtagttaccgatatctacaatacgcacttctagattagtacaattaaaaccctaaaaatataatgcatttattcaaacaaatttttaaagaatacacactatttaactcatagtcacatataggatctatgaatattacctgaaatcggcgtctgaatccggcagggcttcgccccttcttctcttctcctcccctctcttcttttttttttcactggaattgaggagagaagaatgagggctgggggctgggcagcaggccttctataggcagcgaggcctgccgcccggccagaggacggcaaggggccgcctgcaaaatagccggccccgactggcttttttgcattcgggccccttgccgtcccaccagagggcggcaagggttttcctgcaaaaaaccctccctccatcaccgcccgttcctcccccgtttgccacgttagcttgccgccccagaggtgggcggcagggtctatttttataatttttttggccgatagattatttctgtaaatattttttaaaaaaaatctaaaaccgaaaaaaagtcggactcctgcgactcctcgcgtgggccggctcggaccaggccgactgctgctgctccttagccgactcagcttactagccaaccgagtcaatcgagccaaccaatcagcaagacatgcacagcacccgtacatgcaagctgacgtcaacacacacacctgcatgcatcaacatatgcatgcatcgatcacacatacatgtacagcaccgtacatgcatgcatacctgtacgctacagtacctcgtatactgtagcatcatatactccaacttttcaattcccttcgcgaacaccagtggttgcacgcacatctcgtgaagcccgttgcaaagatctcccccacacggtgtccatccaccgtgtgccgtctcgtatccaacttcgtcacccggtatccttgaccgtctggacctcaactcctccctgagtctagtcccgatccccactgttgaccgaagttgacctccaagaatccatactctaatcatcttctcacataatatcccgactgcactagacctctgctcctccctgaacatagtcccggttctcaccattgactaaggttgatctcaagtcacctgcacacaatcagacaaaacaaccgttcctgggcacagatatcacaacctgacccacattagtcatacgcactcaaacaaacatccacacatcttttcaaaccaattctttgattaaatcatttgtataaccaattgttcatcatagatattaatcatgaaaatgatttcacaatctcctctttgatgaacacattggcaacatcttcaaaatgcgaatttgtgtttttgaaaaaaaacaaaaatcacaaagtgaaaaggaaaactctccctttttaaaagagagttacagtgtgccctgcctaataggatctgcttgctatttaaagcgaaaaaggtgtccctgccagaaccgactcgttacggtgtgcaaaatccgactcgacgcagtgtgcgaaagtcgatttacaacgtgcgttcataaaatccgtctcgatgcggtgtgcgaaagtcaatttacaatgtgcgttcatgttcctgtgcagacacatattcctaccgttcgatgtgctttgggattcgagcacggccagccttctttcgatctctcgaatttatccccattcttgactttttcttttttaacaaagacgcccgcatacatgctatatctataacttgaatatgatggacaagatcccaggggatcacttctgaaattatttgtttttcccccacctttcccaaatgtgttccatgcgcacgcttttcaaactgttaaatgatgcattttttacaaaagatttctataagaaagttgcttaaaaaattatattaatccatttttttaaaaatcatattgtggaaacttttgaataaaatctcttgatctttaaaatcaaacgaaaattaagtaaagtagaagatacattggtctaacaagctgtagccatgtttacattcaatgtttttttttttggcataacacaggctgaggctccagatggtacaggtaacgaacgaaagcaaaatacccctctcacagataaatgaatatgacaatttgcaagatggtgttgggattaagatgatggaggttgataccatagaggtgtagcagacctcggaagaaatcgccggttggtagcccgagcctgaactgaaagaaggggaggaagaccaccatctcgtgggtgtcgggcgttgggaagtcttccctgacagcctccctctatttgatgagctcctgcgggggaagatactgttgagttgtgatccaaattcatttgcatttaacaaaggttagcttctgccatagtggagcggaggcccgtcgctggtaggcttgggccagagcgtcttagtcagcaaagttacattaagaaggttcttcatcgttttaacatgcataatacaaagcctgttagtactcttattgcacctcgttttaaattttcagctttacaatgtgctagtactgataaggatgtagaatagatgtcaagagttccatattatagtgctgttggttcttttatgtatgccatggtttgctcccgtacggatttatctcatgctatgagtttggttagtagatacatggctaatcctgataaagaacactggaaaggtattcagtggattttcaggtacctcagaggcacagctgatgcttgattgaagtttggcaagagtgataagggacttgttggctatgtggatttagattttgctgctgatttggataagagaaggtcactgacaggttatctgtttactattggtagttgtgctgtgagttcgaaggcaacattgcagcctgttgttgcctagtctaccactgaagcagaatacatggctgttgctgaagcatgtaaggaatcagtttgactaaaaggattgtttgctgagatttgtggagttgattattgcattaacttgttttgtgacagtcaaagtggcatatacatcactaaatataagatgtttcatgggaggacaaagacattgatatcaagtaccattatgttcgcgatgtagtcgcgcaaggtaagctaaaggcatgcaagataagcactcatgataatcctgttgatattatgacaaagcatgttcctattgctaagtttgagctttgctcaagtctagttggtatagtggtttagcccaagaggctatttggcgccgaaagtgtttttgtctttgttgtgttcagggtaaaggattgattcacgctacaaggaggaatttgtctcaaggtggag

SEQ ID NO: 70913 - DNA, 5646 bp, Oryza sativa
gtgtttgcttatgcaattactctatgtcataacgatgatattagagtagtatctggtagtttaggcgtggtgtctagactacgggatatcattatttggggttatatgctgtggatgagaggtgggccgctgatggtgacagctcagtacgggtattcctccgcacgtgtatatagtcctaagttaatttcctgtggagggtactactccgtatttagccccggttgtatggtcatgatgggctgtcgtaaggaactcggcagtcaggggtggcttctcgaagtactaggagggcatcggaaagagggtattagctagtaaatcatataactagaatgtatgtataatttgtatactagaagtataggaatagattctttttctattttctttccacttagcttagataatttagtttgagaatgagaagttctatgcttgtgtgtcatcctaccctttgaattatattaacccctgcttagactatgattattacaagtaacataaattattagtgcggttctctctattgtaatcttcccacgggattaaacaaatacgatacccatggaatactctcgggtgaaatgctaccactggtggagaaaccctttgtagtcccggttcgtaacccccctttagtcccggttttcaaaccgggactaccaatccaggactaaagatcgctatctttagtcccgggtgaaataaccgggactaaagatcgatctttagtcccggttcgtacaccaaccgggactaaagatggctccgccacgtggccgactgagccatctttagtcccggttggtgttccaaccgggactaaagatcgagctgacctttggttttttgcctggcctcgcgtgagtgcgagtgtatatatatatatatatataatatctagtatatatgtgatatatatatatatgaccaaattaaaatatatttacattatagaaaatgtgtacacatgcatatagaaatatatgtagtcatgtattaattataatccattatatgtcctagctagctacgatttcgacgtagtagtagtcgctagctcagaagctaaggacctatgaattgtgtttccgtcgtaatataattcacccttgggatcaaggatttgttcgttgatgaatcccatgagttgttcttgaaccgctgcgataaattccttgtgtgtgttcaggttatccctcatgcgaataaactatatgaatgtatgaaattgattagtaattaaacaagaaatcgatatgtaatgaaattttgaatttatttgtacgtacaacgagctctcttgtggtgatgatttggtctgcaaggcagtggtaatactcgcacacgtagtagccgcacaagttagttccctgcttttgctttgcgcactacaaataaatgacaaacgacgaaagatctaattaatatacacttgtatgtatttgaatcggagaaatataaatgtagagcatgtgtactcacaggaaatttgaacttccgcctaagtctttctctccagttgccgcggaccaaatgacggaaccgataccaagccttacatggagtttaaagctatgattcgtagtagcaattaacataacaagattttcttaattaacagaggaacttatgacagtacctgtctataagttcgaaaaccttgtcaaacgtagactcttttttatccattgagtcatatacgttgacggtgcaggccgacaggtcgaagagtaaaagcacccagtggaatctacaatgtgcgtgggatgcattacatatgaaacacttagcaagtgcgtacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatctagtatcgaaaaccccccgccgttgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgattcagagaatgtcatctccttgcaagaagtccatgtccctgatcctcgctccgatcatctctctaccggtggcgctcatctccatgtacagctgatggaacttgtacatttgtgtgggtagggactgcaccagctcaggcttgacaagcggtttaccgagttcgtacatgtatttcacttccgccttttcgattggtgcgactcctacaattgatccgtagttagaccggtgtcagtaataaattcttctatcgtcatttcttcaccggtcaccaacggctcaatctcctggtttggttgctctccaagctgagggactggtttggactttccagaagatgctttatcagcgttcgctcatagtccgatagcttaatggcatccttggcaggtgcagacatacccctgaagaagttcctgacacttgggtctataggaatcttcttttctggacttcgaggcttgaattgtctcttgacttctgatgccacgtaagcgtcaagctcctcttgcgtgcaatcataccccgggtccttgctcttggcggcgtcaactttcgccttcttcgttgcccttgtgtgggcaggcggtggagcttggggggcccttgactttgaaggtgccggaagaggagcttgcggaggagtcggtgcaggagcctgaggtggagacggtgctggagcatgaggaagagactgtgcaggatcctgaggaggagatggctgaaccggaggagatggtgcacgagacgccgtttgtcgcccagggaggatgatgtaccgcctgcgccatagaatgatgtcatggcttgtgttccagatgcgtctcaccgtctcctccagggtaatccagctcgaggtcctcgtacgcaccttcgaccaactcaacttcgaccttggagtatcctgctggaatcggtctgcagtggtaagtacctgaagggtccgttgggatggccatgcccgacgccaccatcatgtggtgagaggttatttattagtaatcaacatatataatcagcaactagcggaatggccaaatctaaaatatataaactacgagcttacctttattgataagttcttgaaaggaatatgcagctcacatggtgtccgctgagtgatgtcatcaacgggccaggtggattcgtcctgggtttgcatggcgtccatgctctgtgatcctacctgccccgttgaggcgcagctgctacagtttcctgacgggctcaccattgcaggaggaatggtcggctggggatcatgggaccgatatgcggccatgcgttcatcaaccttccttgccacctcctcttgcatgctgcgctcgtagctcgataccctgaaatctagatctgcaatcttcgcctcggtatctctcttgcttctcatccgactcctgtacgtgtggatgtcctccttgaacccaatcttccaaggaatcacccctttccctcgtgttcgtcctggatgctctggagtctgcagggcgagtgacagctcgtccctctctctatctggtcagaacgtgccctgagaagagtcttccactgcgtctgttagtcgacacgcagcctctcgtatctgatcgccgaagacaagtgagccatcagctgggttgagcgttccaccgtgagcatagtaccagaacttcgatcgttccggccaattagcagtggccggtttgatacccctctcaagcaagctagcctccatctcctcccacttcgacatcgcgacgctatagccgcctgaccccaagtggtgtggtacttcttcttggtggcattttctttgtttctttccatcatcgcctgcccttgttcacctgtcttatatgcaacgaactcgtcccagtgatcccttagctttgggaatgtgtcaaagttcggtgtctgccccttcaggatatatttctggtacagatctcccttgaagctctgaaactgttctgccattttcttcagagtccaccttttcactttgtcctctgtacccgcgggaagggtgaatgtctcgagcattgtggtccacagcatctctttctccgaatctgggacaaagctctcatgatctccgcgtgcccttgttcttcgccagtacaccgtactgacaggcacgttatcccgcataacccaaccgctgtgacgtacatagttcttggcggcttctgccggggcactaggtcgtccatcttcttccacttccgttatgatgtgccgaccctcaagcttcttcgtggcacctcgttgcccgtgtgccctcttctgtccaacggagggttgacttccactagcctcctcctcctagttcccctccacatccctttccatgtgcccctcctggttcccctccgcatccctctccacgttcccttcctcgttcaaatactggtttggatccttgttcccctcttcttcattccagtactggctgcttccctccacgattgtatcgtacaatatctattcctcatcgcgatcagccatctgttcatacaggaaacatctgctaagtcatgagacatttatgttttaacaatcttatattaaaactcaaataatcttatatgctaagactaaaatagtcatgtatgctaagtgtaactgtcgtatattagaaccccacacaatcttagaagctaagtctaattacaaatctaataatcttatactaaaactcaaatagtgatatatgctaagtctaggtgacgtatattataggaccctagctagtcaataattatatactaagtctaattacaaatataataatcttatattaaaactcaaataatcttatatgctaagactaaaatagtcatgtatgctaagtgtaactgtcgtatattagaaccctacacaatcttagaagctaagtctaattacaaatctaataatcttatactaaaactcaaatagtgatatatgctaagtctaggtgacgtatattataggaccctagctagtcaataattatatactaagtctaattaccaatataataatcttatattaaaactccaataatcttatactaaaactcaaatagtcatgtattctaagtgtaactgtcgtatattagaacactacacaatcttatatgctaagtctaattacaaatctaataatcttaattgcattacaaatataacaatcatatatataattacgtcacttgcctgcacgaattccttcgagggctagctctaccactctggcttgagggacaactccgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacatttattcacctgcctataattgcatttcacgttcacgttcgttcgctcgttct

SEQ ID NO: 70914 - DNA, 3119 bp, Oryza sativa
agggaatcacggggagtgatttccccctctttattgcgcgcggggtcggcggaatgcgtcggaatctgcggcggcggcggcgctggggcacgggtgagacgtcgggtccggcgcgaggtaggggatgacgggtgggccccacccgtcagcgagggtggcgggcgggcccgcccgtcagcggcgcgcgcgcgggggaaggccggatgggccgcgggggagaggagagagagggagggagctgggccgagccggcccaagaggagaaggggggggaaaaggacttgtagggtttttctttttataaaacctttttaactttgtttatttcttaacaattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagaaaatgatttttatttcgggatgaatttatcaggacgtgacaattaccagggcaagcagctcccggagcaggagggtgacgatgcagagccccacgctgcttgggaggttactgcagtgatcctcactggctcacccgagaggacgtcgttggcggtcaccgcgggtggagattccttctccgccgcttgccagaacgccgcactcctcgccatcggcactcttcaccagcgctacccggacgagttgcagcactcgccctactgctaccaccctcgtcgtggaggagcccgcgactacgccaccttccgggatgctagctcgaaggatgacgctaccatcatgcacctggcgcgcatggtggaggcgtacgacgcggcccgtatcgacttccatcagatggtgcgtcgcgggttggtcgagaacagcatgaagatcctggagctgcgtcaggagaatctgcagctgaagaaggacctagacgcagtggaggcgcagctgcgacagcttaagatcgcccagggagaggtctgtcgccccaagcgtcaccgcgtctgccgcagcctgaagatcaccgcccgcaagagtacctccgggcccgagcttgttcgtcagtccctggtgtcgaaactagatttcggcaataataaaagggggtggctatcaagctggaaaagtgtatgggtttggagacaaaggatttatacaggttcaggccttcttattcaagaagtaataccctactcctgtccggggatgaatccgccgagtgtcttattgattgtataatttggagaaaatcaacaactgcccctagaggcacccggatcccccttatatatgggaaggagtccgtgttacaaaagataatctatatccctaacggaatatgcagatacagataaaatacagtcgtaaccgactaagtctcaaggtaattccttgacgtacaagttgagaaacaaacccgaaatacaaataagatattctatccatattcggtatcctatattcagcccaaatatcatcaccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaagacaaaataatagcacaatcgtgcatcatatgacaaaagcatacgcggcacctaaagaggtattatagccgactgctttttagccataataaaaggaatccgagtggttaacactctaaaaggttcacgaatgaacatacttgacaggcatccgaataaaaaactccaaagattacccaccaaatattataaaaattatagtaatgaataagtctaatagcctaggctatgactatttaccataatgaaaacaggcatataacataccaaagaaatgactatggtaaaaacaagtcatttcaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccatttgcacctccgatacccttaacaataaattccgagatccaagcgtcacttcgtcttccccgccggaactctcgccattttccccaatccctgctacagtacagagctgcgccaacaaactagggttcatcattccactcgaatccaccttcgaaaagttcagcaaaatccttcccgtgatccaccgccgcaatccctcacctctccctagccatccctcgaatcaaatcagcgcattcgggtaaaatcgatggcggaagagaaagaaagctttgaaggccaatgggcaccatccgacgtaacggaggagaacctgaaggagatggtggcgcacggcgttctccctgccaaggagatcatcgggtggcggccagcatgcggtgaggcttttccgtcccccgatacacacgaggttgtagtcttttcccatttcttctatggcggcttcgctcttccgacctcaaaatttttccgcgggatattaagcttctatggaatcagcttgcatcacctaaatccaaattccatagtccacatcgccaatttcatccatgtttgtgaagccttcttgggaattaaaccccacttcgctctatttcgccgaatcttctttctcaaaccccaaccgaacaagagtaagccatgtgtagtcggaggggccggatttcagctgaggggaactctgagccagaagtacttctcgatgcccttcaagacttcaaacaaaggatggcatgcgaactggttttatgttcagaaccctgagcctgctcttcccgagtactcttgt

SEQ ID NO: 70915 - DNA, 5368 bp, Oryza sativa
ttctttccgaatagcattgctccctggataggaaatgccattagaacagagcgtgatacgcagcaacattcacacacacacacacacacacacacacacacacacacacacacacacacacacacaagagagtgttcagaataaaagaatgtgtgaccaagaagcacctttaaatacagtacagcaagctcagcctgaagcccgtcagccatctggatgagggcatgatctggtttatttttgagtatcttgatacgcacgatattcccatacattgagaaaaggttgaagagcttatcctcatcaattttctgcatggaaggattaacccataaaactaagatattggtaaagtgaatttgggagagtttatagctagtgaaatcttacatcagtgttcagattgctaactagaagtgtgcaacggtcattgatgccagacactccaggaggcaatgttccaccaaaagcagcagcgatcattgctgccttactcatctggtatggagaaatattaaaataacaaagtgcagcagatgctttgtatgagatgtccatgctaacctaagacaagcatagatagaagcagtaaaaactaaacgcggctattatctgcagggtttaaggattcataatacatacctgtgcatacggatctgtgtacagcagagagacgatcaaaagaaataagttaaacatgttttatcaaatatagaaaaaatggataacaaacaaatcaaggaacagtggaatgtcttacctccaggttgctggaaaccaaacaaactgcttggatcattataactaggctgttccaaacagaaacaatggaggtgagatacttcagcatagcagatcgaattgtccacataacaataattgaaagtaaacagataatataaaataacaatagaacaaaatgagttgaggacatacctgagatgatcttgagcgttgttctgtaggcaaagatggatttgtgaaatctctgaacaaggaaaacaaaatgagttgaattttcaagctccatagaaaattgacaatgaacaaaacaatattgcagttataaattaggtatctgatacctagatctatcgttgttgtagtgaacttgcaattcgctgagactgcagattcaacagaacaagttagattcaggagagctaagtgtgaaaactaagtatatggtgtagcaattgctacaggccttacttagaatattgaatgtctagctggcagcaaccatcatatatgttccgtccctgagattatgttattttccaaaagagtgagtttaaaagcagcataagaaatgaacaggaaacctacatgtaaagcaccataagctgtatattgaacaggaaacctacatgtaaagcaccataagcttgtattgcactttgacgtgactgatattgtatgagggtttgaaagcctgcaccaccaaaaaagatcaccatagcaaacaagtcttttaattcagcatgtagtaaacatatcgtcattccagcaaaaaaaaatgcactaaaaacatggctgtgaatattataaataatttaattttttttgaacgactatgcagttgagagaactatgaaatacgcctcataatctgcatgctatctggcaaggaaaacactgcattaaatgcaagaatagagtgagaatgagaggtagaaagaatctgaccggctgacttttgaaatgtgactatcttctccacaaatccatagggagaaaacacttgatgaagcacttcaatggttatagggtaaagcatatgatgaatggttactaacagaattcggttaggttcttcctgaggcccagcagcagacgagtaccgagaaagaaaagaggagagagatagaagaatgaataaagaagaataggcacatctagttggaacagaagagaaagcagagagatagaaggaatgcaaactaatcaatcagtggggacaaatgaataggtacatggaaaataataatgctattgaaatcaagatgttttgacaaaaatgttttttttctttttgtaatatgtgaagactatcacatgctaggtggtaaaacaagagaaaactgtatctagcagctacactaaataaaagccttatcctgcatcccatgtgtcaatgcctgaaatatacaccttgccaacaaaaactgacaatcatacagttatgagaacttagtcttccagcttatagccaaaaaccttggagcatgctaaggattgattactgttataagagaaggcacatttttcttgcaccagtaataactgataaagttctccatgtatttttcttgtaacagaaactcattctctgttaggttggtataataaaacttattattacaatatcgtatatcatagaagaacaaaccatcactccaaacaaaactaaactctagaatagagggaaaactcaaagtccacaatcatgaaagcatacctgatcaggatttcgtccatgagagctctgatcagtagtcaattcttggtgggatgaatattgcaagtaaacatttcttcccctaatatatggcataaaagcacatttaaaattacataataatatgagtatcatatctgtatctatattatcaaagaaaacataacaaaattatgggaaacaatgaaacttcaccatcatattatcatatgcaacatacaaatggcacaactctttcctatagcagataagtgcaacagcttcaaaagaaaatatataaacagaagtcattagcacctatattcagtgaagctgatctataagcagtcttaagaaatggctgtttttcccccaacaaacatagcttgtccgaacaattattctaacaaaaagtcaaaataatactattataccagaagagatgcccttgggatgcaacaacacctggtctaagaacaagcttaccttacactgggttgaattgtattgtagtattggatcacattcacagcagaagctaaatcctccatctggacgagagcctttaacagcagcacaaccacattacaaccacgcatgtccatttataacaactcaaacagaaaaaaaaaaagtagaagccgagatcaaacctggttcttagcacgcagcatgacgagcttggcgacagtgccgaacggctgcaccacctggagcagttcgctctgtatgcaacagaaagaccacagaaaatatcaaaaaaaaaatcgtactccgacaagcagctcatgaactgcaaaagcgccagcatctcttcacctcggagatctcatgcccgacgttccgtatgtggatcaccttggagggctcggccatcctcccgcaccacgcccgcacgcaactctgaccacacgcacacacacccaatcaaaaacccacccacgcaaagcaaacgaacgaattaatcgatccaccgaaccaatcgaaccgtagaatcgatgagccaaacaggagaggaggaccgcgaagggtacctccgaactagggtttaggcggtgggggcggagccgcggaggagctagggtttagccttgcgcgcgcgacgaagggggattggcgagataagatgaggcggcgcaggagaaggagaagtggaggggtggatgcagtggcagggtgggtcagatttggggagtccgcaatacgcacggaagaggaggagacagcatagcacccgcttggattaactcgggagaccgcgacaccggcagccaatgccgccaaatcacggagcaggaacatttgctaaaattgacgtaagtagatggatctcctcggaaagtcgatgatttttttaaaaaaaataaaacgtataaacgtatgcgctcatcgcgtacgtacgatctatgaatatagagcacattttatcctataaaaatatctctagaaaaccggacagatatattttaagatttacgaaatcactaccgatgaatacatcatttgccactaaaaaattaaccataaatactatttatgtgaagtctataacttaaatttgggtgggctggttttaccacaataaactaatcgggctgcgggaggccagattccttaacattaaaaacatagcaagcgattagagcgagattaattaaatattaccctaaaaaattgaaaaaatagattaatataacttttaaagtaactttttttagaaaactttaaaacaaatataccgtttaacagtttaaaaaacgtgcgtgtgaaaaaaggagataggtgagttaggaaagaagggaaggaacacagttaataattgatttcgtgctagaagatcagcagtgcttctgctgatttgctgctgttaatgatatcatggcgttcttctacagtaaagcctgtattgatcgagccatcggcttcacgccgcgacgagccttaaataattcgacaaacaggctgtcagttacaaattttatttcagtctggaatataatttttttttagaattacacagtacaacgcatacactcacccctataaacgcacgcatgcaaagcctacccctataagcatcttcaaagactgcgccgacaagattaacaaagtcatcacaggcgcctccctgggtatgtcgcctaccactaaaagcacagagccggtgttactgaggctctttataaccactaggctacaggccctttcgtagtctagaatataaatttgatggcacaatcatcatgtaacatatactcaaataaatcaaatgatgtatcagacagaatcacaaaatctgtttttttaaagtttgcctaacaaaaattaagatcagatatgacaacctaaaatgaaaccataatggcacatctccaaaaagaaaaacatgcagaaacagaggagccgtatcctctgcgtttcggttccacagaccacaatagaaatactactgcaggagttattatctagcttcaatagactttgaacatcgtatagtagaggggaaaatgacagtcaattgagtggtccaaagtacgagaagccctttacaacacatagatttccactaatcttacagccttatgcacgcctcctttaaaaaacaaaatcgacaatgcaatcagagaagaattcttaagggggcgtattctctgcccaaacctgtatgtattctggtggttcaatgaggaaaatctcagcggtttaggtattgactacaagttcagcccaccattagtctatggcaattatgaggaaaccaactgaaatatacatgaggaagacgggatacagggccagagcctttctccttgggttaactgcagcactcatgaatggatatgcagcccaggaactccatgccaatgtgacggtcactacgatgatctttagtatgacattgtccttcagcatgcaaactagagctcc

SEQ ID NO: 70916 - DNA, 2213 bp, Oryza sativa
ctaaatgatctacatatttgtgttcatttattgagtctattcgttatttgtgcattggagtaaatggacattgatgcatgtatccatacacacaagtatttataacctacatgcaatatcttgatttgctattggttaggaaatattggggatggtgtatgcatctagtttattgctagagtaaatatagtatgagagagttattagcttttcttggtcttggtgtacctatgaaatatgtagataaatatggaatggagggagtatacagtagtgatcaaacttcttgatttatgaacagagaataagtaatgaagtagaaataaacttattttggcacaagttttaaccaaaaaaatcagttttattttggggtagaggaactacatactatggtgtgaataatttttgtttctattactatcgatctactcccaccatcctaaaatttaagcatttttagtatagtgacaagtcaaacatttttaacttatactattaataacaagaaaataaaaaaagatcaatcatgtaaaattgattagtagatttatcattaaacaaaactatcataatatgcatctctttctattaaaacatcttatttttatagatattgttggtcaaagtaacatctcagagaccgtgtcagagtccaaaaatacttatattttgggacggatggagtacatgatccaacacgatctgagagcttagattttaatttctttttcctccaaacgtagtaatttctataccttcagagtgaaggtgatttatcttttcaagctagctttactgtacagttaactatgtaaacaaacaaattaattaattaattacctataacattgtaaggtgtttaatttttttgtaagtaaaaagtttttttttaactttgatcaagtgtgaaaaaaataatcaacacaataacaagtaaatatactatcatgacatacctcattgtggattttagagaagattgactcagcacaaagctatctgaacggattgagtattgaaaatttgaaaaccggatgtgaacaagtattttaagaaacatagaaatttgtttgaaaaaatcacgacgttttatgagctttagaagcgtgcatgtaacaatctgttagctagtatagcactttcaaaggaagcctttttcaacaggttgagctgtcgctgagactaaatagctctgtgatttcgtcgtgaacataaatggaccacgtcacaatttaaatgtcaagcgacttgcaggtaacagatcatcaaattcgatctttcgatggttcagtcttggtgaaatttcatatgggtgtatccaggtatttttctcctattaaatcctttcacttgcagtataatctttttttctcctattaacacattctgactttgcatgcatgaccatcattatgtagaaagcgttgcgttgttgacctgtaaatatatgccacttcttgttgacttgttgggccttagaagaaaattgctggatcaaagctggctgctggtggtggtgaatataatgaaatggaaatcgtcagttgatccaattgttttggtcaggcgattgtataatatgctcttttgatattaatcttccacatggctagttaagggcttcttatatatatttactaccagttgatactccgtgttttggtgtgacatgtagataaatgcatgttatacattatagaaatagaaatggtacatgtgtatgttaaaataatatgaaaatgatatggagataatgatttgacattgctttcataaagttctacaaatacaacaaaattgtaaatgatatgatatatttgtatgatatttaaaatactctagataataattgctagtgggtaatgatgtgacacacttgcatgttgagttttagaaattagtggacatcaactttgtactaagataagatacgatataatgttgactatacaatattattggagtatgtagttttctcggaatatgttatgacatatgaccatatactatgttaatggtgtatgatattaatggtgtaggaatgtcaaaagcacaaaaaaaaaagtacttgcataaacatggatgacaacaacaagcatatattctgatttggagtcacaagaaaatactcctccatccaatcaaaaatattttttgggaattgctaaacaactacctactgaaattttttgttttgtcagctgagttcg

SEQ ID NO: 70917 - DNA, 4343 bp, Oryza sativa
ctggacaaaccagcttattagacgcgacgagtagtataggagccaacacaaatttgtgtgagggaagaggttgagacggatagggagcaagtggccgaatcgtgacagtgctacaaacagaatgatttcatagtagtagtgcaacttcctttttccgatgtatcttttttttttttttgcggggtttttccaatgtatcgatcattgttgactttagcgagcgccagcagttcagtacacgcaaaacgcacagctatatatgtgtacgctaatcatccatgaattgtcccaacctcatttccttaaacgcctacgcatagctctcaccatgtatccgcctctggttctggtccttgcaatcttcttcgccgtggccactgccatagcggccttgtcgagtcccctcccgcacccactcgacccactttctcccacggagctcacggcggtaaggtccgccgtcctcgccttctctctcgtcgcttcccgcccgatatcctttcactatgtcggcctcgatgagccggagaagcccgatgtcctctctcacaccaacgccgccgccgccgccatcctcccacgccgcgcgtttgtgatcgcccgagccggcggcctctcccatgagttttacgtcgatgtcaccaacacctccgctccccgtgtggtttcgcatggtattcacgatggccctggcttcccaatgttcacgaccgaggagcaggtggcggcgggacagctttcacgcgagtaccctcccttcagggaatccttgcagcgacgtgggctggccttgaccaatgtggggtgcggggtgttctccatgggatggtttggaaagaatgaggcgaggcggttggcgaaggtgcagtgcttcattgttgcaggcggcaccgccaattactatgcgcggccactggaaggcgtgacgctgctggtggatgtcgagaaactggttatcgttgcgtatagagatagggcagcgtactcggtgcccaaagctgaggggaccgactaccgcgccggcaaggctaggccaccgttcaacggagcggtgccggcgcctggcgtcgtggtgcagccggagggcaagggcttccacatagacgatcatattgtcaggtaagcccctccaatttgcatggggttgttacttgttacttgccacctctaaaactggtttacttcgcgtggttctatcgacaattccttgggagtaccaatgacagctgcccttggtcaaacggttgacaatattcagagagcaacttcccaacttaaataaattgcatgtattagcactgaaatatttgaccaaccggtttcagtaaacttttgggctcatgtctttcgacttttcgctatatagaatcttccatcaagattcgtcttcctgtaggcccaacttatagttgtacttagttatatagcacttatacttagcaatagaaaatttatgctcaattacaatggatttatacacagctacagtgaaaaaagattttacaactgttttttctctagatttatgatttttgacatatttatcccccttttttatcattttatttaaaacgggttgtatctattagtggaaaattttgcaagatttaaagctccaaatctatccataaatcaataggtagtacctttgacaaattgaactaattcatgagctacactgcttgagcgtgactgcaggtgggccaactgggagttccacgtgggttttgacatgcgagccggcacagtcatctctatggcttctgtccacgacgctgatgccgacctatggcggcgggttctctaccgcggtttcgcctcggagatcttcgtgccatatatggacccggaggaggagtggtacttccacacattcatggacgccggtgagtacggccttggcgtctcggctgtcccgctgcagcctgaggctgattacccagccaacgccgcctacatggatggttattacgtcgacgcggacggcaagccggtgaagtcggagaacatcatctgtgtgttcgagcggtacgccggcgatattgcatggcgccacaccggggtcgcgggaccaatcgcaccggtgatctaccatcgacccctcaagtgcgtgtgtgtgtgtgtgtgtgtgtgtgtgtgtgtataatactagatgatgtggctttcggtgcagatcacggaggtccggccagacgtgaccttggtggtgaggatggtggtgacggttggaaattatgactacacattggactgggagttcaaaaccgttggctccatcaagaccgtggtatataacaatcttctgtttgcttgccgtgtttaaagcaaattaaaggtaagaactaactcttgactcaattaacacacgtattgcaggtgtcccttagtggtatcttggagatgaaggcgacgaattacacacatgtcgaccagattagagatgacatacatggcacgctgattgccgagaacaccgtcggtgtctaccatgaccacttcattacctaccaccttgaccttgacattgatggtaccaagaactctttcatcaaaaataccatcattccaaaacgcaacacgggcgttcgtgcaaccggcggtgctcccacaccaaggagctactggacggtactctatgaggtggccgaaactgaggctgaaggccaggtgaacattaatggcgcacctgctgatctcctcttcgttaacccaagcaagaagacaaaagttggcaatgaggtcggttaccggctcattccagccggtgcgacggcaacatcattgttggccaacaacgactacccacagcgccgagcaagctacactaagaaacaggtgtgggttacgccatataacaagtcggagaagtaggtgtccgggctgtacgccgagcaaagcacgggagatgacaacttggctgcgtggagcaagaggtatgtcaccttgagcccatggctccacatttgtgtaccttagaataccatatcgctcattatacatcccatggcatgcgtatgttggagcagaaacagaaggataaaggacgaggacatcgtcctctggtacacggttggcctgcaccatgttccgtgccaggaggactttcctgtgatgccgatgattagtggtgcattcgagctccggccattcaacttctttgagagaaacccgctgatcaggaccaggccacccgggaactccccaaactgctcgtgcagctttggaagatccggataaggtgatcgatgctgccgtgcaacttaattatatttgagatgtccttcgtacttactcggataatgtcgaaaatctaactttgtgacgtttttgtatcatttaatttcattttcagtaccagttgaataaattgtgtttaagttgtgagaagtcaggctccatcgtgtggttcactgtcaccttcctaatgcctaagctttgaagctgactgcagtatctctcatatccacatatattctgtcacttgcatacgctttgtcaatcaaatgtcaatgccttcaattattgctgctgccaaggttactgttccaccatcatagatcatgtagggtatacatatgcatataagcatattgcttggtcacctggttaacgtcatggctttgagctagctatatgacccaagcatgttttcatcgataccacgaatggtagcttcattccaactttggcagtttttcaatgtgcccacgcaacgcgcggtggttcctattgaatgaaatatgtaatttgattctattgtgaactgcatatatatcattggtggagaagtgctttttactcccggttcgtaatccccagtagtcccggttggaaccgggactacgaatctgggactaaagatcgctatctttagtcccggttaaagccggttggtaataccaaccgggagtaaagagagaatagcggtggtcccaaatgatcttttttttttattttctcccaaatcaagtgggatgcatatccccaaatcaaagtaacatcccaaatccacatcacaaataaagtaacatcctaaatccacatcacaaatcttaaagttacatatacatcacaaatcctaaaaaattacacacaaatcaaatacatcacaggtcatctcagatccatccaataaatcacaaaattatacatgtgaatcacaaattaaaaaaaaaagaaaacagcgccgttgccgccgcccgccggcacaccgccgggcgcggccccgccggccgccgccgcgcacggccccgccggctgtcggctgccggatgggaaggggaggatgggtaggaaagggaagaggaggaggtggaggagaggggaggggatgaggaagggga

SEQ ID NO: 70918 - DNA, 11849 bp, Oryza sativa
ggacatagggtgtgttgtcgagaagaaaactgcataatgctatgtcaacagagagattaaaataactgaaacccccaaaacaaaataatttggtcagtttcaaactgtggtgattgaatggggcaaacaaatacacgaggagatcattaaaccattatgatttcttccatatggcgaatcaaacatctagacagctccccaccaatgcatcatcagttcttgaattctctgaatgagaagtgttgcattttggtttcttctagatgcccacccactatcagtaattaccaaaataattaatgcaggttaccagactctaatcaacaacgatcatatctccgcacctacattagtttacttgctatgacacttttcctattcatatcaagttagacatttggatattgacaacgacctagtatgttgaaagacaacatagatgttaggtaacgatccagtatgctaccatattgcggaatagaaaatataaattgtacccaaaatcccaaattgtcaaagttctgcataaccagtatacaatcagttcatttaacgatattcttgccttagaaatgactatcggaggtagaactaagtagccacacttaagcaatcagaccatttaagccatgcctagcatttaaccttagctgagcagacaaaacgatacaattaatcggacacagcactgtgacttgcaagtgattgctctactatcaccatgaacccagtacctattcaactattgtaaatattaaagcagagcttccatatgaatggttagaaccgatatttgccttgaacatcgaatgtatcatctggttcaataatgtatagtccaatctacattataatacgcgtagcatcatgaaacctaagagatcgaatacttcgcaggcaacaccagcatttccagatccatacaaagtcaatcagccagcggatctggttgtcgaaggagagtaggtaccttcttgacggaggcggaccaggagagtgtgaggccgaggaaaacgatgaagaagaagggcccccagagatcccaatccctgagcgccttgccggggtcctcgcggtaggggttggggaagacgacgagcttgaggttgctgacgatgcgggcgaggtcgcgcttgacggtgtcccacacgggctcggtgagcgtgttgggcggggggccgaagccgtcggaggcgatggggacggagacggaagcgggcggcgcctggggcacgatgatggggacggacgcgccggggagggagggcttggcgggggccgggagcggggccggggaggtggagaccgggatggaggcgcgcggcggggacggcggccgcgccgggagaacggtggcggagggcgccgcgtaaatgaggctctcgatctcgtccatgtcggactgcgccgacgacgggtggagcgggatcgtgtcgccgtggttgtgcgacatggcggtggcggtggtggatctggcgcgtcggtggcgcggcggagagagatctcgcgggagtgcgtgctgggtttgggaggagagttggggtggggaggtgcggatttgcgggtgggtgcgtacctgcctgccggcctgcgactgtggactccaccggggggctttgcttgggaggagggagacgcgggatggcacgtgatacgacgtgagcgttgagagcgcgcccaaagtctggagaagcttaaaattgggataagcggttgataagaaataatctaaaagctagtttttcgattttctgaatttgatactacgggtgtgtttagttcatgctaaaattaaaagtttggttaaaattgaaatgatgtgacagaaaagttggaagtttatgtgtgtaggaaagttctgatgtgatggaaaagttggaagtttgaaaaaaaaagtttaaactaaactcggcctacaactataaattcttaaaatctgactatttgtgaaagtttctccgtagtcgattgcagaggatcctgatcactgaatttaacccgtggaggttctaggagaactgtagcaccctttgccacgctccgaagcgatggtgtggcctacgcattggagacaatggagatctcccgtcccgagcttgagagggattagtgaaaaggactttcaccttagcctcactgcctcagttgctatgttcttctttttaccttttcaaatgaatactccctccgtcccataatataagggattttaagtttttgcttgtaacgttttgaccacttgtcttattcaacaaattttaaaattattatttattttatttgtgacttactttattatctacagtactttaagcacaacttttcgttttttatatttgcaaaataaaattgaataaaacgagtggtcaaacgttgcaatcaaaaactcaaaatcccttatattgtgagacggtgggagtaacattttaaatgaaacaaaacaaagtttttcagtatgtcccaaatttttccattgtctaaaacgtatcctgcaatgtaatggggattcaattgaagtttggtacagcaaaaccaaaacatcggatcctttttttttagatattcacaatgtaaaagtgaaaataagttactgatcaatgcaatatatattgaccgaatatttatttcactacagtctacggcagtcttttacaagacattatttttgacttgtaaccacacaaataaataagcaataaataaattgaacctctatctaacctatggacagctaaggattgaatgggaagcaacacttctcaagggcttgtgaaaaccattgaaaaaagtctagctgttcttcctttacatctgtgggtggtggggcaagcggaagttcggcagggagatgtcgatgaaatgagtctactgcggctgccacgccatcttcattcccaattgctattgccagttccattgttcgtgattttaccttcagcaaggagccaagaaaagggttaactaacaaacacagacatgcatttgctcactaccattcatttatgcagcgacttcacgagataacagcatacttttactgtcctacatgacaaatgagcatacacctacttgaatgcagaggtaataaatcgtttatttcttttcatgtcaacctggcaaagcatgccccgagtgttgtcaggggtgcctttgtcaatactatctcctagtatctcaaaagttatgccacaattttgtagtgaacgtgaagtttagcaattgtttggactcctaatgtactcttttactccctctgtttgtttctctttttttttttacgttggatagttcaaaattgaactaaccaacgtcaaataaaagagaatggagggagtgtcagtttggagggaagtccgctccaagctcttgaggaaataaacacaaaagattataaacataaaataaaatggaagcatagaaacagtactacctcaggatcaagcatgaatcttatagcatttgaaagtgcctcgacagtaagttctgctataggaataggtgcagggccacacccttgtgcatgaattctctcaccccagaagaattgatctccaaaaaatggcactatggtagttgggcactgttaagagtaaagaaataagaaacgacatggagaaatactgccgatagttattgtgaaggaaaatatatgacattttatgcatatttaataagatcttgtatattgaggaaactatgaatacaaggataacatttttcatatggatggagggctgaaaaggccctggttttgttttgtaatcaagtgacatgttttctgctaaaaacatgaaaatatcacattcgaaggctccaatattaatccaacctccatcggtattgaaatatcatttcagtttgtaaagagactagttgcttaccccagctacaagccccgcggctgtggtaccagccccaccatgatgtacctaataaacaaacatataacctgataagtaacatattcgggaacataatgcactactattgaacatcacaagattcacgttaacgaaatttatagttactctgagcaaaagttttcattctattgatgcttgataccatatggtaacattcgtttaaaaaattacacattgtgacgctttcgaccatattataaatacagctaccacattgtttgctcgtaccagcgtattctgtgataccacacaatatatcactgcatattggaggtagcatttaattgttttattttaaaataaagattaaataattctataatggtgtatacaactcggtgaaaaaatcatggttagaaaaaagaaaaaaagagaggaaaggcagtcttctaaatggtggtgttgcaatataaaactaaccactgcagcacagcgaggaaacagccagtcgtgagggcaatcctccaaaatgaagacatcaactggaacttctgaaactgcaattgcaggttgcattcataaatgtacaaggtaggttagttcgttattctgtgtccatcagatgtcaatcccaacattaaacagaacaaaagtcagaccaaatttaatcttctctaaccatatttagtcaagagctacaagaaatgacagtctaccagatttaaaataggttgctacagaacaaccatatttagtcaagagctacaagaaatgacagtctaccagatttaaaataggttgctacagaacaatgcccgcatgtttgaaatctactacctagtacacacatgctccagaataactacatcaagagatagtacgcacattgtaaagattgaaaagaagcacaattagaattcagaaacaacttacaacttccaagatctccccaaccccgactaatgattcctctttgtcctgtttctcttagtgcgtccagaatgacagaagtgacttttttttcatcaccaagaggcttcaaacacaacaaaaaccacattagcagaactatacagttctcataacggaacataagaggaaataattctcatatcaatcccatcatagatgtctcaaagggctgtgagtttaaggctgaaaacttctgagtatctaattttcacaatctaagaagatctatctattatttatgtagccaaaataacatgattcagttcagatgtattaggaaaacttccattggcatattgcaagttatcaaaggattagatggatgaaaaaaaattgccgttcagaaaaacaaacaagggggatgcaacttgcatggtggaatgagaatacaaaaggtattcttatggttagtttttatatgaaaatattgttgtcatacttattgaaattatagtattcaaaacactaggttattgaacagtcttctactcatttttcacatagggatcataccatgctaccaaaaccaatatatattggttttggcccctgttgaagccactgagaaagctcttgcggtggttgatactttgttccaagatttaagaagcaatatcccacaacatccacgagaggaccccaatctgtagatgaaaaaacatgcacacaataagatcctaagatatttgtaaggcatgaaaatcaacaaacaggtcatggtggtataattataaacgagcatgatgatgattcattttgtaaaagctaagtaagttttacatctgcagactgagttgcttgatgcagaaaatatgttgtaggggtccaaagcgcacataggtcaatggggataaatgttatcatgatatttgcgaaacaaaaaaaaaatacatacgctagtatttctttttgtgtgtgtgtggggggggggagggggggcatatattagtgtttctaaccatgctgccatccatatctatatatatggtcagctaccctcacatgcacaaaaaatggaccctgtcaagagggtcctatcactttattgtaatgggctaggatacctaattacttggatttatgtttacaccataaggaagaaaatatatctaccatatacatgagacaaaaaaaatgatgtgcatttcatgttgaagctcaattatgcactaacagataagttgtatcatgaaattttagaaaaaagtttatataaggataccatttggcttcggcattagatgagggctccacatgtatccagtaggtaagtgtgatatagatccatgatatgtgctgaaataggcaataggggccaattttaacttcttcctgaactcatttatgaatcccctggtgccccaccaaattactaaatccaaaatcagataggatagctgaatgtgagaggtaagcatgtcagaatctgattcatttttaaaaaatcaagacagatcaattcgactgttatatacatataatggaaaataacatatctaaattgtggctgcacaactgtgaaaaaggtagaggttgtaccctgtaagttgcactctgaggcattcgtgccaatggatgagggaactcattagttggcctgcctacaaatattgggagttagaaaaaaaggatatatatcaaccttacacaaagagtacaccataaatcttctcaaataaaaaaggaatcagtcatagtgatcgtaggtcctgccatccagctcctatcctcacttcaaaagattgaggataacctacatggatatgtaggagtgcatcctctgcccacgtgtttatgcatgtgagcagttcatctaatgtgaattatactgttatacatccaatgttttatgaagacaatttttactttgcacttttcataacccaaatgaagagtcctcgcagctcactatttggtagagtttacattagaatttcgagtactagttctgttgtttttgtactataactatttggtagagtttccgttagaattacttgagtactgtttcctttgtttcatactatattcaggatattagtctagcatcactaaagaaatttatcgagcagtgtcaaaggtgttcttagtaaaagtttctagcacaatcaatagcaagtgggacatgaaaaggaacgacacaaaaatcttaacagggatagccatgatgataggaaaattataaaatgtttttatgctggcaaggagatagtacagacttacgtccatggaaaagtgaagaagatgtgcaggggtaccccaagtgcctctgcaatatgtagatgtcctgaagtgatataatttgttagaagaatataacacagtacactggtatatcaatattagtatcgtaatatttacaagtcctatgattacagtattttggcataagaccaagcaattgctttgcctttcaaagttaatggatgcatgaccattgaccagtcaagttgatgctttgttaattttttaaagggataaaagctggccaaaactttagtatgtgagcaagtagcgcgtgttcattttaccgtattgacagtggtttaagaaagtttacatggtggtactctttaactgttgcattcatagcaaatgttgaaggcctcagggtaaaggcaagcatacttgatgaaatgggagagataaggctttcaacaagtcaaaacctcggcagtagatccatcgcctcaattgaatgccaaatactaagtagttttaatgactcagaaaacaaaaatatgaagtcagaagctaacagaatttgatgtgcaaaatagtcctatctatctagtacttcttctgtttcacattaagacgttttgggttttgcataggttcatgcatggattcaagtatgtgcttcatatatgtgtccaaattagattcaagtatgtgcttcatatatgtgtccaaattcatatggatgttagtgaatctagatgaacgatggagaggccaaaatgccttataatgtggaacggagggagtacataattaatgcaggtgcgataatggattttcttgagagattataaatttccacatttataggaagaaagcatccaacagctaaaagtatcactaaatacaactctatctttcttacaaagtgcatattgtggcatgcacaactcaataagatttactaaaagaacatgctaaatcaacaaatattataaaaaaaacttataattaacctttggtaaagagaatagagtggtgtcataacagcaaaacccacctaaagcaggaggatttgcaattattgcctgagctctaaaaggtaatccagtgtccaaatcaggttctgtgcatgcaggtagaacagagaaaattatttccttaagctgctttctttgaacagaaatttctgtgggtccagccaggcaaaatcctttgttttttgtcatatctgcagttgaaaatgccctttgtcaaatcaaaagtatagtacaaacatatttataaaaactccgttcaataaataactcataagcactgttatataacttgtgaaaaccattatgcttcatcattagcaaaatggcataacaggattatgacggggcaatgttattttaacaaattcatttttgtggacaatcaagtctaccaaaataagcaaatgcagccttatgagtaaacagtcatatattttgagcaaggcaggtgacaagattaattcagaataagaaaagaaaaacatatggtgtataaaattttccattcctggaggcatagcagtatttatacaatctataaaagcaggagacagcaaatcatacactgagccaatatgcgaggatcaccacccaacgggtaaaaatcaataccagctgacttcacaaaggtacggaaattggcgtgagttgccaatctaacatagtgaccaaactcctgcaggaaatgccaaaatttctattagggaaaattggtttggtgaaactgaaagataccaactttagaaatatacagtccaaagtcacatgtgacaggtacacttaataacatccaatttttgcactatttagatatctagcattttgtcgcccttccgttacttttacccatttttcatattttttggactgaacaacagatgggaaaagacaaaactgcccttgaatcattaagcactcagtctactctacatcatcctggattgatccaatcttgccatctctagccttgctaacggctcccataaccgccatctgctcggggactgtgctatcagcatggaactggttgcatgagcaggtaaatcgactgcggcagcggatagtgatgagggacttgttggagtaatgaggagtaaggattaactcatcatccattattgattgacaagaaaatggtgagacaacctgcgtttgaaaggatttgaactcaggccgatgcactgctcctggcagctccctgccagccgagctagcagccattctcggtgatgagggactagcggagccggctgatggtccaagaccatggctggcatggatttgacaataatgccaccggtgagtggtggtcagggactgtggcagcgccaatggatggtgaactagaactgcaccagttgtgaggaatcaattgcaccgccaccgacgagtggcgatcagggactaccgcagcagcatggaattgtatgcggggatggtggagtcaactgcagcagatggaaagaaagtatggggcagggaagtcgactacggtggcgacggcaggggatcaactgcagcggcaggctggcagtacctagagttcgctccaagtgcaggctctgtggagtttgccagcgaacgagcagtttgtcatccacacagagggtatttcggtacaagagttatctgaagcccatcacttgatggaaatggtagagaactaaatgtttgtaacttcgaatggtattaaagtgaaccaataactctgagtggtatatttttaaaaccaatcttccctttctattaagggggaagcaaatacaagcttgcaaatatattgtaaatccagtatgttatttgatgattgctattaattaagaggattccataagatatcatgagtatatacacttaaaaaataaatacacaaaaacatactacgggtgtaaaaatagtgcaatccaagtcagatatatcaaggtagataagtaaagagtagtgtagctctgtccctctaaaacatttcaaaggctggtagacagcataaacttgtagccatggttcagttatgtgtagtcttgctcataatctcgaccaccactgccaggcaggccgttatgttcacatcatctaaagttatcagaataataatcttgagcacacacttaacaaaatagacctagcatatcaattgtccacaagaactcttgaatggatctctagtgggagtttgcaaattcacttgcctgaagtcgtttagctaaggctataaatggctggacatcccctcgtgttccaactacaagaataacaatcttcaactttgggactgacttgctcaatccaggtgcagcttccacaatatcacgagacagagaaccgaatgcatcaatctctgaaagttcggatgcaataagagcactacgtttcacatctacctccagtgtaccatcattctggatctttaccagattctcaattatctttatctgaaatccaaaataataatgaatagctaaatacatggtaccaacaaaacaagctgaattcaatgccatattgacatataacttccatttttgtaggtaaaatatcacatgagaccctaattatgaataggtaaaacacaaagtagaaacatcagttcttttggaacttgcaagaatcattctatgaagatacaagtgttgcttcctggctgttcacaaatttcaactaaagtcaagctctagtctcaccatgactgtagtaaacactaaacagcatatcaaacgtcagttcatttctagccccattgtaactagctcattgtggatagatgactatatagaatggtaattgcatctagatatcaggctgcaggcagaaactagtatccattgttacattggcaataatacaaacaacggaacagtgtcacatgaagtttctggcatgcatgaaaatactgcatcgtatattgaatgcaaaaaattccaaacgtgtaatagtataacataatatgaacaaccttctcattttccgatagcatatccaacgtgaggtcacacttgagcaacctatcagagtatgatcttacaaaaacatgctcttgccctttagaacaatccgaagtggcagttgtggatttactatgtccaaatcctgtggcagaacagattgcaatgttggcaacaattatatttttagcaaaaaataggcgtatataatgcagtagtatatatctactgtatgaatatttctcagtgaaacacctgcaggtcccagatgttttacaacaataattattatttttttaggtaaacaataatagtgagtatatcttatacaattctccgagctaatgcaattgagaacagtagattgcaagatgccaagataaactctgaggcacataatattaaattattcagccttccagtcttgtaataaagtgagaacatgactagccagtgttgtaagaaagtgagaacatgactagcgtgagctgtaaaatcaaaatcttagtaatgtgatgaaacgaatactcaggccaaaactccatgttatagtaagaacaaaattgaaatggagcaacaaccttgtaaatcagtaagttagctatatctcatcctaacatccttacaccaacactaaagtatagtaaacaactaaacactaccaacttgccctgaacaccccatcggcattcagaattcaaacatgcataaagcttaaaccatctaaaatggctatatatatcacaaatatcatcatacatttgctttggaagtggcaaaatacttaaactggtgaaaatttgtgcgacctgaaagttcccccttcccgaaaatttagcactatatat

SEQ ID NO: 70919 - DNA, 1908 bp, Oryza sativa
aacagcagcgctcataggttaaactcctcctgtttgtcctcgtcccacacggggacacctttcttcttccacaacagtttaagatcttcgaccagtggtcttaggtacacatcgatgtcgttaccaggttgcttggggccttgaataataattggcatcattatgtacttcctcttcatgcatagccaggggggaggttgtagatacacatcgtaacgagccaagtgctatggccgctgctcatctctccaaaaggattcatgccatccgtactcaaaccaaaccgtatgtttcgtgcgtcctttccaaattatttaaattttctgtcgatgtttctacactgcgaaccatcgacggggtgtctcagcatcccgtcctgttgacgctcttcggcgtgccatcgcatcattctagcattccccttgttcctgaacaaacgccttagccgtggtattatagggaaataccacatcaccttagcaggaattctcttctttgttagctgcccgtcaacttctcctggatcgtctcgtctaatcttgtatcgtagcgctttgcaaacagcgcatgcttctaggttctcatactcctcaccgcgatataggatacaatcattcggacatgcgtaaatcttctgaacttccagtcctagcgggcagactatcttcttagcctcgtacgttgtctcgggcaatttgtttccctccggaagaatgttcttgacgagtttcaataaatcgccaaatgccttgtcactaaccccattttttgccttccgttgcaagaactccagagtggtatccaactttttgtgcccctgctcgcaacctgggtacaacgaagttttgtggtcctctaacatcttgtccaatttatgggcccccttttcactttcgcagtcctccttggcgtcctgcaacatctgacaaagatcatccgcaacgtcgttaccatcagcatccctttcctcctcgcccgtttgatttccttcaaatccaacgtactgagtaaagtccggaatattgtcgtcttccacttcatcttcttccatttcaaaaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcgaaaaaaaatcatacacaaataattattcttacaataataacactcatacaataattataagataattacaaactgtttcaacagtcatacaataatgacatatctttattcatacaaaaatcataaaatattacaccaaataattcttatttactatttctaaagttttaaactaattttaatgtgttttacttcttttaattttcatttagtttgttttctagtattcaagattaactttcattatagttttccttctcaactattttataaaaccttctttagcaaatcaactaaatttctatatattctttcttccccacacaaattttctctctcatcaacttacaactaaattttggagacaaaaaagtgtgtaaaacatagctacaaatgtaatatgacaaaaaaaacattggaggatgaagttgcaaaccttttaggcacctccgatttgtatgtaatcaccaaaataaattcactagaaattttggcatgaccttccctcttttttgagaaattttgaagcttgctcgggcagctggaggaggaagaagacatatatataggggtgggactttaggcccggttggtgttaccaaccgggg

SEQ ID NO: 70920 - DNA, 6539 bp, Oryza sativa
  unsure (1)..(6539): unsure at all n locations
ttcctgcagccctgacaggccctgacagcatttgaaccaggactaaagattggttggtgttaccaaccgggactaaagatcaaatatgcccgttacccttttgaaccgggactatgctgtcagggcctgtcaggccccccgggatcttaccaaccgggactaaagatcaaatatgccggttacccttttgaaccgggactaaagatcatctttagccccggtttttattgcatccgggactattgtggaattcggccgaccgacgaaagatgttttctccaccagtgtacaatggtatatccgtgcgcttgtggataaactctgcaaccataatatactagaagtatttctgcgccattgttgaaaattatattttagtaatgtcgttaagaaataccaacagcggcatgccaatcagctgcatctgcaaacaaagcagggcatttcatttattactaaaagctatctattttattgaattgactttttgtttgactgagctagctgcttgttcgatgaaaaattgtgcaagcatcgaaaactgctattggatacaatgtatattgacaattcctctgtgcaaggattcaaatcattttttcaacagtcccttgttacaatgtgcaggttcattttggccagagtctaaacattggataataaaaagcaacattagaaatggagctaaagttttacacagccatatataaatgcataataaagaaagggatgcagaactcatcgagagactgagaaaaagaagattattttacctagaaagcactagacagggctagatttcaaatgatggaaactacagagaaagcagcaggttcagacagggcgtgttcttaccgcgggatcagagtggcttcctgagcaatgcgcaaaagacgctccgactgatgaactgcaaagtccacagccacatcagagaaatgacaaacattgcctctgcgaaaggggggaaatctgcataaaaggggaggggaaggaagtgcggaggaaccaagcaggaagcggaacgagaaggtggagaagcgcggctcctcccgccgcctcctcttcctacagcccggctccaacggcgccccagccgactgtgacaaagcggggcaaaaaaaaccctaaaggaaggggatggacagtgacagctggtgctcacctagcgagtatggacggcttcgcgttgctcacaatatttacagataaaaaaaagcaatccgatctggctacatatctagaaaattgatcacgatcacgggtacttataattagtcgcctaatcgaagtgacggaggatgccatcgttgccaatgcggcgcttgatctcctcgtgaccctccggcctgaggacggagaagtcgtcgtcgcacctatggtggcggatggcagcctcaacctccgcctcctcctccagcgtcatcggcgggagattgaacctcgcgtagctctcggcgcttgtcgccgccacccacgcggcgaactccatctcctcacgcagctcctcctcatccctcttctcccgctcgttgatctcctggagcaaacagaaagctctggctaccgccggaagccagtccgccggctcagccttctccgcctccgcctccaactccttccacttcacattccggctacccgccatggattttaagcttacggttggctcgatctctttcgttcttgctttgtcattttaaatagattggacccggtgtgcaaaagtcgatttacaacgtgcattcatgttcctgtgcagacacatttctttccgttggatgtgctttgggattcgagcacagcaagccttctgtgtgctgcattaatgttcgaaaatgctaatgtaacatactcaaattttagaccttaaaaatttcatgtcaaaatagttggaagctaacttttctatttttgagaggcaaatatttccatttttaacctaggtgtggtcaatctaacttgaacctaactaaaatttgagaacaaattaaaacctttgcatctctaacctaggacaaaaatataaacctatgtgtaagcatgcatactctcataggacatgtttagacttgagtccttcatatgcatttggattttttatttgcatttcataataggtcttatgaatataattacaatctagacaaacaactaaaccattagggcttagtgctaactaatggaaagtaatacataggaaccataatacaacttaaaatatatcaacaaggccaatgtcaaaccccacaaaactaatttggtcatccatctgaagacaagtcatgaacatggaagtgaacaaataaattaactcatataaggtatattctatcttaatcatctctataagcatcctcttaatctaatactaaagtaaacttatacataaataggtaagaagctaatgacctgtgtaaggtaaactgtaactcaaacatatcaatatcacctcaggttaagaagagtccaaatataacttttataaccatttacatgcatttattttatgaggaggaaaacacatatataaagataagtcttgtcaattatctaaaataatttgtgcaagataaaatcatgggaaaattcaggtaggctctacttaacttatataactgactataattttggtataatttaataactaaatttgatacctaaagtaaatcagtcaaaccagtcaaatagtaggttaattataattcttaattagctaaaacctaccctcaccaaatgtgcattaaactgcatggaagtgtatagaagtgtataggggaaataatttattcaaatactaggtttccagaatttatcttctctgtttaggtctcctaaaaatccaaactagtttccaatgagcccatcttcttctaatttctgtgagcaatctatccataattttcaagtgtaatcaaagaaagtggaaattaggcataatcatctgcctccagtaaaatcaacactagttaatctcgtccacacattaagttatgaagctacaaagttaggaaaaaataattccggaaattcatccaaaaaccaatctcacccacgtttgtacccacacctctctcttccacctagtttgccacgacctgggcccacctggcagcctccctggcttgcccacgccctgtccatctcctcctccaccgctctacccgaccaacagaccagagagacaggagagagagaccgagagctgggcgcgtcgacgcgtgggagcgacgtgtccacgccctcaaaacgccaaaccttgctctctatctttcccagtcacatcgccacacctcactcaccattcctatgccaagagaaccgagggagagagctctagctgctctcctcgccttcgatctcaccgccggccgtgatgaagacgaatcttcgccaatcctatctcttccacgttccatactctcctcaccatgccgaatatttctccttttgatttcatcctctctcgtgcagccaatcgacgggaacgctgccgtgcccaccggagctctggagcgcgctctgcgcaccgccgcagcgacattgtcgccgttccggccattgtagaccgtcgtaggctgagccacagcaccaccaacaccttctccacatcctctccaaaaaccccccaagaattcccaagaatcgtgcactgaggagggagattgactccctcttccccaattccagccgtcaagctccaccttcgatttctccctctccggtgagtcacagttcaatttctcgggcatgaagctttcctgagacctattcaacaccgtgtgtgtagctaaacatctagatcaatgctctagctccacatgcaccgtcaccggagaaccaccgcgccgctcgcgccgccgtcgccattaattccggtgaccaatgcttgcaagaataccacctatagcctcgccttgaacccctttacattttctccttaggttgcacgccgagatctgccgccgtttgccgccggcgagctcgagaacgagctcggccatggctagctctgtgtcagctcaaaccaaggacctcacttgagaagaatcaaaactctaggtactagtttgtaaaacctatctcacacacaaaaaacctacctgatcagatccactacaaaagaaattgatggtaagactacactataaaatatcatctcaaagattatatatcatgtgtatatgaatttggtggtaatatataatactaacagataaaagaattgcatagaggtatagaaaagaggaaattgagggccatagacatccttattattcctatattgtgatagtaagttttcagacttccctatctaataatgtcgcatcccaatgtttgcctatatgaaaatatatactccctccgtttcacaatgtaagtcattttagcattttccacatttatattgatgttaatgaatctagacatatatttctatcttagattcattaacatcaatatgaatgtggaaaatcaatatgaatatggaaaatcaatatgaatgtggaaaatgctagaatgacttacattgtgaaacggaggaagtacatgtatattaagaaaaaaaagttcggctgcagcagaatatgcatgacagactgacagcactaaagaccatatgagaacatatactactaaggttgtgtttagttcagcgcaaagtttggattttggttgaaattgaagatgatgtgactgaaaagttatgtgtgtatgacaggttgatgtgatggaaaaggactgaagtttggatctaaactttggatctaaacacaacctaagtaaccctcaattaaataaccatgaacaactgaaatgtgtgggaatcggcggctacagtaagttgacctgggaagaagatcagcggcggcggctgatggagaagcacccagcagccagcagctaatcaccgttctattcaaaccttcgatccaacattcatcgaatcattagacacagataaaaccctgcaaacaagttgaaaattttagacattgtgcatcaatctagccgtggaaaaacactaatctgttgatttgccacttgtgcgtaaatagcctgctactctccctcagatgcgttcattacatgcggggcaaaagaagatgatgtgaatcgtatacctcgtcgatgggttgtcggcatatcagctggcgcggacgtggacggaggcagaatgagacagtgatgaagtttgggcgacgcggaggagacactcgaggccggcgacgtcgcgtcgatctggaggcggggattgacgtcggcacggtggtggagcgtcggcgctcgatcagtgcgaagccacgcggcgacgcgatggcgtcggcggcgtcacgagtcgtggtcagagtgaggggttgttggcggcgtgatttgcgggcctgagttggtgaattatagagtagatttgtcaattaatttttttaaagaaaaactactgtgtgctgtaacagtggagagagagagaaacagtggagagggagggagagaggtgtgtgaggacatggcagccagcaaccagccggccggtcatagcgacacgcgacatgggagtggcgaggctcaccggaggggctggaacggcaaggaacagcaacggcgacgaggaagaagatgatgccggctcgggttgacgtcggggatggagctccgaggcttgccgagctcgatgaaggcgtggctgagggagaggaggagacgacgaagccggcggtggcttcgccgggacttggcgacgccaagcggcggctggagcgcacgccgaaacgacacgacggcgatggagcgagcgtggtgctcgagcggcactgggaatgggagaaggaggtctcgggggtttcctttatataggctagaggggaggaggtcgaccatgaggatgggaaacggcgctggcgacagtgaaggtccctattggacacaccggtttaagaaaccgattaagtgcgatttaatgtggtattgagtgcgatttgttgacggaattgatgcctactacacaagaaatcaatttttgcaattactttcaaggaaaatcaaccgaggagggagatcaaaggtagcggcggcacttgagttcacgggagagatgaacaggtgacgggcagaggtggaggacgctcgtgacgagtggggcccacctgccagcgcacgggcgcgcgcctggcagcggtggctcggagtgggccgggcagggtggcgacaaggctgagggaggggaaagaatgaataagttcaccggccgtcccttaagattttttgaggccccttaaccacaaaaccagaaatgtgcacccctaaactatgtaaaaccgtgcataaaaggtcccaagacagtatagatgcctggtttcgctgacgtggcatcctagtcagcaaaaataattaaaattaatatgcggggccccacatgtaagtgagagaaaatggtgtgggtcccacattcctctntttttttttctttttctcctctcttctctctgggttctctcaagccggcaccgcggcaatgggggagagaggtggcccgcggtgga

SEQ ID NO: 70921 - DNA, 15328 bp, Oryza sativa
gagcgggacttcttccctgcgccggagtcaccgacggccaccttctcctcacagcttaggcgctcagcgtcagcgtcgttcctatttggatgggataggtggacgtagggtatcccgtcgatacccttcccgatggtataccggtatatagcatttccgaaagaaatacaaaaaaacttgtgaggtccacatgatagtggccacctcacctccttgctctacttcccctctcctcacttcgcttccccagctcctcttatctcctacgcgtcgtcgagctcgtggtcaactccattctcaacctcgtcggtgagatgagaagcagaagcatggcccccatcctcatcgagctcttccctatggcgttatccacctcccgtcgtcacttctgtcctccatgacatacctggtcacacgcacgacggatgttgctgacgttttctccgccgctccaggacctgtcactgtcatcctcgactccacctccggcagtgagctccgttatgctagcatcgctgactatcctctactccacgacaacgggcctccaccaccggcctcaactccgtatctccactccaggtcggccaagccccaacaccgcatccgccttctccaactctaggacccgaccactttgtcgaccatgccatgattgcttctccctagctgacagcgcctcaacggatggcctcatctctatcctcctacccatccctaatgacatcaactctatcggttggcccccggtcaaaaaaaaaactctattggttggcccgtcgaccccgcccaactccctcctcgacacgtcaccaaccacgacctgccacaccctctccaccagtctgccccctcacggatctaaggttgtcgccgtcccaggcttctttttcgattgatcggcaactgctcgtcattgtcgttctacagagccaaggaccacgcttcctctagctcgtcttccactcaagctgacgccgtctccacccagcgtaccgagtgcacactatcaacggcgataagaacaagggcaagctcgactacgccgtgcttggagctcaccactggtgctcatcggtacggaggagataaggggaagagaaaggaggatagggaaatagaggaagaaggtggtgtgaccacttatagtgggccacacaagttattttctcttgctaattcggatactacatcagtgaaatcagccatatatactaccacgggacataatttaatctggttttgtaagtcgggggtcaagattttggtattgcggttaagggatacatttaaactcgacaaaaggaacgtcaagtggactcattcttggacaaatttgcaccatgggcttccgtgtcaactgggctgttactatacagcttgagaaatggcccatgagagaaaagcttgttacttctatttgcctctcttgtttctgctacttttggtacgagtgaaacggagaggaaacaaacaaccggtgactggtagatgtgatgggcaatgcgccgaacgccgatgcctcgtcaccacttggctttacagcgcaacagctgctcgctttcactggccatttcttttttccaggccgggatagctactggccgccgctacaggacgaggcgacgaaaaggcagccggtgtccggcgccaagtcatcgcgttttgcaggcgatgggaacggtccgcaccgcgtggcgtggagaacttgagatgcttctaggctgccgtccaggtgtgggcttcaggatgggcagctcgccgtataaaaaaaagttcatccgataggatgcaggatcagttgtgcccgccggcaagcgacggcatccagtggaaaaaaaaacaaatgctacgggtacagccgtacaaacctgcaacgtactgctccgtagcacctctttggggaaacgagctgcatttgccggcacagcaaaatcataggtatgctaatataaatcttatcaaaatttaataatggtaaaattttagtaaattaataatattgctaaaatcttaattatcaattttaacaaaaaaatagtatgttgatagtgtcatcaatctgaacatgctcatactcaaggtgggttcgtaacaagtggtgccatctaggaagtcggaaccggaaatcagcttggtgagggcagtatatgcatattgtagaagccatagctcgacggtgagagtaatagacgaagcgttaaagccatatgttaagaacgcgttgacgagaagctcgagtttgaggttatggccgtcgtcaccagatcaagcccctggttaatggagaagcgcaagagataacacataaataaatagttaaaagataaaacctagtaaaaggttttagagtggtcttattctacttctaagaactttcattggtcatgcctttatacaactagtgtctctataggttttgatgaaaagaaagatgcttctacatgctagaattatgtttcacattcactactgactactgtttactgcatatacctttagctttggttaattcaagctatcaagcatatgtgaaaccaattaagacaatttcttcctccttctcacaatggtattccttttagcagtttcaaatactatgtattttcatttccaagatcaaaaccatggttttattgtaaaaaaattgttattcccttttcattaatcaaccgtatcgaaaccaacaaaatattgcatttatgccttactccaccgttctaaaatatagcaatctaaaattggattagacttaatactatgaatccagattagaggaagtaagttcgtttcttaaaacatttttttatacttccattttcctgttccatgtactccaggggtaatggataaaggctgtgtttatttgttttggcaaaaaaaatttgatgtatacggacacacatttgaagtattaaacgtagattaataacaaaataaattacaaattccgcctgtaaacatcgagacaaatatattaagcctaattaatccgtcattagcaaatgtttactgtagcaccacattgtcaaatcatgacgtaattaggctcaaagattcgtctcgcaatttacatgtaaactgtgcaattggtttttttcattcacatttaatgctgctatgtatgtatccaaatatttgatataacgtaaaaattgaaagtttgaaggtaattaaacacaaccaaaaattgcaaatggataaggcagttacttctagagtccttgttccagatacctgtaccttatacaagaagccacagtacgatccagcagacaaagcccccacacctgatcccatcttatctccttcctgtttaccctgcacggcacccattatccaacttaacaatccaatgggccgtccgtccgtcccgtccctgacctgcctccccctgccggcgcggcgcggcgcggcggattccatcaaaaccaaaccagtctccgaaacctccccaccattaacctctaaaccataaagtccccccgtctcatgtcgtctcatcactcacttataatcacccccatccacttaatcacgctctcaacgctgctgtgtcacgtcacgtcacgcgcggctccgtaataagaccaccaacctcctcctcctccctcccacgtttggagctctcgtctcgtctcgcggcctcgagccctcgaccaaccaaccacccgcttcttctctcccgtctcccgaaacctccgagagctcagaagaaaaaagaagaaaaaaaagagaaaaaaaaactggtggaaactggaaggtttgcggcggaaacgagggggagggatggtggcgaggagggcgtaagcggggggtgggggtgaggcggatgatggcgtcgagggtgatggcgtcgtcgtcgccgtcgcacacggcatcggatctcgcgcggttcccggcggggaggggtgggggcgggagcgcggggctggggtcgatgaacgtggaggagatcctccgcggcatctacgccgacatgccgacgccggcgctgcccctcgtcggcggtgacaggccgatgtcgccgctcccggcgccggatgtcgccgccgcgccgcggacggcggaggaggtctggaaggagataactggtgcgggcgtcgccgccgccgccggcggcgtggtgccccctgctgctgctgctgctgctgccccggccgtcgtcgctggcgctggcgctggcaccggcgcggagatgacgctggaggactttctggcgagggagggcgcggtgaaggaagacgaggctgtggtcaccgatccctcggcggccaaggggcaggtggtgatggggttcctgaacggggcagaggtcaccggaggcgtcaccggcggcaggagcaggaagaggcacctgatggatccgatggaccgcgccgcgatgcagcggcagaagcgaatgatcaaaaatcgcgagtcggcggcgaggtcacgggagaggaagcaggtgggtgtggaaactgtgcatttttacaagctttcgttcgccctaggaatttgagttatactgagaaggctgacgtcttctttttgttggtgaaggcctatattgctgagctcgagtcgctggtcacgcaactcgaggaggagaacgccaagatgttcaaagaacaggtacttctccgagaccccgacatttctcgtgtgcttgtttgatgttggaaacttgaatgtggggattcgtgtgttgagaattgaaccgtgtctccattgtttattgagcttaaacttgcagaaatgtttctgttaaatctctaggtgagtaggcatgtgaccatgaacatgttagaactgcaacagagttgggctgtggagccaaaatgaattgcaagtagtattcgtttttgttagccatctgcttaggatgccatttgccgtggtaaattttttaaaggaaaatgcttcgcatacaacaatcatatactagtgcaccaagcagcacacgctgttcggctgttcggtacagcggccacgctacagccaattgctacaccaagcagcacagccgctgcactaagcttgctgccgcacagcgctgcatcaagcagccgaacacggcatatgcatattaaaactcatctcattcgctgcctttgatgtattctcgcttttccttcttggaaaaggtctccctataaaatttgtagtgtgtacagaagttgtctgaaagaagtgttattcactatactcaccttttgttcttgtctccatttcccctgtccattttaatttagaatttcatactgtgcctacacggttacggctggattgtgcatgacttgcttataactaatcaaggatggcataagttactcttcttggtcttctagcaatttccttacgataaactccctcgcatgtgtttcaggaggagcaacatcagaaacgacttaaagaggtaagctttgtaagatggtgttgcctttaattatctagtgctttagagcatttgtgttaagtgccatatcccaaaaaaaacttcacccacaacgcatgccctggaggggaaaaaagaacatcgtcttgtgaaaatcttgtaatcaatcctggatcagccttcatataggaacatacagtacagaacacaatactgggtaagtatacactggattattccgtattcgttggatatgatactccaaacaggagatgctttttagccttcccactagcctgcaccaagtggcttggcaaacaaacaataggtgatgctgacacctttcgatggcatcagcacaagtgcacaacacatgttgagttttgagattgtctacctcatccatttctttcttgggagcctgttcaactcattatagatgcattgcatgtatatatgtctgattaaaaaggcctgagcctgcagttccgtgcttttccaccacggcacagcttgccaggttgaagcagtatatagttataaattgtcttcttttgtcactatcagggaggttgggttgagagggagatgctttgtcaatttggttgtataagttgcatcgtaggcacagttgagcccacatcttgcttaggaacagttcgcctccatttggctttgcatactatagttgtcttccatttagttttcagccagcataggatttcagatttcttctaattttgcctttcctgcctggattgtatatattgatttatatatatcttgacgacctgcctctcatcgttggtgcagaggccgaattccattatccaaaaaaaaaaaaaaatcttttgcaaatctatatgctcattaactcattcattaggttcatcgatcatgcttatctgaagaaatctgtttactttatgcagctcaaggaaatggttgttccagtcatcattaggaaaacgtcagcacgagatcttagaagaacaaactcgatggagtggtagacgtgagccaagctcagttgccatccccatacagtttatgtagcatttgctcctgttttgtcaattcttctgttttatcggcagtagcctagttgcggtgaatacatgagtatttaggtgacacgaagcttaaatgtctggagtcatatgctacggaggggagagtgcgtacgagctacaaaagcaatcatatgtgtagggaggggagagtgcatatgagctataaaagccatgttccaatttgtcgcgggagtgtattctgtcccatttgttgtctgtttcattttcagtttaacaattaggtgtagtgaggaagaattacgagtactgagtagtactaaacagggtgactctaggtatgctgatatgatatctagttaggcattacttctgattctctgtttggtgccacgactcaaattgtctgtacatacacgttggatgtaaagtcacattatcaagtgaaatcatgatgtatttcctccagaattttttttgactgaatttcttacagaatttgggatggctgaagtatcatagcgaaaggcagaatcagaaagatacaatcggtgacatgtgactgtactttcaggtcgaatttcgtaagccagcgcagctctttagcgtattttggagtattatgattctgattaattggcaatcatctgtgacgtaaaattcaaatgattcgttaagggtaactaaatgttacagttcatatatagtaaattagagtatggttcctctcgtgaagtgattccaaaaggccccctactgactttttttttatataaaaatgggggcggaaaagaacatgatcagttgcatcaacacaccaaacattagctacagaaattctaatgcagatgaaagggtaagtaatcactgtccatccttgattcagtttggcaaggagacgctaaaatcacctctaaaaacgaatattggcttctgctagcttccagccgtcagacattacccgattactgatagacaatcctgcctaacatcagcaacgaagacacttccagattcgcaccatccagccacaacatctgtattcgcacactgcaagttcgccagcaacgtcgttaatgctctcataggggctagcttaacagggttacagggaatatatatcgcagcaagattttgccgatgcacacaaaaacattatactataagttattaatgcgagaggctagcttgctcccacttataacaggactagggattacctttgaaaaacccaaccagttggagtcccctcgaaatgagaaagctcgctcgtttcccttccaaagtccacatgtaatctgcagtgaaattatacgtatcaaagaataaatgtttacatcacaaatcacaagcaaaataattgcatatgtgctcatcaactatggtgtaacaacaactaattaagttactcactagactaaatagtccaacgtgaactgcagccttgtgcagaagagttaacagccgtatataatctattaaaaaacatatatcaaaagctgcttccagagaaacaattatagtgtttttgtctatgttactgaaattcacgtgtgaaattggcaatgagcacatgataagctaatgcatagctgatgttcttaaaattaagcattctatctacctaaacacaggttgccaccatgcaaatgaaattagtcgctaataactccgagatgcatagaattttaagcgagcttgaaaaaaaaaattatcccacatacctcataatcaacaccttggacataaatgaaagattcatcaactgatgaaaatgaaaggcctgtaatctgtgtaggaaggtaaatattttatcacatcatggaacatttcaccctcaatgcaggtattatgattcttctatgaagaactgtggttgaaatttaacttctttatatcagctacagaaagcaatgtcacaaggcgggctaaagtagatcgaacctcatacttggagcacccaacccatcttgacaaggctgaccacctgcatacaatagatcttcaattaaatccagattgatccacggtggtaacttctattataatctgagtatcttgttggtaccagatacagaagtacaaaattaaaagaaatacaaattactccaggatagcaaggacatgcaactattcatcggatctttcaaactaaaagaagcaagcaacccaacctgcgaggatcatagatggttacagtacgatctgttccaccaacagcaattggtccagaaggagaactacagagagagtatatgatgcctccaatagggccagaaatgcggtgtatgcatccaccattattgctcgttctcaagtcccatatgctcagctgcaaactaaccgccataagaagagagtacagagaagaaagtttatacagggacggtggattgattttgagtctaacctgagaaccttcagcgattgctagcattgaaccactttcattcacttgtggcatgcactgggcaaagctaaatgaagatggataccataacctgcagtttcaattttttacatgctaagtcagaaatattttgacattacaaataaatttcagcatgcatatactagaagatattatacagtaattataatatggtcatatggatgctgatagatgggggttatctgtttcattcacaaggcttactttgaatatagcaaggcaaaggtcagatataacccatatggatgttaatttttcgtttcatgtaaaatcgcaagtggtcgatacattgtgctttagcaactttcaaaaacaacaaagtcagtcagacaataatctgtcatgaaggcaatatcctggtaagaggaaacttacgtacgtaaactgcgaacatgaatgtcctggtcgtagatatcaatgcacttacacaattcacgagcaacagctacctggaaagaatataagttgtacctggttatgtggtaatgcaagtgctctacatattgatgcttatgctaaaagtataaaagccaataggaaatgcactgtccctgtgtataaagtttttgctaacaaagataacatgtggattttgtttgtaggcaataataccgtggattggtgcattggactaaaacataacccagcccaacttccttctccgacaccacaatcacgaggtggtactgaataggaggccctgtcaatgtctgagcaagtttagtagcgatatgttcatacatcgctaatgagaaagatgcaaatatgggatttctttcatgttttcaattatccatgccatgttgaagacaagacagaaagttaccatcagccaccgtatctaaccgagatacaataagatgaccataagagtcaactgttccaagaatcaaacagccatcacctggtaaagtggtaatgccacaaagaagggtgtgaaataaactgtggaatatgtgccgttttaattttaccaagactaaaagaagaacaaactgaaagccgaattggaattgataaataaatttattcggtaaattacaatataaacatataattttatcctcagcacttaacaaccttgctttgtgtataactgtatatatcgttctagtactttgcctagtgcctgtgactggcaattgcatttacaaacctaagttagaaccaaccaaatagtcaactcgtatagcaaatccaacaagctaaaattaaaatgacagatcactaaaactgaaatggctaggaagttacaggcgcatgagacagtgcttggtgaaaattagtactagttgccaagcaattatattgaagcaagagcagttactataaaatttcctcaagatataatataattaaatactccctcaattccaaaatataaggcataaccaccctaacccaaagaccaagaaaataattattatcttgtagtttggatcatcctaataaatacaatgcatgcatccaatagaattagagaacatgagagtggaggatttaaaaaagtaataatttaatggagaaggggtaatagttaattgcctacatgcatgtatgccttatattatggaacatctagaaaaagtagttgtgtcttatattatagaatggagggagtacaatataatgtacggtcgttgtttatgctctttgtaagccatagtttcagcaggcaaagcggaatatgccaactcaaacagaagagtatatatcaacacattcataacaggttttgatggctatttcagcctatgttatgttaagtgaacagcagaactactgaactacaacattttaatctgcgaaataagagatggttctatattgttgtgagatactgaagattgcaccttcaccctctgcaagaactacactctggatctctgaacgatgtgggcagcgatccaccactgacgagcttatgacctttcatttagcaactgaatgtaagagagcaatcaaggaccaaaatcgtaaaatggaagtccctatggaagcctagagtttgtacctctgcattgataggaatcaagaggctctccttgcccttggacaacatctcaccctccatggctatctgttcagctccaagatgaaagagaaatgggaatcaaacttgagaaccgcatcaaattacttcccaaatgtaattacacgccaactaccaccaccagcaaaaccaaaacgaacaggagagctatgtccttaaattctctcgccatcctgcgccaacctgcaagagcgactaagaactagacagcccgcacgacaattcctgatcccacagcattcgtgaaatcgtgaccccttgccgcgatacagttgtacgaacagaaaggaacgaggagccagtacgagggtgacctcctcacctcaatcttgtagacgcggcagccggaggcgaggtaggcggagcaggaggagccggcggcattgacctgcgagatggggggaaccgaacagcgcgaatcctcagagccctgggtttagggttttggaggcgcggcgccaacgagagagaggaaggacgcgtacgtggacggcgaggcgggtgggctggaggctgccgggcgaggggtcggagagcagggacggcggcacggccgccttccggaggctccgcggcgccagcatcgccgccggccgccgcagctttttcccgccgccgctatctcctccgtcttgggtgggaccgcctcactaaccgacacggtttcaccacttcacaaaatcacactaactccttgtaaaaaaacaaaaaaacaaccacactaaactccccccattcaaaaacactaaccggagatagttatctcatgataaagatgctggaaacgtctcccgaactgcgtccatcttgcaaaaggatactggtacagtcaataggtcacagtttcccaaggattttgtttgtttttgttctttcttcgcttatgtgccaaacagtttcccaaggattttgtttgtttttgctctttcttcgcttatgtgttatctgtaatgcgatttttgcaggaggttctttaaaccagaaagctttgtagtgcttggaagaaacacgttctttcatatgttgctgttcacgaatcgaagccagagcctggagcgccggttgctgatctagtgtggaacaaagttgggttacaccacacttgcccctttctggtttgccgggttttggtgcgaccagagatgtaaggcgatgactcgtacgctttcttgcggctacgcatttgtaaagtaaaacggccgattttccagtagtcccaaactttcgccgaacagaatgtccctagtgcacatgctttcacgaaaccatcctgtcggctgccgcaactttgaacttgcaagatagcaagaacacaattttctgattcaaatgcaatattacatggcacagcgttggaacaatgacattagttttgaagctcttataaattattagatgttgcaaactggcaccccagattttttcttttaaaaaaagagagattctggaagtgttagtacatggctcaaggtgaccaatgatctttaggtctaggatttctctgcgaccgaagtatggacatctgatcatcaaaccaccctgtagtattctgtattcctgccaaaaaattccgcgatccaagtctgggcatctgatcatcagatccttagatcttgtagtatttctgcccaaagaaaatgaataagaaatgacaggagggttacatgtttgatacaactataatatactactacgtagcgtttacttctttaaagacacgactgtttgttttcatataaacaccagggaaaagaatactgctgggaacttctaacagatcattagatcaacaacacatgcaaaatagtgacttttgtgaagatagctcaggcagagtagagataaaacctatgcctttcctgtgctacctcctgttattgctttgcagattttcagttggggaaaaagaatggtaaatttacagaacaggacatagaaggattattgcacatcagtcgtggacgaaaagtttttctctcgcaatataatttcatatttattccattgccttttatctgattaagaatggtaaaggtggaaagaattgaaagattgtatagacatgtcaaccagtcatgtacagtactcgtgtgcttaacggaatgtagcatctatgttggtcatcagataaggtatcattttgctgttcctatgaacttcacgcaattaagaattatagagagattgagggacaacgattgtataaagggtagtaatctgttggtgtttactcttcctaagaagtctgatggtgataataatcatagatagctttcgtcctgcagatcaatttgggaggaccaaattgcaggtgcttgaatatgtagagtaggttagtattactcgaggcaaataattagcttcaaaatcagttgtcatatattatgtccacggtgccattaattttctgtctccttttatttattatactactgttttcactcgatatccagagaccatcactattctaaacaggtcgaaagctaatgttactctttttttttttgcttcatcatttgcatctaaagtaataatttgttctactttcctaccaaggattgcatctttttagaaccaactctcttcaaatcagttctagaaagcataatgtcagtcggctctatataatataggttcacttataaaaatgttatacatggcataatatcgagtttcctctttctatcttccagtaacgtgcagggtgtttcactacattttcattgctaataatcacaatcctatatatcctacagtaacagaacccagcccaactcatattatgcaaatgaggaagataatcatccacaagataaacccctaaatcatccacaaaataatctgtaggcagtaggctaagagttcaaatgagatgtttcttaacaacataactatatgaaacagcgttccaactctctatgaattgcaaaataataaagctggtagaaagtatacctcaatgccttgcagtgcttttttggcttcagcattgcttttgaagtgatcatagaccggcttcaaaccaaaaacataaggtaaaaccatttcagaataaaatattgttttcagtaagaacaatggccgaaagaaatcaagcacactcaaataaactattccatccgttttatattgtttctccttaactgccatgtgcaaaatcccagtaataagtctaagaaagagttaatgagaaatgcccgtgtatgactgcatgcatgctataattatttaaattcttttacatcatcaaagtaggatacatcatgggaatattgtaataactacactcttattttactcaatagaaaaatatattaaaatgacacctcatgagagaaaggacaacactgtgaaacagggcatgctgttgtgcaaatatgtacactgtttcataatatattatttctttcatgttagagcaacttatcaagaacaggggttactgtcaggaaaagaattactgcatgtggtgatccgttggaatagtgagccacattcttgagaagtgaaaacaaatagtactattttcttttttctattttgtttggtgagggcttcattgctaatgcatgcatcttcttgctcctttcgatatgcaattcctagcggaatttcagtccacaattgaacctagattttggagttaattctttcgaaaaaaataaaaaaaacagcatgtggagccagttgttcatcttaggccttcctatgtgaagcatatagatcttagcagtagaatttgtaacaaaccctgtattgggcatcttccaggtgagacaatttattgatctcaaaattgtcaatcatagcaaatgcagagaaatctcaaaatggcagcacccaggcaaaagaaagatgactgccaggcaagagagaaaaaggttacctgcaatattttgattaatgaatttgcgagagccagcttcatgtcaccaggatgcagaaccccacttacataatcagcagtaagctcctccatgctcaggaacgtcctgtatatttatagtcaatatatagtcatcacaatgaaatgcaatgatagtatcatctcctgacactggtactagcacatggatcttttgtgaatgaattcatttagttgtgacttgtttaatgcctgactaattgtcgagttgtcatgaactggatgaatgcattctactggtcaattacatgattataagcatttgtcaggaaacatggagaagtgacttggagagaatcttacttgttaccaccatcctctttctcccgaaccacctcaaactttccataccatggtaagatgatatattttatgtactccaaacatggattggcttctgctaattttggagggcagaaagcatgttttatttttctactgatatcaacctgcaatacactaaacgtatattgaacagactcatttg

SEQ ID NO: 70922 - DNA, 1581 bp, Oryza sativa
cgcgcggcatggcggtaggggcggcagcgagcgcagcgggcacagcggcgggcgcgtatgagcgccagatgcagccggcggcagatgtcccacccctctttcttgcccacacacgactgtcgtggtggccggcggtggctgcgaggaggtccgcgccggcagagaggaaggagattgggatgccggcgaggaggttggcgagcgctcggagagagaggtgtcgaggaggttggcgagtgctcggagagggaggaggtggaagtcgcaccgctcctctaccccatcgccgcgccgcacgccactgctcctctctcctgcccgacccgacctaggtcgtacatggagtcacaatgcttgttatagcaacgtggaatagaatatatccttcgtaacaaagcctcagcgatttccattgatgttgtggagctcattcggagtttccttgaatttcacctcacatagagtgcaaatgtgcaatgttgttgctcatctatgtgcaaagcagaggctactagcctactaataataataaatggcgtatctagcttaatttgtggtcttggattttcgtgtattatgcttagaaaggactgtactccaactactcattaataaaacataactcctgatttcgcaaagacaaaaacaaacaattctaatattaacaaaactggccaggcatatatttagacaaacaagctacctattttacttcttccggtcacgtacacatttgacgttgggagtattatatatatatactcccaatgtcaaatacacttgactggagggggtactatatggtaacaagtaatatacacgcatgctactatgtgtattaaattgtatgttaccatatatgtacaaaccaaaccaaagggaggtgggggtgactgggctctgccaagctggactagggtggaggtagagcgttctcgaggtccgcctgtgtgggagcacggcgagcttcctcttcttcctgtgctgctgacatggatgcccgcctggccctccatctgatgatctggaggaggatggcgttggcgcagatggccacgccaaagcccgcgaaggtggacaggatgatggcaatcaccgcttgcaatcgcacctgcaatgtatatatgcggcgcaaaaagattaagaaaaagataatattagattatatgtaacctatatatcatttcgctgaaaagcacaatagtaaatcggactttaaatagggtagttatagttgcatcgcggttgaattggtaattgattttagtatggtacatctataaatttaccttacatgctatgtttacagagataagtaagaacaatactcaatgtaatctatttgttcaaaaagctataattattcaattggacttcatgctagaaatgcgttatttttcctaattctaatggttccaaattttcaaaatgtcggtaatatcgtcccccccccccccccttccctgcagcagcaagcacctatcttgatgaaattttcagttttttttgtgaatttggacacaaattattcaaattcaatcaaaattcattaaagttttaaataatttcgtgcaaaaagta

SEQ ID NO: 70923 - DNA, 26972 bp, Oryza sativa
cctcatagaccagctgctggcggtcgtggacgccgcgcaccgtgacggggaggttgagcacttcgtggttgcagacctcgcacggcgcgttgcccttgatgctgaaccacttgacggcgcagtcgccgtgcgccagcgcgagctcccccttgcaccggcactccagcttcagcgtgccgccgccgccgccgctggcgccgtcctccgacagcgccaccatgcatatccggaaaccagcgcctcctcctccgcctccacgctgccggcgtcgtcctcctcttctccggcggcggcggcggcgtccgcattgccgtcgggaggagaggcgcctatcaccgacaccctgaaccgcacgctgccaccgtcgtgaatacgaagggagctcgagtccgcactctcttggagcctcctccccccttggagctgaatctcgacagggtgctcattggcacggactgtgagcggctgatgttcatgtggtcactcgcgtgcttcgccttgtcttcgtcttcgtcttcgtcgccgtcgtctcatcgttcttggcaaatcgagcgaacaataagcaggctgcaggctggatagatagctagatacaattagttaggcgaaattactgtacttactgcagaaatgtgatcactgcttgctgcatctgaaggtagcggatgatcaaaatccagcgacgacgaacaacgcgcagcatttgcaattctgaagctgaagagcttggagaaggacagcgaccgagcgccagccaccggcgccgccgccacctcgccatcgtccccagcgccggtagcctcatgctccgtgctggcaacagcctgctactcattcccgacgacagtttcctcggatcacctgccgactctctgaaagcagcagcagcagaagcaagctcttggtgatcatttccatatcttgccgaggaggaggatatcgaaagcatcgccaaggcaccatttctatctccttccattcgcatgctgatgctacttccacacctacttctgtttgtgtttacctgagcatgccattcatgtgcatatacgaaattagttcagttaagaatttcatctccatgatcaaactaaaagaacattgtcaatagcaaagcaatgattgaattgcaattgcaaaacagatagaaactcactcacctcctttgcttgttgagccatagcaagcactcgatcaacgatcagtcagaggccatatgcaggcaggagtgtatgggcagagcgtatttttatcttttgggcacaaactcacaatcaatgtgtcatgcattcgcaattaatcaggaaagcgacgtagcaagcgactgattgatggtcgaataaatggaccgaagggtaattaagggccgggggtgacgtgaggtgtgaacgagagaaagaagatcgagaagaagaagaagtactcccatccagcagcagcgactgcaggtagctgcctgcctagctagcttagttaggttgggtggtgtgaaagggaaattagctaccttgatggagactggtataattttgcaagcaccacacgggccagagctactggtagctagtttagatgtctttggcttgagctaattacatccttaatggttccatgcacgacacctcacccgacaaacaacgatctctgggtgacagttcttgaatttatatggtttgctgctctgtacagacatttacatataagcttgctcgccttagcaacgtttagataattaatttcattacttaatgtaaagcatttccattaccttaaagtgcattgcttaatgaaatatctcaagagaacatatccgtaggctagcttatttcagaacttaaaaaattaagcagtattccgttatcactcttcaaggaaaaaattgaatgtaggatcgaatagctagaactaagccaactagaggagattgaatagttgtagtatccaaaaaccgaaattcgatgacgatcgtccgatcggattagatgcaccggtctgatcgctggatgatctcaggtctgaccagtatagtagctccggtttaaccgcccaatgccccaaagtcgtctatcaccgccgtatccccgccggtctaaccatgacgatgccgtcggaaggccctttaccatcctacagtaaacgggagcataaaggcaagcaataaacaggaattgtacggatgcaacgattatggaaccaaaattacgaagatatatataatagtaccaaaacccaactaaacaatacaaatctggagtactaccaaaacctgcatctacacatatatgcgctctctctgattagttaagtcgaagctaggaatgactagttattaactgttttctgttttaatcatgctaaagtagctaattaatcattaagcggttcaaaaaatccaacaatattaattaatatatgttgctgttttcccaagtctgtgtgcgctggaattaagcttgcttgcttcatttcctggccggcaagtacaaacgaggctagtactgctcatgtgttgctgttgcttcccgtgtacccatttgacttgctaatcccactcatcagtcattgcggatacttgggatagcttcgatttgatgtatgctttaaggaaattaaacaaaaaacaatcaatggaaaggaaaaggaccccttgatggaacaaaggttgactaagtctcaacatggaaactacgttatttctacgcaccatgttttggtacgaccttagtaaaagacgaactgcattcacgtgactataagccaactttaaataggcttcgacactcttttctgtgtctgttctgtacaattctttttttcgttgagggcatgtttggaagactcgttttaggtccaaaacaataacaaaatatcaggtccaatattagtgtaaaatatcacccccataatttcttttacaaaatttgctataggatataaaaaagacgtgtaattcgctggagaacaccataagacactgtaaaaaaattggtaattagctgctagaaattcacggtattattttattatttccggaggaatatgagagagaaacagatgcgagagtacgattatgctcctgcctttgtttggcctacaactaattgggtctggttcgaaccaagacccggtcctctctcacgcctccgaatctccaactcctttcctcaaaccctagaaattaagccagcgaagtagtagtggcgacatggtccacgaccgacggcaagcttcaacaagggtggtgacggattgaagttgtgcagtgattgcatctttggagctgtgagcccggtgtggcatcgctgatggctagaatgttggccactggggtgatgtctgtgggcacccgaaaattataccgtccaatgcaatttgtgattaccacataattttggatgagtgagatccatacatacataaatagccagccatacctcaatgtgcccataatcacaaactgacaccattcgatataaaatccacaaagccgaataataagcaaatgagatattgtttagacttagcatgccagtcaactttagcctgacatgcctatcaaaccataggaaggtggcgaccaaatgtgttacacatctcaggaaactttggctcaaattgctaaaactctacaacatctcaatttctcaaaagtcatactcatgctcagctagtccctaggaaaagtgactagcctcgcactttcatcgcaagcaattgatgaacatcacgaatgcatagatttggataaaaggacaacaaggtacatattttataatggggttcacaaccccattatacaacacaaaatatagtagcggaagttttgcaaattcacaagcaaaagtaaaatccgtggtgtaccaacaaccccacaaggacaaaacaaagctgcaactacacactactgtcattaccctcggcgggatagtagtagtgcacgtcatcaacaccggcatcatcacctgaaaatagcaacatgagtacgaaaggtactccgcaagacatacaccatatatggtagttgtcgatggagcgatcctccaatagcagggaagtgcatactcctcccctattgaagatttggccagggagtttactacagatgatgtgtatgtgggctgtgaagtgttttctagtctcggacgaaggacactcaacgattatacaggttcaggccaccccgggggtgtaacaccttagtcctgtgttttttttcattcgggattgaattggaatacaagcatcttcgtatctctcttttctctcctttctaagtggcatgtcctcttccttttatcaaccaaggagagtgacacagtgtctttctcatcctttacctcatgcttgcatggttgcctcctttttcaacaagtcaaggaccgaataacaactgtcttgtgctcccttctccacccgtcatatagccaactcggtgtgctcacgctaacctggattggtgacacgccccctccattaggtgaagcggcgtatccgagtgtcgttgcgcatgcacaccatgtggcgaggcctgtggccaggggatgaatcatcactgtaggcctcctcgaaccttaccacctagacacgccttcataaatccagcccaaattaaaaatcacttcctaaatggaataatagaaattattaaaagcttaaaacaaatctcatcaaatgctaaaatacatcaaataaaaattcaattttggcttggagtattttttttgaattctccatactttaatttggtccctcaatttttacttgaattttcatagaaacctaaataattttaaatcaacaacaaccaatttaagagtttcttaaaatgagaaaactaaagataatcctctccctctcgttgggccaaatccggcccaaagcgctctccacctctttaggcccgctgccggagtccctttctcctccctcccactctcctcatccctctctagcctctctctctccctcttgggctgcagccatctcggcccaattcatcatcctatccctcggactgaagtccgtttacctcctcccgctggccacctcctttctcttgggccgtatagccccgaggcccatctcagatccccgcgggtcgtgtcccttagccaagccgtcgcccgttcttctgccggtcaaaccctaccgccaccgacacgccgatctacctacccggacgtttaccatccgaataaaatgccaaaattggttcctctcctcctcttcatgaattcccccatgtttttccctcttgattcagcctttaatcgtcaaatttaatctccggtgaaccaccgccattgatggccgacgccccaccggcgtcgttctcctatcccggcaccgttccactccccaatctgctataaaaggaaccctggaccctcctcatcctccgtgcttcctcgggacaaggtctctcgcccccacgctgcccctccccccccccatgcctcctcctctctcctctgggccggcgaactccggccaaccctccccgtcgacgggagcagcaccgaaccacacgccaccaccttcctcggcatcgaagagacctccttatccccggcctcatctgcgtttcacccaaagggcgccggaagtgcatcctcattggcaaccaatggcgccgccgccgtcgtcctcctccagccggccctgaccgtcaaatcaagtgtctctggagctcgccgctacctccaccggcttcgcagccgcctcctcttccccagcctcaccttcgtttctcctggagaccgctggaaactcgtcctcgccggtgaacagtgaatacgtcatcgtcttcttcctccagtggcccctccctcctcagtggagcaccgcctcactgcgccgtcacggctatcggctgcacctcatcatcctcaactacgcctagggttggcaacgagacggatggcgggggagggggcggcgttggacaagaacggtcccgcccccactctcttgcgtgttcacccggccccggcccggattggagaatgggacgaaattagtcaccatccccggcccctccggggccccgccatccgaccaggttcccgcacacccggtgctagcgacagtcgaaaggagagtagaacaaagtgggaacctgtagccagaaggagagcaagtgaaagacgcgaggagccaacggccggcaggatgggggaaacagcatggagcatcgcatcagagaacctatagctgagagtggtggcaaggggcagagtagtcggtgctagctgcgggcggccgcctcctgggtgagcgtcgcaacatgcgtccgtagcagcaacgccaaatgatttttcttctctctgcttttttctttacgcgagcctcacacgattgcgttgtgcccccgccgccagaaatgtttcgtcgtattgtggggatggcaccgcaccatatgggttagggtttgcttcttttgtatttatatctcctctaaactgggctacacaagctcattggtggtcttccaatagcaaactatatctgggctatccttgatgggctattaatatgtaatagcatatattttgtacaatacttcggggcccctacgggtgacccgtgggtgatgcagccaacccggctcagccccggaaaaagtcgggggcccgccctctctcacccgtcggtgagaattctctaccatccccggccccgtaggagcgggtccccgcaggggagccagccccgtgggggaaattaccacccctagctgcgcctcctcgttatccgaagattctcggaacacctccccatcgtagttgactacttccaatcgtcattctcgccaagacgaagtgtcgcccatcgtttcgtctccgttaccctcctccattcgtcgccgctgcaccaaggtcgtcgtcgcgtcatgcccatggtgagaacccctccttcactgtcctatcctcattttatcggcgtcgctgccgtgccgcggtgcgccgatgacctctggtcccgtccgccgatgcaagttgttgttttcctcccgcgtacagccacatatttgcgcgtgtggttgcttacgtggcttcacacacaaattaatggtataataataattaaacaacttggaaatatccatttaatacacttaaaattcggatgatcgtttctcggccaaacgagctcctaattgatatgttgaaattgtttaatttttgttataacttaaagaaactgtggttgttgtttttatgtattgttaccgtatctttgatagagttgtatcccagttttgttgctcgtgcagttgtttcggaagttcctgaagtgcatatcaaattgtcggaagacctttgtttgagcaaggcaagtcataccatattgcttggacattaaatcccattattgcaaaaactatgttgattcaattctatatgcatcacttttataaattatatgactcttaatgttctttatttaatagttaatattcatatgatcattgttatatagccatgttgttgaatttctaaccatgctcttgtcaacctaagtaaaatgataaaataacaagtatggctccgtatatgatggacttactagttgctttaggttgagcttatctatacttagatccatcgaagaatcccttttacaaattagaatgagagtaacaactaaaatatgtaggaatgacgattaggtggctgcttgagctaggacatgatggaatctgagtcaaaactctctaaacctgtttttgtgaggcacgaggtgtatggttttgttataagcacctcgggcctgtgatgcgaagcataacagtgcaatcacaagtctaatgggtaaggcttgcctagaagtctagatcatctcaaaacaaaggacatcgatatgataggtctggggctaggggatgctgactttgacctggcgcacaagggggcatgtctcgtcccgggggattcggcaacctttacgttgtcgaggaccagcggacggcgagacctttgcgggtccttctgttttgggttgagctaggtgggtagtcttgtcacgatcttgacttttcgggtatctttcgggtattgcgatgcatagctaacatgaagttaagtgttgtgccttgtgggtaaagatgtacacctctgatcagagtaaaactattcgaatagcaacgccctcggttatgggcaagcctagcaatgtacccaagttagtttttatcttcgaagtaatggatggaattcatgtcactttggacaggtggttaacctgggtttatggccggtatgcataggttcacaaccatgataatattgcttagaaatagaaccgagtttaaactatgctttaaaaacattaaaatattgcaactttgcctttacacaaaaagaacctattatgccacctctttgttcacctttcattataattcattttccggcatggcttgctgagtacgatggttgtactcattcttgctcaatctttccctctccgatcagagaagcttttcgaagaacaggtgttaggtgtagtcctggctttacttctagttgagtgccttaaagatggactagtaggctcactagtccgctgatgtttttcatttgttgtcaagcctaatatgtctttgtaataacgtaaatattatcttgataattaataaagatgtgtcttttgtaccaagtttattctggtgtaccctggcttttcctaggacgaggaattataccctagcgttcgggaaagttattttccaggcgtgataagctggtataagagccatcacaactgtgggataagtcaaacagacaaaccgtaaggacttattttgtaagaaaagactatttgcaaaaatccctttttgtttcttcccctatgctttttgcaaagtgtttatctctcccacccttgctacacataatagctgaacaaggtggtagaaaaacttagtaacatttacaataccaaattagtttcattaaatttaacactagatatattttgtattgaaaatgttagtaaattttactacaaacttggtcaaacttaaaaaaatttaactaaagaaaagtcaaactacttataatatgagtaccattttgacatttcatcttccttaaggtacgttaggcgatgaacagtcataattaattctgaacacagagaagctttcgaaggaagaagatggaactgaatggtgacccacatgcagattgggaatttcggtccatacaaaaaatacaacaaaaaaatattcaaaatatgtatgatgggtacaaaatggcatttctagttttagaaatattgcaaaagcatgtgtacaaataggtaaatatgtgaatagtaatgtattttttttcaacataacaaatgcgcaatggcatgatcaaatttacccaagaacaaagaggtaaaagaaatatatattttatcgactggttcgtagttatccttcatatttattgggtgtgaagaaattactccttacacaagttgaattcatgaaaaaatccataaataataaaaaaactctccttttaaactaccaaaaacaggattattcggataagaaaaatggaacattcgttttctcgagatgtgtcattttcttagtcaacacgtccaaacacctgatttgctgaaaatatatggattgtcatgcattgctagtagtgctttgagttatgcttatattatgacataaattttgaacgctagatatgtttctattttggaccggagagggtataaaattctttttagtgacttgttaaatagaatactagcgtctactggctgggttcctatacctgctatcagcccgtgtttttaacccaacaaaatttaacaagtcataggaaatatagttgatttagaacgctagtacaaaaccgacccatccgaaggtaacatggactaaaaaccactatctctatgactggatcaccgttaaaatcggcctgacaaaatccctatcttatcttaaaaaaattaccgcaagttttcaagtgaaaaactttcagacataactataatataattggaatataattacattataactacactgtaactgcattgtaattacattgtaactataatataatttatataaaacttgtatttgacttatgatttgtttgactaacactgggatcttacgcgtgatatgtgtaaaaatttctttttcgtaattttttccctctcatgtataaatcttgagatgattcgatggtaacaattctgaaagttttgaagagagaacttgaagtagttttctaaaaatttcgttggagaaaagctcaagcgcactgcactagtccatttaattgaaccaagtgattttgcgcttgctggtttgatacgttgctagcaccgagatctgatctttgcttttcctttttttttttttggaagaggtagatctgatggtggcaattttactctagtttattaaaatcaaatatccatgaaatagtcgcaatgattgaattgtaaacaatattactacctacgttttataataattaatggttaaagtttaaatggtaaattcaaaattgcccactattaagaagcggagagagcatatgaagttcaatagttggagactcgaaaaatggcaattcatcactaaacagcgatggcagtttgtaggcaccggttggcagtggccaagagctcttgatggtgaacgcagaagcggagaaatttcagcgaaactgcatcgctatcactatcacaagttacattcagcttgggcatcgcgtcatcgtctggacctcggcgaaagatggaacgagtcacggatccttcgatacagaagttgatgccaagtcagagtaaattgttgtacgtgcctttcacgatttcatacctcagctagcttgtcctaagtcgaaagagtaaacggtgaacctaccaagagaatctcacctacaaattacaattacaacttgcgcaaattaaaattgccgcagcttgcgacctgaccagaggcagcccttaaaaaatttgttgtttgaccactcaaatgtacaaagaatggacttgaaatctagaatgccgagtgcagataatctactagtattaatttcagcaaaggcgattttttttcttactgaaggcttaaatggaaaccgctccaaattgagttggaacagtatttaagaacagcaaacatccttgcagtttcaaactttggagtacagttaaagaacagcaccagcaaaaacagcactaaatcaacattttatttcgtctctcagacagtaccatgctgatgatgcgcacgaccaacacacaacacatgcttacatattcacaaaatgtatgtaggtaatgcacttgaaggtttgagatgctacaaacaaatgaaatcatttagtccattgaagagtggcttgtcaacatacttacaccaaactgactggatacagctgaacaactagatcagttattctgggtttctaagcgaacttcttgtcgaggtgacggtctatgatttcagatacggtttctaagaagattacttcacttgaccctgggagaacatggccctcggcttcctggacgatgtcctcaatctcagagtctctattcacagtttccctgcacagtatacgcccgatgtcatacggtgtgaggcctcgtgctgcacctttctttaaaagcatggtgctgatgcacaggacacgagcacatcttgcagacagctcccacccatggaacttgagaagcttgatgtcctcttcagcgtctagtgatttgatgtatgcaatggtttcatcactgaatggttcacgagcctggggccagtacagccactcaaaggtacaatcttcaaactgcgtcacaatggaaaaaaaattatcgttagtctaccagaataagtactatctcatgcaagaagaaaagtgagtgctagagagtaacgtgtaccttctctggcaagcagtaaccatgatcaattggaaccaacttgtaattgccaccttcttcatccttgcacactaaaatgttccctgcatgacgatcagcgtttgctaacctaagatctaacactgctattttgtggacctccttcactggaaatgctcggggacccatatcctcacaacttccattgttctgaatgaacatctgcagtgatccaatcttgaagctcttccccctgtgtaagctccggaccaatgctgtgggaggcacaccagagaacccgatacgttcttcagattcatgatcaccaattggatggtcaagaatataagcagcaacttccctaaatgcaccttcccctacaagtgtccccctcttcatgccttctccatcagtcgacactggaagccctcttgggttgtttttagccataggttcctcatctctgggcttaaacactgcaatattcttctctcctgatgcatcttgcatgaagtaaacaccccctgaaccttcagctgacatcactggcaagtatccattctcaagaccagctatggctgagctaatcattctcatcacttcaagtgatagcttcaccttgtggttaacgataattggttcaacaagagcaggcctagcaccagctggtttagcagggttcacagcatgagcttcattttgaaggttctctttctcctgcggagtgacaactgtaaccaccgtgtctttatcaacttgctgtgtccgtaactttgctggcttgcggatgaacaaatggatcacagcatcatccttcttgctaatatcagcaatcagctggtggtcctcaagctccttgccatcacattcaagcttgtgatcctcaccaaggtcctcatctccctccactgccagcttactcttgagatacttgacattgcggctctggtccacctggaactgaaacttctttccactggtagtctcgatgttaatcaagcgaagatcagccaagcggataacaaggtgcagaacatttccatcggcaagcccataatccttcacatggcagttgttccttgccagctcgtgcccatcaagcacaagcctctgcttgttaaccacgaaccccttgaaccgctgaatgcgcagcttgaccgaggcgatggactccgagccgagcacactcatcggcatcggtggggcaccaggcacagcaagaaagatgataatcgaatcctgcagctgtgacccggacaaacagtggggcgaccggctgccgtcgaagcagatgggcaggagagcaaactcttccaccatcgggctaatggcaatggcagcagacgacatcttcacaggaggtccttaggatgccgaagcttcctcaactactgctactatttacactaacctaaaaatcagatccttcacactacgaattagaagccatggagaagaaagggcaagggttcctttccttccttagaggatggaggaaaccctctgcgatcgcgagataaccagcgtggttacaatcccatcttgatctccaggcacatcaaacctgcacaaaattcagagagccattcgttattaaccaccgaaacattcaaccgaaggggagaaattccagagcatgaagagaaacgtaccagacatggttagatgagggggagaagtgacgaaatatctcgcctttgcccaccagtgattgaatcccccacacggaatctacaaaggagaaatcattccggatcgatcagcctcagaccatcaaatccacccgatccccagggtaaattcagctcaaattaacacaaaaaaccagagaaattgctcaccagaagagggattaatcaggaagggcccgaaccccctccgatccggacgccaaccgagccacaacctcaccgattcacctcactccaatcaaaccctgcaagcacaccaccacaccaccacacagatcagaaaaactccccaccaatccaaatcccaagccaaccgccccaaaaaaaaaaagaaaaataatctcacaagaattcacaggacaaatcagcgggggattcaccgcaagaaccgaccagaggagaggaggggggataccccggagaggggggcggggctaaatccggcgcggcgccttgttcttccttgctccgaagttcacgcgagatggggaagcttcggtttggttttggtttggggagaaagaaattcagagagagagggaggggaaatggtgatggttgtgggggcagctgatttattcggcggaggcgggcggccgtcaccgtcagtttccagggctgacggcgtgagcgtgacgtgacgtgctgtggggagagagagagagagaggacgcgccttcgcggaagtggggccgatggaatcggaaggggaaaaaaaatctccattgtcggggctcgagggtatacagcggttttaggatttttttttttttgtcggtatgcttagcacacggagcaagaggaaagaaggatggttctagagacaccatagataagaaatccaggttgggatattttgatctttaataatgatgagtacgagattattattacacgtcgaacattgtattaatccatatacacttagaaaaaacaaacctaaacaaataagatgagtgaaaacaaacttgcacacaccagatgccaaaagtcccccagaaaaaggaaaaatgtatgctgatgattatcgaaaaaaaatacttgatttagtcatatagtttggcctacagttaattagaaacgaataaaatattatatatgtattcttagtgtcttaaaattacatatacaaatgaactataacaaaaatatcaaaatattttgttttcttatcaagggcaagatgcccccatttctttttattagaaatgagatgactaaaaaaatataaaaatatgtataagtgaattttaaattttagctgtcgctgaaaatctaagactgtgtttagttcacgtgccaaaattttttcagtatacggatacatatttaaagtattaagcgtagactaataaaggcatccacaatgtggaaatatagagggtcttaagcccttgagtagtccatatacattgtgagagtgagcattataaaggtttcttggatgagctaccattagctataatatgcatggccataaggaataaaaaaacattcttctctctataggtgggggagagaaattggaaaggtgtagtagttggttatagatgataaaaggtgggacccaccttaatacctcctcttgctatatacactgtgtgagagatgctatatagcaatagagcccacattggacctatcttaaagacccacttgagcattatacattactgatgtcttaacaaaacaaactacagattccgcctgtaaactgcgacacaaatttattaagcctaattaatttgttattagcaaatgtttactgtagcatcatattgtcaaattatggtataattaggcttaaaaaattcgtctcgcaatttacatgcaaactgtgtaattggttttttttcatatttaatgctttatgtatgtgtttaaatattttatttaatatgatggaacttttagaagtttgaagggtacggtaaacactgcctaaaatacaaaggaaatgtataaagccggcctgggccctcctccacccaacgtgcctgcctgccatcaatctcctccatcgacaaaacaaaacaaaagaaaagaaacacgatcacctcactgccttgtgggggcacacacactatgttcagaacggtcggcgagaggagcgggcggaagaagagtcagagcaaggatggtcggtcaggtcagtttctctgactcagccagccccatccgtgccgtggccgtggccgtggccgtggggaagacgaaagaaaaaaaaaaagagtaaagtccatcaccgatccctaaacttttaccgctgtatcatcccggtccctaaactcgtaaatcgaccgttcaggttctcaaacttatttgattgtgtcatcccggtccttaaacttgcagataactcgtttaggttctccaacttgttcagttgtgtcgccccggtccctaaacttggatttgaatatcatttgggccaaataggacagtctaaagactttatatttaaaaataatttataactttttcatgtgaactctaatgaagacaaactttatatcaaacttgtagccctcgacgcgatctacaactatgtagttgattttttttattttaattcattttttgtcccaaaatgtaattttaaaattaaaatttcaaaatctataaacatgcaaccatattttgggaccctaaacagttttaattcaaaaacttttcaactacaaagttgtaggtcgcgtcgagtgctacaattttgatataaagtttgtcttcattagattttgcatgaaaaagttataaattattttttgatataaagttttttgaccgtcctgtttagggaccggggtgacacaactgaacaagttggaggatctaaacgagtgatttacaagtttagagaccggaatgacacagtgaaacaagtttgagaacctgaacggtcgacttacgagtttagggaccgggatgacacaaaggtacaagtttagggaccagtgatgactttactcaaaaaaaaaaaaaagcaagccacaggaggggagctggaaaaggccgggggagcggactaggggctgtttggttgaagccctgagccaaaagagcctggcgtgatgtgtccctgagggatatcctgtgttgtttggttggtggcctggtttcattccctgcctgatctgaaaaacctgataggttcattagcctggctcaggccaccaaaaacgagcgcctggctcaggctagttacacaaaacgcgctaatcaaccttgtcctgtcacgggcccacggctgtgcatgcaaaaagtgttggaatattttattgttgaatcttggttggtgtaaacgaactgaaaatacaacatttgcttatatgcgatagattaggatatgagatagtaccgttttatttactttctccgtttcacaatataagtcattctagcatttttcatattcatattgatattaatgaatctagataaatatatatgtctagattcattaacaacaatatggatgtggaaaatgctagaatgacttatattgtgaaatagagggagtaaataatatctaccttaaccatgtaattatgagccatctaatctcaatttagtttcctcaggctcaggctaccaaccaaacaatatttgctcaggctagcatcatcaggcaagttttgataggatagccaatgcctctcaggcatgcagttttctcaggcacatcacctccaaccaaacaggttaaagggattaggccggggtgcgtaggccgtgacgcgtcgtcttaacaggagacggtgtgcgccgtccgtgtccgtcgccaaggacgcgtgtgcctacgtgtgggtgtggctgcttgtgcttgcgggtgcgactgcgactgcgactgcggccggtgcaaggaaggaatgggaaaccacgggcgtcgacccagctgtttgcgttttttgtcgttgtgtgtcgccttctctacgtgggcacgtctgccccttttcttttttttgccccacaacttccacttgccttttccccgcgatgcatggagtggacattttctcctcgtcccggttcaccctctccgcccgtccctctcgtaccccttccaatcctgcgttataatcatttactaatgatctgtctattttgcttcaagaaatttagctcagctaaacgtccatcccagacgcatcctcatattagctactcccttatatattgcaggcaagtttcttaaaatgctaaacaaactatttttttcaaatacttttatataaaatttattttaaaaattaaataaaccaaaattccaagttgtaatacttgatacttataattaataatatactaatgtctcgtttcgcaacaagttcaaaatcaaagccgataaactcattcaaactatacattagaaaattgcgggccagttgaattagatttgattataactctcatatttttatacatacaattatatttatatacaacagatactaaatttatgatgggatttaatatacaactattttattttcttctgtttttattgtactttatttacaactattgttatcaactatacttgttataatttggtcctacaaaaagtcttggaaaaatatcaatctttatatgtagcatccttagacaatatcgaaatttgtatattatgtatatctcaaaagaaatttccatgtttttaaagaacttttttatgtagctgaaagacaaattacttaattaaaagatagacgcgacaaaaaaaattcttttatcacatgaaagatgattttcataaaagaaaatcaatcacagaaatattctattatcaaataaaacaaattatattttaaaaaaattaatacatgaaaaaatcttgaatctacacaaaaagttctgcattatataaggatgctgcgcacatttttttaaaaaaatttaacttaagcgaatcaatcaattatcaatcagtatatgtcttgaaagacagttttagaaaaatatctgctccaacggcatattttgaaaataattgataaagtcattttttcactgctagtagcacattggttacacttttttagttgtaacatagaaatataagttttgaatcatagatattctatactcagttgtcttaaaatataacaacttactatgataaatctaaacaagcttcttatctatattctatattagattgctaactatgtagatagtatttcccatgccattacaaatttacctatttagaaaaatatcattacaattcgtctatacgtagccgtgacactgaaattttacaaaattgaatctatgccatcgctgtcacgttcttcgtcactgtcgtttctttcttccttcctctctcctcttttcttctcttggctgccgtgggcgtcaagatccagcgtcggtcgtcggcaccggcagagaagttgatgctgccgccaggcacgattccttcccgcggctccaccctctgtgtcacctcctcccttccttcccttttcttctcccagctactgcgggcgtcaagatccaacgccaatcatcggtgcctctgtgtcacctcgtccctcccttcccttttcttctcccgactgtcgcgggcgtcaagataccgcgtcgatcgtcggcgctattggagaagctgatgccgccatcgagcacaactccctccagcagctccaccctccgtgtcacctcagcctgcggcagcggggaagcccatcaccatggccacaccatccttcctcaccatggggttgaagtcagagccgcagctggtggtggtggtggcggaggagcgtgagtgtgcggcttggactcgagcaatgcggatgccacgacgaggtagggttggtacggctgctgccggcgacggcggccggggtgtcatcgtccttgctattggctaccaccgctaccgctgccgctgccattgggaaacgagagacaagggtttagggttagtttggttcgtgtcggccgcatgctcgcccacaccgccgttgtgccctctttctctgctcctccacagtgctgcccttgtcgcgatggctgcgcgcccattggactcgaccccgccggctgaggtagatttcttgggcgtggagctatggaccgtcgtgccgtgttccttgtggagaactcgctttgcggcagcacccaccacgttctcctgtaggagaagccacactggcgccgcagcggcgatggagacatgatgatggtcgtcggtgtcagtgagcaaagatgtgacgagagggaagaagacgggagaaagaaggaagaagacggaaaggaatgagatggatggaaaacgtaatggcagtggtatcgttctaattttgtaaaaattaagtgacacggttacgaatatacgaattgtaatagtatttttatgagtagtgaataggtaaaattacggtggcatggatccaattaaccctattttgaatgggatgtccaagagttttttaatgggacccacgcgtgcgaagaatccggccccacctgcacgaagtataaaaagatgatccccacatacacaccgggggtagctccaacgacttctcatccgaacgttaagcgcgcgcttcctctgcttccgatgtggcaagctcccattggctgatacacgcgtcccgcgctccctcattcgagctcccttaattttctcccctcgagggtctcactcgtttaaaccgtccgaacggtcgactcaggcgtacgcgcaatcgcctttgcctttttctctccactctcttctctttttttttctaaaaaaaatcatttttcttctttaattcaccgactactccgaattctctaacggggagtaggcccagccgtgggccgtggtgctgtggctgtcgcatatttcggctggatttttttttttatatttggagtgatgttgcagtggagtgcagctttcggctggaaattttgtttatttggagacgatgaactcccgttgagattattggagttggccactggcttaccattttgtttagttttctccgcgaaatctgctgcttttcttctctagtagttgattaaattaaatcttgtttggttattgaaggatgatgtggttgcatagtcctgttccttaggagtagcaaatccatgtgcgttccagttggcggaattgatgtttgtccgaatgtccgatagcatcaatgatgattcgggaaaaaggctttgggcgcttgtgttagaagtataatatgttagttaaaaataagagtcaaatactgttagaagtataatatgttacttagatataagagtcaaatacaaatatagagataagatatatcctagagataaaatcctagaaataagatagagttctagagatagaatcctagagataaatctactcttacttgtattgtactctaaatctctatcccctatatacttctatatataccctataagagggttgatgtaatacacgagaaaacatcagaatacaatatattagaatttttcacatggtatcagagccatagcccggggagatgagatgaatccgtaagctctccccggggcacagcattagttagctagcctctcctatcatctagattagattatccacatatcattagatattttttccaatattgatattagatcaattcatattagccacatcgaaccctacgatttccaggagccaacacgacgacgatttcgtcgtctctcactagcatcatcaatcagaaggcgaggccgtggcgtacggcaccaccgtccaagtcgccgtattgaagcccgatcgagcgacggcaacaccaggacgcatctactcagaaaggagcagcgcgcatgcacatgcacgtacagatcggttaaaccaatcaaggtgctggccaagcgccatcacgtaccgatggtcttcaccgagctctcctgctgacgtcaacaagcatcatgccatccggcctcatccatggatcgatctgcatcggctacttcacaagaagcaggggccagatgctgttcgtcgccaacaacatgtgcacacgcctgtgctgcacacctgcgtcacaccggctgatcacctgcgacacacctgcatcaagacaccggccgatcatctgcgacgtcttcgcggagtccaagtcaagccgccgagctctccaggacgatcgtcttcgccgattctacatcatcagtggtcttcatcaactttgcgctgccgactcgtccatagatggacactcgcgtcctctgacagattaatctgcaagaaacttcatcgacgacatttaccgcgtcctctacgacggcaacgaccgcatcaccgacgacggcatcgatcacgtcatctacgacgacaacgactgcatcaactcggcatcacttttgtgatgactgctacacggcgcagaaggaccaaccaaggtggtggcctcatcgccaacgacgtcctctaacatatgcaagacgtccccaatggcatcctctgacatatacaaggtgcaagatgctaacaattgcagtttttgtcttcacaccatggcgtaaatatttttttttcgtcttcggctatttgcggctacatcaactaccatgattaccatgaccatggctactacatgattggctacatcgacgaacgtctacaacaagaatcatttacgacaactccagtcaaagcgtccgtgtcatcgctatcgtccatgacactcccgctatgactgcgggagggaatagagaagagtcaagggacgacatagaaggggacgcaggcactaggtggaggaccgttcaccagagatgcaatcgatgatggtgacttgaagaagatgaagaaatagaagatttcaaatccagtcgcaatcgttcgcttcgctcccgttacgactgagggggaatgttagaagtataatatgttagttagagataagagtcaaatacaaatatagagataagatatatcctagagatagaatcctagagataagatagagttctagagatagaatcctagagataaatctactcttacttgtattgtactcaaagtctctatcccctatgtactcctatatataccctataagagggtcgatgtaatacatgagaaaacatcagaatacaacatattagaatttttcacagcttggaaatggttggttcggcaactaattgagatgatatttttgttaggatactccaacgcatgcctgcctggttaagatttgaattacaattcaaaattggttctaaattctaaaatttgatttatgattaaatttttagagattcttcgtcagtttgaatgcccaacccttttgtaagtattactaagaagaagtgttaaacttgtgcaaaccacgtatattgaaaacctgaaaactatcgtttgaattcaaaatggatgcatgagatttgtccatatcacaatgagtaaaagttttagtagtaaacattttactcgtgatgacatagataaatctcatatattcatttgtgaacaaatggtagtttttgtgtttccgtcacatttgtggttttcattggcatgtatcacaactacccaaagttattattttttagataatagaaatggattacatctccgacttctgtcataagacacacagccataagtttaatagtaataaaaaggtaagataaaagtaaatcaaaatgagaaataaggtgatgggacaaatccccaactcccctttattattgactagcgttaaaccacataaaatattttagctagcaattcttatggaactacgccacctatagtggaataagagacccttggctaccgattccaagagtgtagcactattgcgcatagtatcctactcctcctgtggtagcattgtagaccaaaagtggagctagtaggaagacatgaagataacctgcatagggttagataattgtttaccattaaaaactttatcactgtgacaacgccaaattgaccaacatacagcactagctccaattagaatcatcttcttaatggacctagatatacccctctaagtcaattactgaaaatatttttggcgttacagggtgggggatactaaaagcaaaaaacacatatctccaaacaaactgagcgacatgacactgaaagaaaagatgttggattgtctcttgtgcatagcagaaagaacaatgtttgccccccccaaatttcttttagccaggttatctttcgttagaattactttcttgtgaagaaaccacataaagaccttgatctttagtgtaattttcaagtcccacagaattctctttttatcggaacattacaattcatgatcgcggcatacatagatttgacggaaaattgaccattcttatggagcgaccatacaaagcagtccttttcatttgacagagttatattagctagcctgaggatcaaatcgttccacttgattagcttttggccaacaatagctcttctaaaagagatatttagcggcgttgtgctcataacctctgccacagtagactgcttctttcgaacccaaagttattactagaaatcaaaattagcctttgatcactatgggaacctctgtcatcacgcagctacatccttagcgtatctaattttcctttattgcacaatcaataagtaaatctcttttacttagtggaaactgagttaatggtggccactatgagtctatgctttaattaaaggattaaagggcataacatcaaattttaagttcaagcacatatatttctcttttttttacaaacacatatatttcttatattaaaatacaatcatataatatattattataataaaaaatatttaattacaacgaatattacaatatagttggattgttgggtggtaaatagtttaagagaaaaagatcgattaaatcttgctaatgaagctctcatttgtatgcatggatggacacgtataaaagtggagaagggaaagaaaaatggagagagcgggtgctgtgcagaaaggcacgcaccagtcgtatacggtagggacacctatggcctgtattttatttatatcttcaaataattcagatactcatattttaagaatatatagttataaaagttggagaaagaactataaatgagaagttgaaaattttaatatttttagattctcactagcaatccaaatctcaagttcatccaaaccaaacaacttttgaatgtcattctaattatttgatattaggtcattttataatatccgcgtcttttttttaactctattcttttgaatgtcaagttcacctgcatagggcgtccaatccaaagcacttcatgaatgtcattatctcacccagttttggttaacacaagaggtcccctcgagataatgtaaaaagactaaaaacccagcctctcttgtacatcctcgcatcccggcccatatttgcccatgaatggaccaggatttgtgctttggtaaataaagcataaatgaaaagtctatattgcctccctcaatcttgttcctagttgacttgcatccctcgaccgcaaaatcgggtacaatgcatccctatttttaaatcggtgcaaatcgtctccttcgatagtttcgtcagacatgacaattttgacccctttgactggctaagtcagattgtggtgtgggcaccatctgtagggatctcctccatcctatcttctttctcccctcccccatctcactctctttcctctcttcctcctctctcacattacagcagcacgcggaaggagtcgtgtttggccaccacgggggtaggggtccccggccccggccgcacgcgaggggaggggtcgtcggccggccgcagcgtgcgctaggggaggggtcgccgcccgccgggacgagcttatccgtagcgacgtgcgtgggggcggggagggggggggggggggcggtcatcggcgccgcgggaggcgatgcagccacactgagagccatcgcagccgtgaagatggctgggaatgtgtggagcaaagtgccgctgcattggtctggggctacgagacgggatgaaggaatggatattgcgaccaatggaggtgaaagcattctacagtccaccgtgagcgtgagttgaaattatctcgccgcaggtacgagagcgtcgggtagtattccaccgccggcaacggccgcttcgctaggggaacatagccggaggttttagcacaaccgccggacaagtggcgacattcgtgttcttcctcgcccatatgctgcactgattaaagaagaacaccgacgagctgttcttcatttcttcatcccgtcgatgtccgggatgcggaacagctcgccgctgatagtgttgcagatgaagcgcttgatttcaggtttcaattccttgtcgtcgattggtacgggaggggaggggggcgtgtgctggtggcgtgggcagtggtgaggccgtttgtgaagcggaggaagaggagaggaggatcatcacccaccgagggcgcgcgacgtaggcggcggtcgtggagagggggcgcgccataggcacgacagagtcggtgttgcatttcggcgagagagaagggagaggaagataggagatattgggctgacaaatggggcccacctttttttatttttatccttttcactcacatatgggacccgctttattttcaattcctttcatgactgtgctgccacgtcagcacatttggactaagtcaccctacctcttcagaagaaaccgttttataaaccacttaaggagtcaatttacacccgtttttgaatttggaggggtgttaatgaatagtaaatttgacatgacaacatgcatagtgaattttctataaataaaatttgcttcgacataagtaatgagctttactatacattttacgaaatcaacataatcatggttaataatgtaacgttatggtaaaatcaataaatgcacatttatatatttaacgaagatggacgtgttggtctcgggaaagcatggtatactattagttgtcatgaaaatattgttaaggacctgtttagttaccaaataaattttttatgctgtcacataaaatgtttagacacatgtatgtagtattaaatatagaaaaaaaaaaactaattgcacagttcaccaggaaattacgagacgaatcttttaagcctaattacgccatgatttacaatgtagtgctacagtaaacatttgctaatgacagattaattaggctttataaattcgtctcacagttttctggcgaaatctatattttattttgttattagactacgtttaatattttaaatgtgtatccgaatatccgatgtgacgtgtaggggtaattttttttgccaactaaacagtccctaaatacaaatcaacataaatttgttaatgttattactggatttctttt

SEQ ID NO: 70924 - DNA, 1565 bp, Oryza sativa
aactccagcatggaggacgcggccgcaggcgagctccggcgtggggcatggtcgcatggacggcggaggatctgcgtggtgacagagacggcgccggcgacgagctcaggcgtggggcgtgaacggcggaggatcctgcgtggtgatggcggcggcgccggcaattgagctccagcgtggaggacgtagccgccggctgaggcgtggacgacggacgtggctgccggtgacgagctcccgacggaggacgcggtcgttggcaacgagctccgatgtggaccgtggacgggggaggatgcggctgccggcgacgaggttcgggttcagtgtggagcgtgaacgggggagaacatggccgcaggcgacgatgcctcgacacctcgacgcccagctcctggtatctagtaggtatcatattgatacctcacaaatatcaccctgatacgtcgtagaaatcgcacgatacctgatagatatcatatgatacctcacgagtatcgcctgatacgtgataggaatcgtctgatacctaatacgtggtagaatcgtatgatacctgataggtatcacccgataccagctacttatcaggtgatacctgtaaggtatcatacgattcttaccacgtagaagatgatagttgcgtagttgcgaggtatcaaatgatactcgagtaggatcatgttaaacctgggaggtatcatgatcctccttagtatcatgtccggtttcaccaggtttcataggtgatactttaggaggatcatgtgatacctgggaggtatcatgatcctcatctgtatcatgtctagtatcattaggtttcacaaatgatatcctagaaggatcacatgatactcctcaaagtatcattatgtatgatacctatgcagtaccacatgaccctacttaggtatcatgtctagtaacaagatcctatgggtttcagagatgatactttagtaggatcatgtgatacttgcgtttctaccacatatcatatgatacttgcgaggtatcaaatgatacctatcaggtatcatgcgattcttaccacgtggtgggtgatgcttgcgatgtatcaggtcctaatacctaactggtatcaggtgatacctaccaggtatcatgcgattctgccatgtatcatgtgatacttgagaggtatcagatgatacctatcaagtatcatacgattcttacaacatagaaaatgatacctatcaggtatcatgcgattcttaccacgtagaatatgatacctatcatgtatcatatgactcttaccacgtagaagatgattctaccacactccacagccagccatgaccaagttaacaagttctttgcacaccatcttgtctctttgctcccccaaagtagcagatggataggatgaaggcccggactcgcagcgggatcgacggccggcgacgaaggcgccgaccggaaagggcccgcgatggagttggagccccggtggagggcgcaccggccggccacgcaaatggacccaagggtgggcgttaacggcggccccgtggatggcaggcggtggtgctgga

SEQ ID NO: 70925 - DNA, 5494 bp, Oryza sativa
caagtttcaaagatgttttccaggcagctgctcacgtatcagtgttcctgcagtcatttatggtagatgtgcttggcaaaaggaattttggtggatacgccatactggctggccctatccaagttgtctgcaccatctgattattggcatcaccgttggcctaccacggtgcctttttcttctgaatcctcaatttgaatcaggccaaaatgcacgagtgttaggaatattcaatattgtactccaagattggcatgactctgtactagaacattcagcgtgtaaacgaccttattaatttggattgggatcctatgctgtttgaatagggaatttggaaggctatatgcatccagaccagcagggaccctctgcaaattaaatatggtgaaggttgtggtttataaggcatgcaagtccgcaagagcccactggcccctgaggacaaaggtactgaaaatattgttgttgcatagagattttgttcaagggtcagctcaatactacagaagattgggatttcggatcatgattttgtatgattgcttcgtgaattattgatggttcggtataccgaattcgcagtttatagtacatttggaggatatattggggtctacacaataaaaattctttcgtcttggtttctgctagacgttcaagctgaacaatcatatcgagtgcacgtacccgcgaaagctaccagtcgtctgttatgtggtatcccaaagccggtggagtataaggactgataaaaacctccttgaaattcctcaacaatactaatgcagaggtgtacgtaccatcatgcctgatcgctaggatcatctgctggaaacactaccttcagggtaaaaaaaaacacgtagcgctagtatttgacgctaatatatttacttagatttcattgttttgaactgtacgtgtcgagttaaaaaaatgaatcgagaaggcatgcatgtacattttgggttaagccaaattgccactcctaattgacgagtccgtactgataggttcagagaagtgatcattgacgaaatgacaaagcatctgtgagcccgcctgcccgagacgcctggcaccagggttcatggctatcatgggacaaatatcgtttttggcactattgtctgaagaaatgatactgtagctcgttctttctgcaagactagctgccatcgttaatttgcatccttccaatgtgcgtctagctactaggctagtactctaaaactaaaactttaaagaaaatctcttgtataaccttaaaattttagctaatcttttctatgtccctgtattttgcttacttctttgtatacccaaaaatatgattttgatcccttccatacccctcccgttagttgaccgtctaatttctataaaaacaaccattttaccttttggatgaacatagaaatttatgaattatgttagttgactgtctaatttctataaaaatgatcattttaccttttggatgaacatagaaatttacgaattacattactggaaatgcaaaagtttattggatgagactattatagttatgagttagacgtgtgatacattatttatgaaaaaaatatttttagataatgaaataaaaaatatgtatttattttatttaaaaaaatcataaaaataaggagcattcatacaaggatagaactacgaatggtcaagatttttttttaatgaatgctcccgataagaaaatctattgtcctattaaatttcaaataaaaattttaatttattatatttgttttattttcaaaatttatgtctaaattttccgcactaattatttagtctcttttttacataaaatgcacatattgtgcactcaaacaaaattttcaatggtttttaagcttatattcaaacctaaattatcaagggcattaaagacatttgccaccaacttaacggtgaaatgaagaaaaatgtgacggcaaaagcatggaagggatcaagttaaaatttcaaggggtatagaagggatcagataaatttcaggggtataaaaaaaattgagtgagttttcatgggtatacaggaaatttactcaaaaactttatcaatgcatttaccaatcatgcattcatgcaaggttgtttagcttttgatttttaccgcacgcggaactataattatctaagcattaactattacaaattcataaaaatgagtttatttgatttttgagagaaatttctatatatttcttttaaaaaaacatatcgtttagcattttaaaaaagcatgtgcaccgattagcaaaagaacacaccttaaaactttttgcacgatacttcctctgtcgcgtgaaaaacaaatctaaaaccagatgtgacacagaacaaaagtgtaacatctggttctatgtcacatctgtaaaaaaacgaatctatggattacccgtcgtctcgtcggtttatgacaatgatagcgtaattcatccaaaccgtctgagacgatgggtttagcctctaggtgctgtaactgtaacaggatgcaagacaaatgtaccaattgtatcggtagctcaccctctctcttcctgtatgtcctggatacagcgagggacttttttaccccgaacaatgcagaatccggcgcatgcagctatgcagatgcagggcaatggcacagcaagcagcacagacgcccagaatccacgaaaaagatcggcacagtccacatggaggctagccttgtcttcgtgcactagcatagcataccaggaaacagcaaaccgggccaggcttgccgctccgatatcttctccggtgtgggctacctagctccgcggccgcggccggccagccggtcccctcccttcaatgcttactgccctctccgccatgattgcattgtgcgccattgtccagggctccaggccgtgatcagcgctcgctgctacgctcagaccaacacaggaaattattacttgctccctactactacgtgcaagcagcgtaaagggggcaggccactgtttgaaattcatccctctcaccttttgaaacagccgcgcgtcgtgccgctgtagtagtgcagctgtgcaggtgcagtagctttgggtcaaaactcaaaactcgaaagggagacagcaccaaaaagatactgcggctgcagccacacagggctagctgcttgacgcagagagttcgtagcgacgttgctcgtctgggcatggcagtcgcgcctagatcggctcgtgcacggcatgcgttgcttgcctgggtacgccaccacctgcgcagccagcgatcatggccggcgcggcgtcccacggcacgagagcgagcgcgcgcgcgcgcggcactctcgtgaaggcgtacgcgccatccggccgcgcggcgcggcgcaggccggtgcagcgtgcaggttgacccgcgacaggcgcacggccgcacacgcggtgcggcgggccggcggcctggatttgggcggagttctcggtggccgtcgcttttcccgtgccagctgacgcgattacgagccgtacccgatcaaaaccggcgtgatcgccggtccgatgcatgcgttttgttttcatgccagatctttggtaatcgttagtacgactctctgagtccgcgagtacgctggtttctgttaattgcagcctacagtattttctttttcttttttgcctcggggaagcgatgcgagcgatacgtgataatttcaggtggcgcagtgccgctgtgcatgtgtgaaatcatgcaagattggcaggttgctagcgcgcacgtactcctctctggtgtgatcggtttcaggtgatagagacgatacatgggcataccttgacacggagtgggctgggatggcgcgggtggtccatcggctacagccttacatgctcctcctatcaaactctcgttatgtccagttcacttggcccatccttggtttcctctacgactagtgctcctctagccagtagccactacccactgtttccatattggcgcacgggtcatataagatggtttgttcctgttcacctgacgggaaattctttctcctaaaacgatatcgaaccatccttatccggattggattaacgagatcgtcgtgctaagtgtgctaacacacttgttatatgaccgttattccgagttcgtcttgctgctgggagagttgcagaattgtagtactcccttcgtttcatgtgacaagacgttttgactttagtcaaaattaaattgctttaaatttgattaagttcgtaaaaaaaagtactacctccgttttacaatgtaagtcattttagcattaacgagcatggtggctcgcgcaaattgcgcggctagcatcattatattttctctcatataatagcatatatgttttctcattatattattcaaatatattaaaataacaatataattttaaattttgtaataacattacaaaactactaatgtgtaatattcatattatattttatatacgtgttagttattaattatttttaatatcaaattttagttatttataaattatatatattcctatatggactctagactcgtcttttaatatttctttttttaattctgaattttctgtaaattgtatttctatatagactctatgcccttcttccaatattattttttttatttctgaatttttattatttctaattgtatttctatgtggactctaaactcatctttcaatattctttaatttttaatttcgaaattcagttactctaaattgtattcctatattgactttaaactcttcttcccatgtttttcttaatttcgaattttagttatttgtaagttgtatttttatacggactctaaactctacttttaattttattatgtttattccaaattttagttagttttaaatttctatatggactctatactctacttctaatattccttattttttaattctgaatttctatttcttttcttaattgtatttctatatggactctatactctacttctaatattccttatttttaattccgaatttcagttatttcctaattgtatttctatatagactctatattccacttctaatattccttatttttaattccaaatttcagttatttcctaattgtatttctatatgtactctagtctcctcttctaatatttcttattttttttaattccgaatttcaactatttctaaattgtatttctatatggactctagtctcatcttctaatattccttattttttaattccgaatttcatctatttctaaattgtatttctatatggattctgccttttctttttctccgattaatgtgagaatttctaggccatgagagcgaacgtggaggctcctttttctattcctttaataatataactagctaggtggcccgcgcaattgcgcggctagcacccatataaaattatttttttacatgattttacttaaaatttctgaaaaatttatctcgttgtcttaagatt

SEQ ID NO: 70926 - DNA, 4973 bp, Oryza sativa
cagcagagcaatggccaaaagcacagcagcaacagcacaacgaccaaaagcacagcaacaacaaaataacatcccacaagcacaatagtcgcaagttcagtgtcaccttatgttcatacgtattgctgcttcagcccgttcatctgccgcatggcaacgcgcccgacggcaacatccctaaggaggccgcagccactggcggcggacagccaggtgcggaggcgatgcacatggggcacaacggcatggccttccaggactggcatgacggcaaacaactggaggcaaggtcgatccaacgccgccagcaagctctgcacagtggttgtacagtgtatatgcattatgtccagcaaatgtgtacagtattgaacttaaaaaaactagtaatttgcccatgctaatgctacagtgacatttgttaatgcagcccaaacaattaaaaaagaacaggttttaacaatcgtaatatacataacaatagatatttttcccctctaggaattacaaccaaaatttcacatctaacaatccttgtaatttatctccaatctttaggtctttagctgtgagtccttgaattttcatgcatgtaattcttagatagttcaccttcttttacaaatgggctaaccatcccatcacccgttgacacatactctttgtccaaaaaaaatcccaatcatgagtttgaatctggacatagatttggttctttttatgataggagaagtaaagagtaaggaaggaacaatcacaacatgaaattcaaagccccaatagtaacctaatatgatatatcgaaagcgcaccaccaaaacaaaactccaacttacaaaattactcatgaacaatgtgttttttgctttttttttttcttatcacagtatcagttggcctaagaaacgataatttagacatcaataaattatccgatagactatagcacatactccctcgatatttcaaattaaagcaacttacttgcccacagttatcaaatacatcattagacctaacctaacagatgctcagcaccattagacctaacaacttgtctagaatacatatgcatgcttaaaaaatcatctaactactcacatagtttggtcggttcaccgaatgatgtcttcctatctgcatgccttgctctcttgttcatactcctccttccttgactgatgtatccattcctcctgtcagaaaggaaaaaaaaaacaatcataacatcctactcagaccatgtgttaattttccttttttcaatggacttgtcaattcgaagcttaattcctacaagcagctgatcatctgttaaatcctagtcaaatcaacaaaagaaacataagcccagcgagggaacaatagaaaccatgaaagggtgtttagtctcaccgctcatcaatttggtaggaaatattgctaaagttctaagaataagttgccctaaatcctaacaacatcttatcgcatcaaaattgctggtataaagactctgtttagcaagtttaggccttctttcaaaaatctgggtattaaatctgcctgcattctgaaacaaaaacatgctggcataatacagattaagattagtgcagaacctgcggatcttggagttgcacgtgttgccgagattcctaagcaggtcggctcgcatgcagaagacgatgtccctgagcgaaccctcctggcaacggtgcctgagttcccgaagcttcttgcgcagtagaggttggcgttgatggggtcccgcggtccagcatccgcgcggcatgcgcctcgtaggtgagagtgacgcgcatcatgttccgccagaacttgagccagtatgcagactgcacccgcggacggacccccacgcgcctccagaaaccccgaagcaggagcccgccggcacaaacggcgcggcagcgagctctggcgagctgctgcgtgctaatcaggcccagcgccgtagccgcacgccgtcgttgagccgcccggggactgccgccgcgcgatctagccgccctaggcccgggagcgctgtcggcggcagatccaccgctcccgagcctggcgccggcggagacggaggcggcgcagtaagcggtgaggggggagtaagccggcaccgcgagcggcgatggaggaggaggacgccgccgcacgctgtcatcgccgatacccaccgccggagaggagaggagaggagaggagaggggaatggatgggagaagtgtggcggctgagggtggagagatagagagagagaggaggggtggagagcagggttttatatggggctagggttagggacggcgatcagaaccattagatcgtagataggacggtcagaaatagttgggccatttgggccgaaacaggaatgatcttgtggtattttttagtttcaatttatgagaactttaaatgtaattttaggctgattttttgtttcaaatgaaaaaaatcataaacaaaaaaattgtagaactaatcgagatctgcgactattgtattggttctttttacaaataagttcatttgaacaatttaaattttgaattttcaaaatttgacaacttcgaataaaaattagggttaataaatgatttcaaatggaaaagtcaccaaaaccaaagctgtagaaatcatcgagatgaaaaggttttattttggtcatttctccatatgactctatttaaacaatttgaaatttgaaattcaaagtttgagaaattcaaatagaattttttattagtgaacgacttcaactgaaaaagtcatcaacaacaaagttgtataatctatctggatctacaatttttattttggtcatatcttcatctggcaaagtaatagtaacattgttcacaaaatttacaaatctctcttatagtttataacaccatataagagatatgtaaattttatgaacaatcatactatcaatttgtcggattaataaatgaccaaaataaaaattgtagatccagatagattatacaactttgttattgatgactttttcagttgaaatcatttaatatttgaaaatgttatttgaagttgtcataatttgaaattcaaattcaaattattgaaacaaagtcatatagcaaaatgagcaaaacataagttgtagatcatgataagatatacaactttgttgttgacaattttttcatttgaaatcatttaccacacaaaaaaatatttgaatttcttatattttaaaattcaaattttatatagatcaatcaaactcagatggagaaataaccaaaataaaattggtagatttcaataagttacacaactttgtttttgacaactttttcacataagtttgtttagtatgataaaattcgattcaaagttttaatattttgaaataaattgagaggagggaggcaaaatgaacttcttgactcgctaggagtgcggtatgggccaagtgggaaggttggaggcgtgttagattagtttctttagaagatataaacgtgatatataaaataatatgcaatatcaaacaaaacatcgtgtgcagcttagtgttttgcacaccaccactgaatcaggatctcgtgggttcgactcccagcgcccaacaatttttagctattttgctgagttaggcgcacgggttggcccattttgggtacgcggctgttgggctagcaccaggttggaccatctgaaaatgaataaaaaaactgatgtggcagtaaggctcgcctacatggataaaaatattgaaaatagtacaataaataatttgtgacccataaataggtcttatgacatagtaaatattgtcacgggacgacgttagactaactatatgacacttattgtgacacacaattttttattgtcattaagttgaagtgcttaaaataaaatgtcataaattagatgatatagtgacattatgacctatgtcatattaaatacgtcaaaaagccacacatatcttgtagtgaaatgagagatccattgtgttgtaacatccacaacaaatgagagatttatttgttgtaaccttcacaacaaatgaaagattcattgtgtggtaaccttcacaacaaataagatttattttatggtaaccttcacaacaaatgagatttatttgtgtgataatggagatctctctctatataaataacgcaaggtagaggctctcaatgagtgtgtctttctcctgctattgttcattggcgatactcttcttctgttcctacgctgtctctctttttcccggttctgttcatcccgcgcgcacgggtgatcggaacgagcaggtgcctccgaaactccgtccgcttgagaatctgcatgggtaggcgggcgatcaagtttttgggtagcgcttcaagcgcgactgctctgcatcatcttcaccaacatgtcgataaccggcgacaacaacaacactggagacaaggagaaggagcctcccgtcaacagcaacagaggcaatactacctcaaactccagcaaatggccattctcggggtataacgtttcactattaccgtttgttcttcgtttcttacagctgtcggtcgcaatattattgcgttctcttgtctatgttgatgcttattctatattaagcatgctcatgttgtacacatctaacaatgtcactagatctactcaaattacaaatatcatatttattgtcttaatattttggattaaaatatgccgaattatgaccaaattttcaacaatccaaaaacttgataggtctttttcgatacttggcttagctgcatcactaaaaccacatcctttcgatggttcaaattataaaagatggaaagcacgtgcacttttgtggttgacggcgatgcaatgtttctttgtttcacggggcaaaacgagtgaaccgcctctctcccctgaggaggaggctaagttcgaggctgcggattgcttgttccgtggagcattgatcagtgtgctccccgatagta

SEQ ID NO: 70927 - DNA, 15418 bp, Oryza sativa
cattataggtaattattgtataaattttgactattaagtttactatagatgatttggagttagtagttgactactgtaaaattgctctaatatatgtcatgtcagaattcagatagtgtcaaaaagacacttaggttgagtactttttgttcactttctcaatccatctatctcgttttttatgctcactttttccaaactactaaacggtgtgttttttatataaaagaaattatataagaaagttgctttaaaaattatattaatttatttttttatttttttatactcagttaattatatattaatgaaccaccacattttctgtgcccggagatggagttcagccttaaagttactacctctccttcattctcgctattttgctcatccatacaaaaggtccaaaactaaccaaaatggagcctctgtcgccaactgaggctgaccggcttaatgtacttgctgttaggcacacagttaatcctgcaattcggagttacataagtttttaccgtcccagccttaaaacgattgcatgtacggcgggcaagaaagcagtaattattagattgtccaattggacgacgctgtacctgttgttgcgtcctctcctctggttaagaaactttattaagatgtcatatactgtgcgtgcatggtagagcctgccatgcatgcagcatgcatcgctggatcagtcagctggtgttaagcatagctaggggagcgatcgatcgacgatcagtacgttggggggctctgatttatggtgccacagtaaaacttgaagttgcactgacacgcatgcacatgcaattgcatgatcatattcatagccatagagtatgcaatattgctgcgccagatgctttcatgcacccttcaaattcaagcaaaacaccaagcaagcatacatgctcccgggctcccttctatatcattcattacacgggtactgaattactgaaacttcaaaaatataggtgtagtactagtaccacgtaatttatttcttgttacccggtttgtatatgttgtgactattccaacgaaattgcacgcgtacaccatactacggacggcaactcggcaagtacttgggtagctgggcaacagatcagttcgcgtacaggctcatcgactacgtaccaaactacatacgtataaatgtacttatacaataactatttactccatgtttctcgcgcagacgtactccatccgtctaaaaaaaaaagacaaactctgggtttccgtgtccaacgtttgactgtccgtcttatttaaaaaaattaaaaagacaagtcacacataaattattaatcatgttttatcatctaacaataatgaaaatactaattataaaaaaattcatataagacggacaatcaaacgttggatgcgaaaacccagggtttgtctatttttgggacggagggagtagtacgtaatagttctccaacggccaaaaagcatgtaccaatagtatagtatagtggagtattatatactattaactttgtactctctctctcgtttttttcaaaaaaaaaagggtttacgcaaaattagtactctctggctagtccccttataaggtttttaggattgttcgactttatagaaaaatgtaatattatttttaacataaaataaatatatgataaaaatgtattcgatggagtataggtttagtagaactaatttggtttttttatatcgctatatttttttaattaattttatcaattttaaagaagtttgatttggaataaacatataatttcctgtaattaatatggaatgggggaatacctagctagtaatcaccaggtcaaaaaaaaaaactatttaacgctagagctctactatatatgatgctctgtgtatgtaatctaagtacctgcagactctagcagtatcagtgtaccaccaagatcgatgatcgggcactactatctcacatagtatatacgtacatacggaccaaccccatcatccagtagtacttgacagtatcattttcttcaacttctaagcaagcaatgaacggtcggcacacatgcatatagttgtaagtactttcgtactactagctactccatcagtcctacacagcacacagaagtacctaagataacccggtcgtgtgcatacttgcctgctgcctcccgtgtttttatccaattcgaagcattgtacgagatgtgtaaagtatactacacaactctaacatttttttttttttgcatcgcaagacgacatacgaggtcgccgggtcgatccagagtttggtccgtcctgctcgtattatatctgcacagtacagtacacatggtaaaatcagcacccgccagtgaaacgcgatcgaccaacgtacgtacgttcgccaaggccgatgtgtgtgtgtacatgtgtttgtgtgcatccagaatcgtacaaacggccggggtctcgcgcagcagcagccagctagcgggcgcatgcatgcacaccgcggcgcacaggctgggccgtggcagcctgctgccgcgaatgaatgccaagtcgtccgcattagccagcggcttccggctttcgcaggtaggggctctctcaggagttcgtggccctgacacggtcagtgcactgcgcgcgcagcgcgcccacccgccggagcccggcgccgcaagccttttccagctgcggcgtttttgtccgagccgcgcgcgcgcagggtgtgagatcgattcaggggcgcgcacagcgagcgaaaagagctatactcccatgcgagaacgaagaggccacgacacgtccattaatgctgacacggtcatgaaagtgctcacggggaggcgcctccgctcccaagtcggtcgcgcgcatcatatcgtcgttcgtccggacgtccgcggtcgcgcatggcaaaaacgccaaagcgcgagcgcgatggagaaagcggcgacgccgacgtacggatcgaccaccgagcctaccgccatcacatgtcgtacacatgaaacgaaagaacgagcgacgccgcgaccgcacacgcctagtccgtgccgttgcggtgtgaggtcggctgcatggatgcgtttcgtgggcgcgtgtgtgggggtggggatcggaggattcggccggtttggattttactgctgtgttgttggccagttctaatccggttcggcctatcttgtgactttgtgatatgtgagtcgtttgacgcttggcaggccgtcggatccacacgggtccaaaagcgtcgtcacgaatgggcagtgggattcactatcttgcaccttgtttggtagaactctaacttttatatctaactttagaagttgggtctgaagtggagttgtggagctgacaaaaactagctccacctctctagttcatttcgtaagagagctccacccagctctgctcccttttttgtggagctgaaaactgtttggctgagctccaggtccaaaaaaagatggagctggagctgtgtcaaacagatccatatagtagtacaatctagatccaaatgaagcgcataaagcctctagtattagtaactttttctttttttagaaacacaagtactagtatattttagtttttttttaagataatggaataactagtatattttagttagccttgacattgtgaaggcatgtacaattattaataatgatatcttaatattgctaatttggaatatttaattgttaacatggaagagagaaagtggataaacaaaacattgttgttatggttaacaacgactcaacaataactcttagtcatggttgcataagagtgaaaaaataaacataaaaataattaaaaaaaaaagaatattttaaagttaatggttatagcctatcatcttaacaattgcaaagatatagtatctaaataagtttgtattgtctaatagcctattcgtattgggggaatttcaatacataggaatagaaaaagcggaggaattgaataggagtgcatgcacacttcaatccataggaaattttccatgaggtttgtttggatggaaaatttcctttgttttctctctataacttgtaggaaagaaaaaaattcctttggttttttctatatatacattgctatgaatcgaatgatattcgtaggaattaatccttaggaatccaaatcttttgaaattactctaaaacgaatagtccataagagataatattgtctctaccatttgaatatgtcctcgattcccagcttaaggtcaatctacacagttgcacgcaccggatatctttaattcttctcttctttgaattactgccctgtgtatgactggtaccttagcatggttgccaatcgactttttctgctgcttgtcagtgatttcgaggaaggagaaatgttagaatacggatgaactccctcactgttgtaaactgcacggatcctgatcatctgggttttactggagtagtagaaagtagaattggtgccagcaaacacagtgaaagttgtctgaattttatctgcccctttttatcttgtttcaatatgggagtacttgcgcaagcacctaccgggagggagcttaacatggtagtggcacgcatatatttgaatcgcatgctgatttacaaacttgagcgtacgaaatgatgcaaagatatttcatcgatccagtgcgaacatttacatgcggctctgtatctatcgtggcatgttggggaacgatattagaaacgaattttttttatttataattttttttattaaaagttttacaaaaataattttctattttgaaaattgacggaagtagtcgcctaccgccctctgggaaggcgaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaataggcggcgagggggggcatggaaatttgcaggcggcccccttgccgccctcggcgagggtgattttgtactgtgcggggggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatctccaagactgataaaatacaattttattattttttagggcatatttggattgttaccgtacaaatattttgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggaagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgtgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaatagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggatgtgagcgtaacgacgctgcaataaacatgatcggaattagacatgttatgtgaagaaaaaaaaaagacgactgataaacttataacgcagcgaagttgcactaaccccacgtcgacaccagtaagtccccatcgtgggaccgtcctctggccactgcgcgctgcgaccaaccccatagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgtagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgttaatcccacggttcaacagcgccggtgtgtcgtacgccatacctgcatcaaataggttgatcagaaacatataaataattagttcaacataagtaataaatgttgaactaagcgaattactaacacatattaaacaagagtacaaacaaacaaaagtgtttagtccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattgtaccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcaatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctatgtgctacagatgtgctaaaatatatggaactaaaactaaaacgcaacatatatactcaaacataacatattagtacaaatgcacaaaagatgtatgggagcatacctgtgatgaattgagcgaaccagcagggcttcgccgctccccttctgctgccctcccctctctctcttttggttttttttggatttttagtgaatataatgaaatttcacagaggagggactgggctttatggggggagaggcaaaaatcgccctcccccagggcggcaagggggccgcctgcaaaatcccatgccccctcgccgcccatttgcaggcggccccccccccacagtacaaaatcgccctagcggagggcggcaagggggccgcctgcaaaattccatgcccccctcgccgcccatttgcaggcggccccccccacagtacaaaatcgccctagctgagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcaccctcccagagggcggtaggcgactccttccgtcaattttcaaaatggaaaattatttttgtaaaacttttaataaaaaaaattataaataaaaaaaaatcccgcccaagtaaagcagcccgtacaacaattttatcccaacaacaaaatgggccggaaaggcctcgtgggtcgtctttttttctcgggccatcagatccacggttcctacttccaagttccaacgccgttttctcctcttttaggcgacccagccgacttcgccggccgaaacctgccttacggcaactcatgtcttcagtgacctaacagcttcgtttatatccatgcttatataagttaaaatttaaaattgattttctggtttttgttgtagtttattttacaacgtttacatttatatcactaagtagtacggacacatataaacgttttacttataaattactacctctatattttactattttttatatgacaccgttaaatttttacattacgtttaaccatttatctcattttaaaaagtaaccatcttcccttttgttgtggtttgatttattactaaagaaaatttaagaaatatttttattttaagatttgcacgtaatttattaataagcgaagtaagcgtggctcaagtagtcaggtttgttgtggcgaaatcaacctactcaaattcaagttctagacttgatacatagaagtgtaaatggctaacccgtaaaaccaacttatatgtcaaaataagtcacgaacctgtttattttgatccataagtggattcgcggcttacccatttatacccctattaatacgggtgctcgcacttacgactaaattattctttcagtgatagataatgaggcgtccataatgattttgtaaatctcaagatatgatgtctgtctttcgaatgtgcttatatagataatgtgtgcatgtatggtaatagcggtagagtgtgaacacattgcttgcgagcgtccgtatttaaaaactgaggaaatatttttttttgctaataagcaataagcacaagtgtaattgaagaatgggtaaacaaatcaagtgatttctccgtaactacgtacactcacgccggccgaatccctcgtctacaccaccgcctggttgcgatttgtcagttatagggcgcaagttcttctctaatcgaattcacgcgggcgcggatatggacgtcgactgtacgctccggcttgcgcgtgacgaggcgagaagctctcgctggtttgcagtaggttgccgatctttttccgcctactattagtgagctcgagtgtggctgcctggtacactggtacgtgttggacttacgtaatactccgctctactgttaccaaaccttggcgacaactctactgtacggtactgtcatacgcatcacgtaatcattgaaaccttagctgctagccacgcgcacagttgggcggtgggcacgaccgcaccagcactaccaccggccacactttgcacccatacgcatttggtcttcttttgtcctacaaaatctactgctaagttaccgtatcgttaggaactcatgatcatacgtgcgtacaagtacaacgaacgatcacatgcatgcacgctcaatcgatcccaagcatgtaggagtaggaagagtacttaattaattaggctaatgaaatgaaatatcttgatctggtagtctactatatgccattaggctcgatgagattaacaccagagattagttcacctcaaaatccaaaagacaggagctaataggtaggaagttcactacacggcgagttttgcctgcttctcggcgacctccaacgacgactcctccgtgatcgtgcaagtcgagctcctccggtgcgacgagcaggacgcgagggccgggtcggcgatggcgacgatgacgtcgatgaacgccgccaatatggcggcgtgcgtgtccttgccgttggctcgcaggtaccatcccagcatctcctccagccagccccagttgccgaccccgtgcgcgaccaccatctcctccatggacacccggaagtccacgtacgggtcctccgactcgaacgccaccgccacgccgccgatgaaggaggcctcgccggcggcgtccgacgacttctcctccagtatggagctcgttgccgacgctcccgggtcgaagaggagccggtcggaggagcggaggccgcgcacgatggcgtcgtcggccgtgtcggcggcctcggcccccgccgacgcctcggacgccgtggagaggctgtcggagcagtcgtgccgcgcggaggaggtcgtgaaggaggactcggcggagtcgaggaagatggaggcaatggtcctggagcccgggggaggcggcggcgccgtcgcggcgcggaaggactgcgtccttgggttcttgcaggacggccacacccacggaggtgcggttgccggggcgggaggcggggacggcgaggtgtccctggccttgttgtggaagaaggagctcaaggccagccttccgatgaccattggtacggtgtgggtttcaagatgaaccggccggaggacagagggtttggtgtgtggctttaaaacaggggagatatgacacaaatcgtggacacgacgcggtttggttttaaaggagctttgggagggaagaggggaaggggggacggggatgaaagaatagttctgttgggcttttcagatttatggcctgtttacatggcaaaaaaaattatcctacatgttacatcagatatatggacacatttaaaatattaaatgtagtcgaataacaaaacaaattgcagattccgttagaaaactgcaagataaatttattaagcgtaattaatctgttattagcaaatatttactgtagcaacacattgtcaaatcatggcgcaattaggcttaaaagattcgtctcgcaatttcctggcgaactgtataattggttttcttttctacatttaatactccatgcatgtatccaaaaattcgatgtgacagcgtgaaaaaatttgttttggaactaaactgccacttacttgtatatatgtagatcttcgagaatattttttgaaaattagagtatctaaaaatccgtcgcaagttttctaaataaaaatatttcatatgttaatatagtataattgaagtgtaattatgtaattgtattgtgaacttgtttggtagtgttccactttctaatttaactctagaagttgggtctgatgtggaattgggtctgaagtggaattgtggagcatcctaaacccattttcacatctctatagttcattttgtgagagtactccaaccaactcgacacctattttaggtgaagctggagctggagccgtgacaaacatgccttggaactacattgtaattatgatataacttctataaaatttgtattcaacaatagtttggttgtcaataaccgggatcttacgcgtgacaggtgtaaaaatatatttttaacaatttgtttccttcatgcacaaatctcaaggcagtccactcgtcacaaatctgaaagttttagggacaaaaaaatctcttggaagttttctagcaattttgtaaaattaaccaaggccgcatacttcattttacataatattgttggattttttttctagattatttccatattgttatactctgtaaaaaggtttgggctctcattatcagccacaatgaaaatttaaatatctgaaacctttgagctgattttaatttaagtcatagtccacctgaaaaatggtttttctcgggattgagatcctctaaccctttgattttaaatcactaattaacatgtggatccgctatctagagagcccatatgtcagtgacctacgtagtcgtcagagagaattaagttagaggatcctcttctgtagtcttgggttctcattgtccaggaagacactgtatgtactgtcctcatacttgagtatccatgacttgatgatccatgtatgcattggttcatctgaaaaccaaaagggtgcaattttcagaacagacaacccaaatgaaccttgcaactcatttggcacactcagacggacgatccggattatgggggcaagacccacagtcccacacatgtgcgttcataagccaaaaagagcaggatgctgagacacaaacacacaggacagcgctgatacatgatacaccatccattgaaacctgaatggctaccttgtcttgcagatggaaagacgaccgggtcttgtagcacgaagcatgtaaaactgcaaaggcatttcgtgcttcaagcgaatgtttttccggccatgtttaacgcaaccccgagaggggagcttgaccctgtaccctgtccacgttgctctttcatggttccatgcaagatcggaggccatgtctttgcctcctgcttcattgcaagtcgtgtgtggctcgctgcatattggtagcgaactcacttcgccttgccagtcgcagggtggatggatgatgcacaaaagttttca

SEQ ID NO: 70928 - DNA, 548 bp, Oryza sativa
gagctaaccagctgctaaaactctcggcaaccatgttccatgcacgaccagatatataaagatcaatcgcatcgaggcaacagtggataaatctccctgaaatcttcagctgaaaaggtttgggtaaagtttgtggcgtggtgttttggttgctgttgacgcatcacatcgaggtatctatagctctgatcagcagcagtgtagtagtacagtgaatgaaaaccacctgaacggatgaaccgtgagtggctaatcatgtcaagctggctagctagcctgggctgcctttctgcctgataggtagccgtagtagttaggatcaattagccggttggtgacacaggctcaagctagcgcagcaaaggatgcggccgtgcacatgatggatggaccggttggataacacaaatttttgacaatttgaccctttgcaaaaactaattttacaaatgaatcgtgccacaacttatttcagaaatgacccttttgtttagcgccaaatcgtatggtgctgaacttagacacctcagcgtcacgttaactggtgt

SEQ ID NO: 70929 - DNA, 4659 bp, Oryza sativa
tagtcgcataacgtaaaggaccttggagattggagttcttgattggttcctattggaaatttgatcataattcggtatattttaatctaaaataacaagataataagcatgatattcgcaatgggaattgatccagtgatagtggtaaatgtaatcaacatgagcatacttaatatagaataagcatcaatatagacaatacaacgcaataatattgtgactgacagttgtaggaaacaaagaacgaatagtaacagtgaaacgttatacccccgagaatagttctccgctggagtttgaggcagtattgcctccgttgatgttgacgggaggctccttctctttgtatctagtgttgctgttgtcaccagttgtcgacatgttggtgaagatgatgcagagctacccaaaaacttgatcgtccgcctacccgtgtaggttctcaagcggacagagtttcggaggcacttgcttgttccgatcacccgtgcacacgagatgaacagaaccggagaaacagagagacaacgcaaaaacagaaggagagtatcgccaaggaacaacaacaggaggaagactcgatctttgagagcctctgccttgcgttatatatatagagagagatctccattaccacacaaaaaaaatctcatttgttgtgaaggttaccactgtcagggttatgaatgaggtataccctctacccttggacgtatgttgtatactgatacggtatacctgcgcgtatatggatgtttcctatacatgttaaggaaatccatcacgtaacagaaacggagtccacagatggaaggagtcatgctcggacagaactgggtcgttactatatcgtgtggggtccgatatctccgagttctacttggagattgactgacccgcggtataaaagggaccccctgggaggacctaaggcatcgaatctcaccaccaacacatctgccacagcctacgaagccggaacctacaggagccaagtcgccgggtgatctagtcgaaccaactcgactacgatctcgtcgataccatcgagttcctttattccctttgtaatctgtgacttccatcatataatcccataccaactggattagggctattacctacgaaggggcttgaaccagtataatctttgtcttctgtttgcttgatgttctattacgtagatcctcgtaccagcgtaccccaataccctccatatccggtccaagggtatccctcgtcgacaaccacaaaataaatattatttgttgtgaaggttacaacacagtgaatctctcatttgttgtggaggttacaacacaatgaatctctcatttgttgtggaggttacaacacaatgaatttcctttattaatggcaactttattctcatctgttacaaaacggaagagcagcaggcaggctcggctcgattggccactttgcatcggcacacccacggccgaggccgactcagcgcgcgcacgtgcgtgtggctgtccaaccatcacctcaaccggtcaacggaaaatctccaatatcaccatgtttaagttgaggttcttccacctaaattttcaaggcagtattattatctctaacattacttgtgggctcttgaaattttaattgaattaaattgggcctagcccatttattccaacaggttccaccacaactaatcattgtgccaaactacacctccatattttcttggcacagaaaccagtctcaaattttttttagtgacaaacatatcttccaagttgaaatgttctaaattttattttaattaaaactgcacactactgtgcctagaagagatttttctgaatttcatgtaaactggcagattccataaatcccgctaattcgaaagccttgtcatcagtgctagatacatatttccagatttatttgactatttgctatatttaagctgccttatttttttttatactttaccacctcaaagaataagtacattgataaacctaatattttacgcataaaataggaaggttgttaacatatattttaccatgaattctaaatgcttacacacaaactttccttttactaaagttatatgctgtctttttggaaatcacattttataattttttttataataatcatattgctggaaggatgttttctgaggctatataaatgtcaattattaaaattagattgtccaccaatcaacatatactactacaaaatctcttattggtgacggttcatagttaccagtttaattgaaatcggcacctatttattttaaaagtgctggtttaaaaaaatgccacatatactatagtactatcctatttgatttgtgccaaaccattcaaaaacagaattaaaaatcaatttaagggttttgttgaatgtaggatatttttttaagaaaaatgttaaaaaaacaaaacataatacatttatatattttagagcaattaaacaatattcacgggctataaattttttggtgcaccacaaggagcgctcattttctagtatctatgtaatactggctagctcaatcccttgtaaacacatgaatatgtgaggcaacaggataaattttgagaggaaaaaacatagagtaaaaggtaggtagaacaccactcattgaaggaaacatagaaaaaaattgctgaaaatgatttgaccttcaatgtgtggaattgatttaaatcaagaagcattgatatgtaatatgccgtcctaacgctatacccaccaaaatatttagtaaagcattacccttctctaatttgacagcatctttagatcactttaataccttgagtaactagagtgaagtaggcaacagcaaaacatgagtcgttccgaaaatattatctctcttcagccagaaaaatggagactatgtggatcaggaatttttttgttgattcctgcgaaattgtaaacatggaatattaatattgttttggtccctattggttcaaaatagcttccataaagtaaaatagtcttgtcactataaacagatgtctatagtgaaactaaagcaatttcaagggtatgaatctaaacaaggtgccaaggtttacaatcagaaattcaaggaagtagctagaaactattttcataagataagaagcatagactattttcacactttttgacctgaactcatgcggttaagttgcatctacctaattcaaacatttgagtatttgacgtgtggcaatgaaaccatgactcaggttactcacatatcatagccccctgtgaaagggtgtgtaacctattagttgcagtgacctaagtagcaccctaagattctgaaagtcttcatgggaacgaatttcagattggtttgcttgtaggctaagttcccaatttaaatgactgtactgcatatatcccaatggatcttaaaacgtcattgatatactacaaattcatttttcttctaaatatgtatatgtcaaatgtttaaaatcagatgtttatttcttttggagcatatgcatatgttacccgcttgaaaccggtttacgtaacctgacgaacgaactaagagtgacatgacgttgaagacggggaagatttatgaagaaatcagggaaaagcagagtagacagtattttcatttcatttttcatatcccattcgattacaggttgtgtcttaatatactagcaacacacggaaccaccctttgggccccactccagcgagaacacaatcagcttgtctctctttcccgaatacatcttcccaactcgagtacgccttatagatgtgcccttcccctgtttgagccacctcttagtgttttcatgtcatcccgttgtcacttgccgcatccatcttggctgcaggcgctacacagggtatgccttgtcgaggcttcgcttgatccggtagtggcgctccagtgaaatggaaggttggccacaaagcggtggcacccctgaaccctaaaccaacaatgataccctttcacttgatccggcataggggaatcagcgcatatggtggcatcttctccgcggtgggtgacggctaacagagcggagcataatgaaggagaatcggcgtaggcaacgatatctattcctccctggctagcttgggctttcacgatgagagggcaagcgattgtttcggcggtggtgctaatctgcctaggtacaccataggacgcaccggtccattagcaggcctgtgcgcctagaagcaggctctatcgctacagtagcagttactccctctgtcctaccggataagacatttcataatacaataaatctaaacaaatagaatatctcatccgttactaggttgtaatattgtggaatggagggagtaagccgcccaaagctaacataatgtattacaaaatagcgacaagaaccaccttggtgtaccaaatgaattactgtaccacccaaattgacaagaaaattacaaatcaataacaggaacagggccaacaaacggatacacatagtttactcataatatcatggatcaatctcgctagaagcgcttcaactgtcaagtccaagctcaatctgttagaatagacaagagcacactattttttggggtatcacggtgaaatcattttttcgaaatacatgttaccccctcccttcttaactccttgtacgg

SEQ ID NO: 70930 - DNA, 1303 bp, Oryza sativa
  unsure (1)..(1303): unsure at all n locations
gtaattagctaatcgggggaaccatgatgccaagagacatgtggattcaatagggtggtgtcgaggagaacccccgggtttcatggcacagtatggtctgggacctaacctggtgttggtctgggacccctctcgttggcatatggtgaacctgtgtcggctttcgaaatgccttgtcatgaaagcctcaaggtctccagacgtggccgttctgcacgggctgggtgatccgagtgagtaatgtcgtgtgggtaaagtgtaccccctctgtagaggttattaaattgttcgaacagccgtgcccacggtcatgggcggatatgaggtgattcctagtatagttttgtttgactactgctttgtgagattgttgttgtggaatgggttcgatgtttggaaaatctgcggctgatgggatcagccaggcccgggtggccgtttgaaagctgttggccgggtgccagccttgatctattcaaagactgatacaatgcacatactccgaccggacgagacgcactgtctcctccgtgtcgttcgagaagcactcacttagttgtttcaaaaaggagtttaacaaaaatcattgcaaaaacaacagcctttcctttgaagcctgcattaaacacttaattcccatgacttgctgagtactcctgtactcatccttgctctatataaataaacccccccccccccccgttgctgaagaagatgaagtggatcccgctgatgaggagttcttcaggagcatgtcggcttcgatgagttttagggtttcggtctagttcccaagtcgcgcctgtgataagtggtttaagtcttaccttccgctttccctttttgtaatgcagttgtgagctcggaatctgtccgcaggctaacatgactgtactcttactctgtaataaaaagacttctgatgctgtgatatccatcttcctatagacctgcactattctctagtaaacgatcggtatacaggttatgtgagtcatcgcggactagttccgctcgggatagttaaaggcgtgacaggtgtccaattgtatcccgtcggattggagggtctatcttaagctcttgcctagttcatgagatnatcgagatcacacttatctcatatactgtgaatagcagtcggactcatcaatgcatcaacatacaatacatggtcaaaggacggtatttttctatttgctctcgcaaacgattggatgacaagataatcaaccatttgccaatcacaagttttcatcagtttttgtgagtttgagaggagagaaaaagagaagattgagaa

SEQ ID NO: 70931 - DNA, 2006 bp, Oryza sativa
ctgctagttagtaattcctaaaatttttagcgcttgtttttttccgtacagaaatctttttttccctttttttacaaaaatctttttttaacgttgcttcacccgctgctgcagctttcgtccctctaatatttgttgatctgtttccgtccatatcaaagcctgaatattgttgtgatacatgattgatttatagaagtatatatgtataatctaattcatacggaacttcttttggctaacagaaatcagacaataatttatattgagtccgtacatccgtatagatcctatatcatgtttgatttcaattccgcaaggctgcgtgcctctgaaaaattttattttgagtgaattatgctttgggccacattttattacctaagtttcactttagaccagataaatttgtcattgttgcgatttgaaccactacaaatgatttttttttctagtgcaatcaacgaccttaaacacatcagctctaagtatacggccgaactcttctatgtatggttcatatatttgccgaaaggaaagttagacatgacgagaaaagttgttcatggtagtccaaaccgcaatgacggtaaatttacccggtccaaattgaaaagataggtttaagggtggtccaaattgaaacttgggtaataaaaggtggaccaaagtgcaatttactcttttatttttataggaatcttatacgtagaagtgtattttgattttatacaacttttagtttagtttaatagacatacagctcttaacttctatttatgtagatataattgtatcttggatacaactatatcaattaatctataccattataattcggacccactataatctaacgggtaagattttaattccgaaatttaactggctttagattgtatttctacttggactcttcttttctttttttttctttttctccgattaatgtgggaatttctagtccccatggcgaacgtggtgcctcctttcaaagctgttttaataatataatagatagatagatttcccacattcatattgaggaagtagtaatattttcaatctaacacaaatttattatgaaaatatattcaattatttatttgatgaaactaatgtagtattataaatattactccctccatccacaaaagtgacacctatttcacatttgagtttttccaaataagttgttcctatttgtaatctttacgcattcaagacttaaattaagagataaattaaatattttattagaatccaaggagtcatctaaatagttattggttacatgtttgcattcactctttgattttataacattcaagatgatttaattcttccttagtcttgatgtcaaaagtaatatgtgtaacttttgtggatggagggagtactatatttatctataaacttagttaaacctaaaataatttaacttagttaaacctaaaataagttaaaacgtcttattacgtaaaacgaacggagtagtagttttttctttttcaacgatgattatatcatttttgcattcgtggtcacatttcactcgtccaagttctcacttctcaggctctccgctgtcgttcggctgtctcgtggaattgggcttttggcaccgaagcaggttcctcgccggcagctacccgctggccgctgttcgcctgtgccgctccggtcgtattcgtgcacacacgtcaaacagccaaactcttggagaggctggaactgggtcagaacttccagaaacggcccatcacattaggccctgaattgggctggaagcctggtacggccacaacagaggccctttgaatgatagggtcgctacgggttatcagcctaatatgacccgcaaggactcggcttccaacttccaagtagacaagtagtgaagcttccattgcaccttcgggatgaacaggtgagcagcgccctaaatagcagcagccagcaagatttgccataactaaagtggtctaaattgggggggggggggg

SEQ ID NO: 70932 - DNA, 1409 bp, Oryza sativa
ccaccaccctctcatcctccacgccttcgccgacctctggactcgcaacggcctcttctccccgccgtccccctgccagttctagccaagtttcaacgcgacgccaccatgcacgccatacttcttaatcgtgttaaccactagctatattactagtgtacttgttaccagcgctattgatagcgtgtctgtcgcctcagtttgttaactatctacatggtgtacgtagttcatggttgggagaggttattaacagagatcccagcgtgatgtggtgcatttccaacggtcttcgatctgctgaaaccaaagcacaaagaccgtgcaaaatgcaccattaattagctccagcagcttgatctgcttgatgtaatgacacgccatatgcccatgtacgtgatgtgtaatgatgcgcgcgcgtggcgccgtggtggtgtaatcatatactacttgtgtttcatgctaattaagctagtagtactccctatctatactaaattagctgaatgcactggtcacgtactgctcgctgacacctgagcttattagtgtactacgcttgtgcttttgttgcgattcgcttgcacgacggcgtgacgctgtcctgtccatgcacgcgcctgtgtgactcgttgtgtgtctgtgtgctgcgcgtatatatgccaacccgaccgctttccgtttcgtgtggaacaaaggtgagcgttaacgtatacgcgcgcggtcgatgcgacttgttgagccgtgggggctcagctggggcgctgaaggtagtacaaaagctgccgctgcgatgctgcttgtttccttgtggggtttcatcattcgctggctcgacgtgttcggttgtctcggtgtgcgtgggtgggtgtgggcgcgtgacacgctgacgtgcttactgttgcggcgggtgagatttgatggagagggagatagctcgcccgatcgacgtacggctggatccttccgcggatcacggtggttcaaccgtgcgggcttcaccggcggatgcacaagttttaccccctggcttgaaatccaaacccgcatcatcccaatcctggctgctcagttgggccctcgcgacagagccagcgatcgatcctaccgagcccaaacaataaagagctttttttgggttacgggtaaagactattttatggtttttcggcggtcaacagtgatgcacgctggcagtagagcccggactaccgtccatccgacaatcccatgagtgacctgaacaggatcattttgatagtaatctgaacatgtcttaagattgaaaaatattcctccgtttcaaaataattatttttcacccactttataccaccaacataaaataaaaagactaaaataccctcatgtttatcaaatccaatataatttctatttactttatcttc

SEQ ID NO: 70933 - DNA, 16168 bp, Oryza sativa
tgaactaagcatggctaagcaatccctagtcctaactctaatcatgttagaaccccaagttgacaaagaaataaggtacaacaatagcatggctacgacattaggtaaacaacccatagtaacattataaaacaatgcaatatttgaaagaaaacaatagagcatttgcaatataggatcaacatgttcaagtggcaagcatgacttgccttgctctgctgctggaggaacctcggcgactatctcgaagtacaccggagcgtcggaggaatcggaatctagcgacatacaaagaaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaatataatccagggctgacgtcatcaaggcggggcgcggcgccgacatgcgggccccaccggtcagcggctcggggagggaggaagggcgccgacaagcgggccccaccggtcagcggctcggggagggcggtccacggcggatcaggtccacggaccggggaggagcggcgcgccacgcggcggccgaaccgatggccccgatctacccaagggtagatcggacggcggcgggagctcgcggccggtgcgcgtgggcacggcgcaaaccggcccggcgaccatggcgcgcgacggcgcggcgcacatgcggcagcggcgcaagacggcggccgacgacgaccgaccggcgacggagagcggcggctagaagtgaaacggcagctacgcggctaagcggcggcgcgacggctaaacggtgcgggagagagagaaagaggaggagaggcctcaccgacaacggtcgacgacggcggccgacggaggacgatggcgacggcgggacgagctccggaacctcctaacgaacaaaaggagaggggttagagggagagaggagagtgcgagagagcgagggcgccggccgaaggcggcggccatggcgtcactcaccggcgcacgacggggatggggctccggcggcgaacctcgacggaggaggggtggacgaggtggacctcggccgcgcgaacccaacggcggcgacggcgcaatgcggcggcgagcctagcggcggctagcggcggccggagtagcggagacggcggcggcgggtggttgcacggcgcgggagcgatggagagcacgagggagttcggcgaaatggggaaaaagcgagagggggcgacggggaagcttaaataggggaggggagggctggacgtggccgggagaggcgggatttcgccggccaacgtggggaaagagagagaggagagagaggcgggattcgaaaatcaaatcccggccatctcgggcgcgggcgcgagcgggagagagaggggagtgggcgcggggaacgcggcgcacgcgcgggcgtggtcgacgtggcccagaggaggcggaggcgtggacgcggcggcggttgcgggcgcggcatcggccggaggtgggggaaggacccgacaggtgggccccacctgtcggcgaccccgggagaggaggacggcggggcggcctggctgggcctcggcctgcggccggcccagcagggaggagggggaggaaggagagaatgggccggcggcccattcgaaaaaaaagaggaaaaagagaggaaaaagaaaaagaaaaaggaaaaaggattttccctggaattaaaatattgcttgctcaattttaattggttaaaattatttctagaggtctgaaaattccactaaaaatcctgttaatgaatttcgacatgtagaactcaagaaaaattccacatgccaaatccgattattatttgcattactttcttagggttttctcttgatttgcacctgcattttcttggggttgttttaaaaattaaatttggcttgggaggggaacttcggggtgtgacaggtatacaccttaatgtgatctgagtggcttttcataaagcagagatgttatcctatagaacatcttagaaggaacacacctatatgagtccgactgctagtcacagtctatgagatttgggtgatctctagatactcatgaaaagtccaggagtataacttatacgctccaaacagaggggatgcaaatggcaacccagtaccagttaagggtttgagtgaaacctgaatcgcacaagactgacaattcaaggcatagtccattgttcagttgtgatttggtgtagctcttttcctaggtggaagttgaacttaacagtctccatcgaaacactggtataactaataggttcagtttggagaacatttcttgtgagccatgaaatctggtggggattgttggaataaatgggctaggcccaatttaattcaattaaaatctcaatagcccacaagtaatgttagagacaataatactgccttagaaatttaggcggcagaacctcaacttaaatagggtgatattggggatttcctgttgaccggttgaggtgatggttagactgccacacgcatgcacgcgcgccgagtcggcctcagccgttggcgtagcgaggcgaggcggccgatcgagccgagcctgcctgctgctcttccgttttgtaatagacgagaataaagtcaccattaacaaatgaaattcattgtgttgtaacctccacaataaatgagagatccattgttttgtaacatctgcaacaaatgagagatttatttgttgtaaccttcacaacaaatgaaagattcattgtgtggtaaccttcacaacaaatgagatttattttgtggtaaccttcataacaaatgagatttatttgtgtggtaatagagatctctctctatataaataactcaaggtagaggctctcaatgagtgtgtctttctcctgctattgttccttggcgatactcttcttctgttcctgcgttgtctctctgtttccccggttctgttcatcccgcgcgcacgggtgatcggaacgagcaggtgcctccgaaactccgtccgcttgaaaacctgcacgggtaggccagcgatcaagtttttgggtagcgcttcaagcgcgactgctctgcatcatcttcaccaatatgtcgataaccggcgataacaataacactggagacaaggagaaggagcctcctgttaacaccaacggaggcaatactgcctcaaactccagcgaagggccattctcggggtataacgtttcactattaccgttcgttcttcgtttcctatagctgttggtcgcaatattattgcattctcttgtctatattgatgcttattctatattaagtatgctcatgttgtatacatataacaatgtcactagatctactcaaattacaaatgtcatatttattgtcttaatattttggattaaaatatatcgaattgtaaccaaatttccaacagcacttggtgctggtttaccaagcgtgcttctacgttgtttgtgcgatttttgtccaaagagaaaagttcctcgacctgaacaaggttgagctcaaggtattaatatcgaatttccaggttctcaaacccctataggtgatatttgcctattcggacaaataaaaaaaggaataatatgtctgcaatgcagaacaattaaccaccattcaatcatcttcgtaaccgaacgctggttagcagaagactattctcccaacatagaaaaaaaaatcaataaactaccagtcaatacatatttatgggagacgattacacaaagcacgatcgttgtttgttcagtttttcttttctatcttttttacattccctcacacccccccccctgttctatcctttgtttcttttttcatttttattttttttactttgtaagcttctctatttatcaatgaaaactagctacaagcacttaagcatcgtttgcaagagctggttcccaacactaccatcattttccgcgcgcacgtttttcaaactactaaacggtgcgtttttttataaaaagtttatacacaaaagttgcttaaaaaatcatattgatccattttaaaaaaaatagcaaatacttaattaattatgtgctaatggactgctccgttttccgtaaatactgtttgggttgggaacccaaacttgcgaacagagccttatagatcagtcactagtatatctatttaatattagactcggtttgtcatatattttacgcagagtatgatggttcaaacgggtctaaaagataatatatagttaaaaagtataagtcatcaaagattctaaataataaaaactccattttaaggataagatttaaactcgacggaaagattatggacattgaggatgtttagattggtgccattttaaattatacccttttttgataaaattgacaaaaaaatatagatgtatatattaatttagtttgttaccaaacatttgtaatacataagaatctattatattattaagacagctttaaaaagagacaccatgtttactgtggacgcaagaaattcccatattaatcgaagaaaaagaaaagaagagtccaagtagaaatacaaattacaaataaatgaaattcgaaattaaaaataatcaatattaaaagaaaagtccatgtaaggactcaatacgagattaattaaaatttagaagaaaattaaataaaatctgaaataaaaaataaaagaagagttcaggtaggaatacaatttaaaaataactaaaattcggaatttaaataagcaatattgaaagaagagtccatataagaactcaatatgagattaattaaaatttaaaataaaaataaaacaaaatcaaaaaatatctctactacttaaaaaattgaagatgattccgtcgtccgtccgtgaaaaaaagggcgaaaaaaaatcaaatatcaaataaaaagatagggcgaaaaaaaaatccgattccccgtgagccttaatatgagtcagcatcatatttggacccaaatcctagagaaaacactagtacaagaacacaagaacagcatcaacacaaacacaagaagaaaacgcgacaccggaaggggagggtgctgccgtcgccgggccaccaccacctcccctcccttcccactagatccagcggagggaagggtgccgccgccgccgtcgcctcccttcccgttggatccgacggaggggagggcgtcgcccctgcccaccgcctcccttcccgccggaagggagggcgttgccgcctgccgcctcccgtggctccatggcgagaaagaggaggcgaggggcagagaggcgctgaggtcgcgggtagagagaggagagaggaggcggggtgtcgcgggaggcgaagagaacgagagagaggataagggagatagagagagagaggaggggcggtgtggttcggtttatacgggcagtttttttttaatatgtgctattttggcggtgtggttcggtttagttggccggtttttttaatatgtgttatttttttaataaaatcaacacctataatataaatataggtgtcagtttttaaaaaattgacctactactctgtaaaaaaaactcaatggacttttttctttttgaaccattttaatgcacccggagttttgtatgtctcagcaagaagagaacaaatctaccatctgaatagtcgatacatataacaacttaacaaacgatatgcataatttgcacactaatttgtacacctatggaaaaagcatttatcgataatccataaatgtttgaggtgattttccattcatgcatgcatccatgaatctcattgactaggcgtgaacagagaaaacatgtgcaatcaaaatctataaatgtaatggatacatgttctaagtgggttgatggtctaattaatgataggaaatgttaaataatatagctagggcacttgaccctgtttttcctatgctaacataatttgagcgcacacttttaaacaccttaatcggatatgatccatttgaatggttgtactctagctttacacttaaatcaggccaaccattagagaaccctcttaagcatatcatataatcctataaacaggatatttatatatgctgatcactatgttctatcggagtataaatagagcatgaaaattctaatttatatccatgaaacaggcattcgtttaggattaatgaaacagattttcatatgtaggctaataaagtttttccaatttttatctaatttcagttgctttttcatttacattattagttttagcactatttgatccactaaaaattattgtaacttatattttctctatagtaaattatttgtagctaaatttgaaaatatgattaagttatataactttcctgatattgaattatcgttccgaacaaagttatctgtagtttcatattgttatttatatgtttatatttccttcatcattttatgtccaactatataatatatgatttaggattttaatttatgtcaatgaatattatttagaacccgttacaacgcatgggtattattgattttttactagtaagaaaataaaataaaacccggaattttaaaaaagagttcaagtagaaatataatttaaaaacatgtaggattcaatgctcagagaatgtctgctactgctacccttgcccaacaactgttttcattcccagatttgttgctgttttacaagtatagtcaagaacctctccaacacctcgaaggatgttgtttggaaatcagacaatcttcaacttcaaggttaaccttcctagattaacttgggagaggagggatgggtgaaatattgttgacatcccattcttctgaataagtactatagtttttagaggatggaacagcagaaagcatatctattgcacttgtaactaatgtgaacgatcctgtaaagtgtaaatcatgtgttggtactgttatatctgccgctctaagtgaatctgattattcaatgggttttgtgtctgtaatttttgtatgtaaatcagtacagtagtaaagaaatcagtacagtagtaaagaagaaccgtatgagcgcaattggtcaacattcatgttcatttacattggtatatacggtagtaaagaagaaacatatgtgcacaacatcaggaaaaccaacaagactaagaggaaaactaaccagactaaggaaagattactgttgtgctgacgaaagaatcaacaaatttagactaagagaaactccgtagaacagaaggcacggaggaaatcctaatcggcaaaatgcgttattcacttgctcagactctgcccttcttgtgataatctcgggcctccccagctcttggccgccttgtgtgtcgtcgccctccactcgtcgtctcttttcttggcgatcaccggcggcgcaccgctgaccgtgctgcctgacgaatcaaagggctaagaaaggtccttaaaggtcgatcttgtagggatagctctaaaagatcattgtgtcagccctcgttggctaatgtttcttgtttttggttcttggacgagctcaccgccggctgccatgcccggggccccttacttgcggacgtctggctccctccttgcaccgtgatcgcctcctctctccctccttgcaccgtgatcgcctcccctctgtccctccgagccgggtcggttgctccctcgtccgcgagagtcaccggccttaactgtcgccggcaatggccactaccctttaactttttttttgctacgggcgctgcaaactattgctacagacgttgcgaactatcgccgccaacgagtgctttctacgctttctctctcgccactgccttcctctctcttttccaaaccgttacagaacttgtaacaagaagaggaagattgctctttttagctcctatcctgcttatttgcttctcttctgctattaaatgtaagagtcgttttttttctggaaggcccttatttttatacaaaactagaaaaaaaacaagtgtatgtattatttttaattcgtacattttgtatctactatttagagatgatctaaaacgcaaaatttattaagaaactaaaaaatcggcgtgccgttggcacccttgctagtcaatatatatacacacacacacttatcactcaaaaatactacatgataaaattgatgtgtttttttaatttaaaatatgtaaatacttattttattatttaaaattttagagttttcataaaatattttagaaagaaaattattaaccaatattttagttttgacaaatagatatatgatattaaaaaacatttatagatgcatgtataaatgatttatttattatatatagaagtgaaaaacatatttatcataaaaaatttagaatttgtatgacatgctaagcaaaagtaccaaatttaatgtgtcatttattacataaattttgatgaaatccaaacaagtaaaataaattttgagattcatcaaaattaattggttcaaatatattttctaatagatttgaatttttgaaagattaatcatttagtatatttagagttttttttaacatatcatgtgtaacaaaaaaaacacaatcattttattgactgaggaggtattgatgatcctattacgtgatataagaaaacaaggttgtcttctttctttgtttgttttggattttttttttctttccataataactttggatttactatatattctagagtagtaggagtagtaccgagtagtcgtaggatatttaaagaaggaaaatgaatgtaaatttgttgttttagattttttttcttaataattttaggtttactatatatattttagagttgtaggagtagtatcgagtagatgtggtatatttatagaaggcaaatgagtagaagttcatgtggttggaaatggaagatagttttggaagcctctagaatccatatgtgatatttttctctagatttttcctcacatatgattgttagatgttttttctctagtataaatttagatttttcttcaaagtaagaggtgccaagtggaccaatcaaaagctagcaaaagagtcaactttagattattagactagtccaatacttttttttataaacattagacctttcaaagtattattttgagtgaaatacccgtttgttccttaaagttgcatggtgatgtcacttacattcctgattttataaaatacttcctccgttccataattcttgatcttttcgataaggttgaggtcaatattttggaattttgactataaataactttgaaaatatttagtttgaaggcactaaaacaaaaatatatatgttagtcttaaaaggtactataataaaagtaaatatttatttatttattttatatattataatataaaactatagttaaatatatattctgaagaccatatcattgtccaaaacatcaagaattagagatctggagaaagtaagtccataatgttggttcaatatatgactgcaggtccaaatctcctttcgattgggtacgactgcctacgtggcgctccatgatggtacacattttgcatttgtccttctaggcaggagtatacgttgcaaaaaagtgtgggcagtgaacagcagcggtgaagccgatggagctatgtacataagagaatcccgtgccacgatgaggacctcaagctcagtcgtcagcggatcttgcaaccctgagctctagcactaccagatcaccgatgctagatcttgaggaaagcaggggaggacccttgacgtagacgcaaccagaacaatagcgcttgacagctagctctgcctctaagctttgatggggcggatccagggtaatgccgaggtcaccttcgcaccgcatgagccgatagccgtcaccagatgcaccacgcccgagcaccaggctcactggatgtggagcttgtgaccatcaatatcgcctttgcgccgcgcaccaccaccggatgtgtgcacggaggggagggtgcaccagtgaggaaggaggagaggaaggctgcgagatgcatggagggcagagcttcacaccagagaagctcatcacagccccatccctgagctctgcaccggccaccccatacattggtggtgacaggaccatctcatcacttgctcatccacagcacccaaccattgctgtcgtcgccaagcgtggacgtggtcagatccactgtcggtgttcactgcctacccttttgtgcaacttgttctcataccaagggggccgaatgcaaaatttaagccaacgtggagcatcacatcggcaatcgtacacggttaaaaggggttcggaccttgtatgatacccaatattattatctaaatatgcattttataagatcgtggatctaagtgacaccatcatgcaaccttaaggacatgccatgtattttactatattattttagtatattttcagctttatgttaattattgtcaaaatacgaatctaattatacaacttcatatgaaaaataaattatttttaaaaaatatatatcaaatcttagtattaaagctaaaactaaccattaattttgaatccattgtaatttttatggaactttagcatacctcctccgttttatattataaaatgtttcaatggttcttttaagttaaacttttataagtctaataaagtttatataaaaaatgtaataataatttcaatccaaagcaaacatgctatcaaaatatttaatgttggatttaattaaactaatttgatattgtaaatgttactaaacttttctataaatttgattaaactttaagaagtttgattaagaaaaaagtcagaacgaatgttgctaaagtgagttttgaaatatgaatgacttttgtcaatattttggcagtgtgatcagttattcaaattagaacttttgtttttgagatgtcatattggaactaagttaccagttaccacttatcagcaattgaccgagatattgtgtttgtttgcatcctccggactgataatacttgttgtttgagataagagtgaggtcaaactttatgatctttgattatgagccatttttaaaatatctgtctttcagatatggtgatacctgtataggttagtcttaaaaaatattttaataaaatatatatctattacttcctccgtttcacagtgtaagtcattctagcattttctatattcatatagatgttaatgaatctagatagatatatacgtctatattcattaacatcaatatgaatgtggaaaatgttggaacgatttacattatgaaacggaaggagtaatacttttatatatattataatagaaaataatggttaaagttattttttttataagaccgcatccttattaaaaagaccagtattatcaaatccagaggaagtagattaatgcgccgcttgcccccagaattaacgaattgggctttgaatctaggaggaaagggcctgcccgtctccgtcgaccaccacgcgcacctggttaatttggttcgccggcgccggcgtgccgcgaccccggccgcaacgccccgggcgccaattccgcccaccagatcacaggctgcgcaactggtgactccgccatcgcgcgcggacggggacggctgcggcaagaacgcaaaaggagaagcacggcgacagagaggagcaccgtcacacaatcggagtcggaggcaaagccaaacgaatccggatcggcgggcctttcttatacaatctctatataatttcacggggatttgcctgccggcatggcactcactacgatcacatcgcttcactgcgtagttggctagtagtccctccttctctaaatgtttaacatcgttgacttttttaaacatgtttgactgttcattttattaaaaacttttatgatatgtgtaaaactatatgtatacataaaagtatatttaacaataaatcaaatgatagaaaaagaattaataattacttaaattttttgaataagacgaacggtcaaacatttttaaaaaaatcaatagcgtcaaacattttaggatggagggagtattaatttgacaagggaacacaagctcgatctgctcagctagcgtcgactcgacgacgatggcgtcggtcgtggtgcgacctcccgtcggatctgttgggcctcgtcatcgcacgcctccccttccccgccgaaccgcgcgcgcctccgcgccgtgtgcaggccgtggcaatccgccgtccgcctccacgtcgcctccccgccgcagctcccgtggatcgctctctcccccaggccgcccgtcgccacacccacccacgccggcgagaacaacgttgttaacaccgtctgcgttggctccaccgacggatggcgcgccctgcaccacaccgccaccgccggcggcgggacgaaaaccaagaggcacacgttcttcttgcacaaccctttcaccaccaccaccgtcccgctcgccgagctagaggacgtcctcgacgacgctttcttaaagcagaacgaggtccgcaaggtgatcatccggtcctcctcctgctgccccgatggggaccacctcgtcgccatcatgaccgaccactataacttccctttgatcctgtgccggccagggaagggcacctggacgcccgactcatgcacgatgccattcgtccgcgtcatcgatattgccttcttcaaggacaagctctatctaattacaacagccgaggacctcttcgctgtcgacctcgccgccgatgaacacggcaagcccaccgtcaccaacgtcgagcgcatcatcagacaaccgagaagccccgatggcatgatcgacgcatttaggtggagtgacgacgaagacgacgacgacgacggcgacgcacgagaggatgacggtgacgcatcgtcgaccaatgacgacggggagtactcctccctcaatgatgagggggtagtagatggtgaggaccatgacgaggtattgaaccaagagggtggagacaacaacagcgacggcgacggcgaaattgagcccgtcactgatgacgatgacatcgacgacgttggccagcagtggtgccccacttgggagcatagaaagtttgagcaattctacgaggaggagtacgcgattgtcggcacctagcacctcttggagtcgtgtgaccggttgcacatggtgagacgggagtgggtactcccgttcatcttgcagaccgaccacacccgcaagctggacgccggaacatgggttccggtcaccggcggcctaggtggccaagcaatcttcctcagtgaactcttcagcaagtccgtgcctgcgcctgcacacggtgaggttgaaaaggacatggtttattttgttgatacatacgacgtgtgggacatgaaatccggcactaggaggccgtttaggtgagtcgataaggacatgacgcggcccacatgggtgtttcctcccaagttgatcgtgtaatgaatgtggaacaagggaaagaaatttaatggagagcaccacgcgtcggacgtacggcgtgagacaaaaaaatcggacgcctcgtgcgaccgtccgatccatgaacacgtgcgtcagccatccatcatgcatggatcaaacaaattttaaactacttttctcttaaaatatttatccaaatcatgatctgattgcaccattaaatccgttgcaattaaatctttaaaacaagaccacacatgaatataatccgatgaaaaaaaaatagcttattattgaattatttttaaatggtgcacgctgttgcgctaagtatatcggaattgtttcactgagtagatcgaaaatgttttatcagacgttgtttcgccttatatgaaaataatgtttcagcgaatagcgaaaggatgttttaattcactgtaacatttgattcatacatagtgaaacatcacgagtacattaggtgaaatatatttaaattgaaaaaaaatcggacggtaaaatgttgccgttgactaacaagtgaaatattatgttatatatttggtgaaacaaaaaaaattagcaactggaacatttaaatattttatgaaacatggtgaagatacacgttgaaacatgtcgctgtcacacatgaaacaacaagaattaacggattgaaacacatgtttttcttttatcaaaatataatcaagcgatatcttgttgtatagatttaattacaataaatacaatggtgtgatcggatcatagattggataggtaatttaagagaaaaatcattttgaagcttgctaaaatacatgcatgtatgcatgcatgaggtggagagagtgtcgtagaaggtagtttcaagaattttgtgaaacacacttaagacacatattgaaacatatcactattatgtatgaaacattttgttttaacggtttcaaacatatgtttttcttttgacataatataatcatgtgatatcttgttgtaaagatttaattgcaacgaatacaacggtgtgatcggttcgtagatcggataagtaatttaggagaaaaaatatttaaagagaggaggaaagaatgaaaagaaacaactagacatgtgcatgtatgttacactacgacaatggttcgtccaatccaccagacagctgatttgcagtattttcctgacgccaacagagagaaaggataaattagcaagtagggactgagctgaccttaggcgtccgatatttttcatctgatcggatgttcgaagagaagcatttttgaaatttaatccgtgtaaatgcttacacgatacatgatgaaagggggtagaattagatatttgctattatttattcaatagatggaaaatgctgggatcggcgccagatcacccctagaaaaatcgggcgcaggcctcccgggcctccgcaccgtccccaccacgcgcccaccacatgcgccattcaacaaattacccacatattatggaaatgctctactaaggaaatccatttcaatttttgttccactaacaatatttcagcaagtgtaatcgtgatgtttcactatgtatagatcaaatgttgcagtgaattgaaacccacatattatgcaaacgctctgttaagataatccgtttcaatttttgttccaccaataatgtttcagcaagtgtacttgtgatgtttcactatgtatagatcaaattaattaattgttatgcgtgtttgtaccatgtcgcatgtctgtccagatttatagtattagaatatgcgacgcatctaaaatcgggcgttcacgtcatcatgcatgcatacatgcaagcaaaactttctaagcgaagctatttttttctcttaaattatttatccaaatcatgatccgattgtaccattaaatccgttgtaattaaatctttaaaacaagaccacacatggatataatccgatgaaaaaaaatatttagcttatttttgaattatttttaaatgttgcacgttgttccaccaaatagatcggaattgtttcactaagtagattgaaaatgtttcaatcgtttaaaaagctgaaacacaaccaaatcacctcatgaaacattttgctacaacgtatgaaacaacggtttctcaaaaaatcgggtattgtttcaccttatataagaaaatgttttagcaaatagcgaaagaatgtttcaattcactgcagcatttgatctatacatatgaaatattacgagtatatttgctgaaacattgttggtataacaaaattgaaacggattccctaatagagcgtttccgtaatatgtgggggatttgttgcaacagagtgtgagtggtgaggacacgtgggaggcaggctgagacgcgcgtagggggagggcgccctttttttcgtggaggcacgtgtggggggagggcgttgtagcgtccgttccgtcgtggcgcctagcgggaaaactaaatcttaaaaaccctatttgcggaagtcgtttctttgcttgatgtctctgtgcgtgccaatctccatcttgaatcccctatccatcgtcaaattcaaattccaaatctcaaattcctcccaattcaaatccctctgtaaaagtctagtttgctctccctaaggtttggtgggc

SEQ ID NO: 70934 - DNA, 12644 bp, Oryza sativa
acttttgcgctgacattttttttttaccgaaacggatggcaggagctttggccattcatttcagatggactgggaataaaactgtaaacttttaacttttgtttgtctgtttcatgaaactgggaaatgcacatcttcatgcgaaattaagagaagaaaaaaaccggggcaagaaacaatggcacggcctggaactaatgctctgttgatctcaacactgtttgtagttcagcaatgtccaggagctaactaatccatgaaattattgttcacacgaacgctggtaattaatcagtagcgatctggtcgaagataaaaaaaaaaataacgatctggtcgccgccgccggcctttcctcacgccgccgcagacgctggttaatctttcccaaaacacatcaagaaataaacaggacggccccatcgcaatatatgtgcaattacggattacaccctctcttagtgttgaattacaagaatgccacaataatttttttcaaaattatccttctactacactactacagccctatactagatgtagtagtaacgaatttccacccttagatctcatctcctcagcggtatatatccatccaaaggtacactaaaaaaaatccttcgtctggattgctgtcaccaaaatctgtgaatcagtctaaaaagaagaaggaatcaaacggacgaaaaaactgttaattcgaaatggcccagttaaaatgaccaattgtatgggctagcatggcccagtgagttgacaacacccacgtatcatggtggcccatgatcatggtccacctcggtggtcctgttgtagcccagtaggtaactattatgtttcaaggaaaaagtctatactttatccttcagttatagtcggagtctgattttcattcctcgactgtaaaccgggtataacacattcctagtatcaatattgacttattttgcctccccgagaaattttgatggtggtttcacctgataaggcattctcttagaatggtttgcaatgtaaatatgtaatccattggatttcatgcaaaattctttataagtttatcccgaaaactttccagttcttctacgagacagactttactgaacttgaggcattcatatcattgccaatattagaagctacgttcaagatcaagacaatctttccactagttcgtctgcatcaaacggctcaatgcatgatgtgatccacagttgtcttgcatgtgcagtagatgtacagtataagagcatctccaacagcctctctaaatcgaactctccaaacacccatatagctaacttcccatcttatttagctagtcaaactagatactcacttcaactgactctctattaatcatcttcaaaataataacggacccacatgtcagcctatactcatattcttcttctctctctctccccttcttccttcccgttgccgacggcggccgcatgtggtggtgctgcgacacggggaggcgggcggctgcgcacggtggtgcggcgacacgaggaggcgggcggccgtgcgcggttgtgtggcgacgctgggaggcaagaggcgagacgccggcggctcgcgacaacgacccggggcgacactcgaggcatagctcggcgcggcggctcgtgacaacctcgacagcggatctagaggggggcggtgacggagctcggcggtggcggtggccggccgcgaagacgatggggtggcggtggccggccgcggcgacgacgggacggcggcgccctcgtcactccacatctgactccgacgatggaggccacaggtgcgtgccgcgtggagaaagagaggaaacaggcatgggtcccacatatggctagccggctttggctggccaactttggctagtctggtggggaatttatccagccggatggcttggagaggcatttggctagtttgttggagtagatttttttttgtgcaagttagccaaattttgacttggagagctatttgactaggctgttggagatgctctaacagacggtatgtgcctctttgatgccgtgcgttggggaaaaaaaaaagaagacgtcaacagttgtgaaacaggtgggcctgatatgcgcacatctttggtgggctagtgatgacatagaaccaggttactagtatcattttgttagcgctggaaacaaagaccggctcgtcaaaccttaactgtcgaagtgtcaaccgtcaacgtacgctgccggccgcctattcctctctgccgccctattccatgcatcgagcgttaaaccgttgcccctttcaatcaccagttcaccacccgcagatcgttcgatccccagcctccttagtccaacaacgcgcgccagtatcccctgaaaacaatagccgtgcaccccctgttccgcactaaaatcccacgcacaagtcgtcgcgggcgttctatacttctatccatatctcggtcgctacacgcgttacatccgtacgcttcatacatatactgctcctacctaagatcgatcgatcaatgcgcttctcaacaggtaatgggtgatcacgcaatggccaataatcacgagcacaaggtggaccacctcgaccagcccttctacggcccgcccgttctccctccggtcgagccgctgtccgccgccgccgcgcgccgccggtgcgtcgccgacccgtacgcgctctgctgcagggcgatccgcgtgctgacgatcgtggtcatcgccgtcggcgtggtggcgctggtgctctggctcgtgtccctgcccaacgccctcaaggcctacgtcgactccgccgagctcacccgcttcgagctcggcggcagcgacggcgccaagcggggccagctgctgcggtacaacctcaccgtggccgtgagcatccgcaacccgaaccgggaccaggccgtgctgtaccggcggctggaggcggtggtgctctacggcggcgagaggttcgggtacgtcgacttcccgcggacgcggcaggggcggaagagcacgatggtgatccggccgagcttcgtcgggcagggcgtcctcgccggcgcggcggcgttcggaagggagaaggaggaagggttcttcaacatcaacgtgaagctccacatgagggtgcgtctcaaggtgatggtcttcgtggacagcgtcgagtacaggccggacgtggactgctacatcagggtgcccgacccgagcaacgcgacggcggtggcgatggggttcacggcgacgcgctgccgtgtcgacgacttcatgtgatggactggaccctgaagggtgcagcattgcattgcacgtataggtgacttcagattgttcattgtgtatattatgatcttcgagacagcaaaaggaagtttttcttttcaaacgaattgaatcaaaaggaagtttgatcgtccatgacgaattaacgattgtgcaactttatttagtgttgtgtttaactgcagtatcaatgaatcaaatcttcggctaaatttcaacacttgtgcttgtgtgtcttcatggatagaggaggatgggagacagttttctttcctctgaagcagtcaagcttggctggctggtgcccttagtatctgacatttgtggggatcaatgccatgtttcaatgtgtaaccgttttatttctaggttattcctcttttaaaataatagaaggttttattaatcaacgaaaacatctaatctctgcagcaacaacaacaagtacgcaacactataaaagagagaaaactagacaacatgacatatcatgttgccttgtgacaccttactagggctgtcaaaaaagctagagactcgtgagctgctcgagctcggctcgagctcttaacaagccgagcccgagcctaacctcaagcttgtgagctttttcgagccgagctcaagcttttcacgaggctagatgtatatgtacttttattttttatatgacagactagtaggttaaaagataaattagtatacatttatttaaaaaattagtatgtgttggtattatatattaattttaagttatcttaatctttttatttagtattattaacttaaataattagtatttataatataatcaaaatatacattatcatatactcggtcgagctagcgagcctaaccgagctcgaagacggattaggctcgactcgagcttgtgtctagctcgagcctagaaagccaggctcgcttgtactcggctcattgacagccctacaccttaaaccaacaccttaacaagaaactgttatttgccccccatatcgtctaaaccaacttcaagtctgagagatttttatccagcgttaactccaacacaacacctacaataagcaagtcgacaaacaaacaccaacattatcggatcgagataggccaaattaaaatacgagtattagggctttcaccatatagagatcttgccaacagtaacaattgctccaatgccaccacgcccgcaaaaagagaaaagcaaccagaatagaactggtcatgactgattgtggccgttgaatcgttcttcccaaagacactagaggagaccacccacgttttcatttccgaattattgccatcaacctcagcaaattgaacaaccgtctaacgaaatgttgcctccaatgggacacctccgtcgagtggatggaaagggcttgatatcgaagacctaagacttcagtggactaatcatcactcatcacagattgctaattgttgaggaggtgtacagagaggaccaacgttgtctggcattggctagatccaatttctcatcgatttgccaagaggaggaaagaaagaaaaggataaaatcctcttggaaaccttggacgccttgcctcatcagagcaccattgcagtcctcagaagatttcctttgtttatggttgttacctctatacaaacaacaccactaaccggtcacctagccaatcacaattcgagggattgtagtcaccggataaagtacatctactcgcggtggatgtagttgaggtgccaaagagatctcggggccgccacaaccctgatggcggctccatgggatgatatgtatggaaaggcccaggggttcttaaaaaatgatatcatgttgctatgtaatattagagcttgtattctttgttagccgtgtttgtatcctttgacgcgaactatattttgatcgagttggatccttttttttcctaaggggtggatggaagtttgtgacccattgatggttaataatactagtaatcgaattagtacttctagaataggctgggcagtcaacttttgatgaatcctggcaatagaagaataaaattgggaagaatgaatacatgccaattttttgttgtttatggttgttacctgttccaacaactagatttagcatttacattatattgccccttatgagattaagaacatgtttgacatagctccagattccagatccacactagatgtggactttataagttaaattaaagtggttgaaaattgtatgtttcaaaatgattcattcaaatgttatcaatacaatcatagatctagatccatcgatttatgaagctagaaatacctagctacaagaaatcctggatttggagttatgccaaaccgggcctaagtgtgcaggatgatactaagtagtaaatagtacgatgatacgctgtgctcaatcctcagtgagattgtgtcactctatttgtactgaggaaacatctgcgacatgaaactggaaaaaaaataatacttcacaaactaatattgtgcctaagatggagaacaacttaaacaacaaataatctattcttcatctgttaatcagcatctgtattttgtatgattcgtatatcaagcctactttggagttccaatttgtttaagaatcgaaccagctattagcaactaacaacatgacaagtaaattttttttggtcgtttttctgaacgagcgaaaagtaaatctcaactttacaccgcgatggacatcgtctggagtgaccgggcgtctcttcggtccggcgacgccgccggtgagcagaacgccggcgtggtgatcggcgtcgtccccttctccgtcccctcgtctatcgtggacaggctcctggccgggcccccgaacatcttcttccacctctcgagctcgcactggtccggctcctggtcatcatcctctgcctcgccgggttggcgctcccgcgacggccaccgccggttcctctccaaggacggcctggccatgcgcagctgctggctctccttgtcattgaagcatatgccgaacaggacgaagccgcggctggacgcgacggactcgcggcgtcgccaccaccgccggacaagaacggccacgagtagagacaacagcgcgacgatgacgccggcggtgagcgcgagggcgagcaccatgcgggcgtcctcccccatctcttctcctcccctgtttctccagcaacgcgcggttgtttccgcggctactactccaagcgaggtttgtggaagctgcacgagaattggactatacgatggcaatgtccgatgaaccaggccagaagaaacgaagtctttgccggtcgttgtacagctaagctgctaatgacagtgaaaacgctaggtttatttgtgtccacgaaagaccggagctgcggtaaacggttcacctgctactcctactcgtccagttgcacattcgactgtgttgccggcggcttattctgttcgtcagaaaataacttgcgattttttttgaccggttcctacttcagataatttctggagtaactgaaacacccagttgattctttttgaaattgttgttttgctaaattttcttcagttctgaacttctgatttcagatgcaaccgcaacgttccgtccgtcaaccagcgcgcgggcgggagccgtcttgcaagacaggagtacttgtttgtactacctatacaaacgaattactactccactgaacctgcacggagagtacgttaaaacgtggaactcggagcaatttccagggctcattcattttagcagtcttcagattgaccacacatattcagtcaggcaggacgcaaaccgggatatccttctctgaaacaagccaaaagtggtcaaaacgaaagagatagcacgcgctttgtttagtacacgggcccaaaagcctaaacttttatttcgctaaaaaaacaaaaactggcccagaccgtaaattttgattttaatggaaggcctaagctgaagactattgtctcggtccatgacggccttgtttttcatgggccaatttaagccaatattaacgggcaggaaatttgaactaaattaggttgtagcaaatcgcaaatggcccacgcacaactggtacagttcgtacgtaccgcgtacatactctttttcttagcatgtgtttgttttgagagatttgttagattgggttgggtcgaactcattttcatggtggtttagttgtaagactagatgcgatggattgtcttcgaaggtaaatattctactgatatccagattcggctgacccatgaaaatctggcaccgcactgacccaactctcccgcacgggtcacatcaaacgcacatgtctcgccacagtatatatttatagaaatatatacaaaatagcatgatacgaagataccatatttatagatctagtacctacgggggtatcatatatgctatccgagacaacatatccgatacctatggtaacatgctgacgtcaacatgatatataagtaccagatcttacgggatataatgtgtagtactggaggtatcatattcgatacctacagtaccatgatgatgttagctatctcgttactatggtatatcattatgtagtctccgtcataactttaaccgtgcccatgcgagatgcctctgtgaccacgcggacaattttttattattttttgggaggggggagggagtaattaaaaccccttctcttttctagggttatccattaatcttattcaaaattgcttttggttgagcttgatgctaaagtagttttggatcgttgaactctctctttctaaaattcctctcatgctatgcaaattgaatcttatagttgtggatttggagtttgggacctaatgtgtgttacactcaatcttcaggattagggtttgtgcaagggttgtgtggtgtttgttacttttgaaggttgaagactccgatggttaggcgttgctcccgagtcaccgatctacctgtgattgatggagggaagattgtgaagaccggatctcatccctgtaagaaaagagatacctctagtgatttaggatgaatgtatttatgcaacatcactataatagagttgaaaaagactcagctctattcaacaccacgtagactctgaaaagggaaaaaagaagggttcctgagtacaccagcacatagtgtcgcatatattagtgcactgcccattgcgagtcgagaatgaaatttgcccttgacttatccttaattacttcctccatctcactcgctaaagagtgattaaacttgctacagttttcaaaactaatttttaactttagatttctcgtatattataatgtctgtaacaacgaaatcataataatataaaattaaatgtaaataacaatccattgatattattttcatcaaataaaatttattctatagtaaaatatttactgattaaatatttaaagagttggattttaaaatgtgtgtgcgttttagtgagtgggatgaaggccttgtttagttcccataacataaacttttcgtctatcacatcgaatgtttagacatatgcatggagtattaaatgtggacaaaaaaaccaattatatagtttacgtgtaaattaattgtgagacgaatcttttaagcctaattgtaccatgatttgacaatgtggtgttacagtaaacatttgctaatgacggattaattaggcttaataaatttggttcggtaattttctaacagaatctgtaattcgttttattattagaccacgtgtaatattttaaatgtgtatccctatatccgatgtgacactagaaaataaaaatttttgccatctaaaccgggccgaattacctaccacaacgcagttaaacaaaccttcaaaaccatttaagtcttcgagctgaaacgtctgaaacctgtgtaccactagcattgcaccactagtccactagtagtccacaggtcgaactgcagatagacacgcaattgaattgaatgctgcacacacttgacatttcaaaatggcgcgaaagattaactacacccttcctagtgtagggtgtacagctaattaaaaacctgatccctatgacgagacgatctgagtattgaattctctccctgcttggtcagtgcattgggatcgattagacaggtcttaaaacctcaacagctagcagatggatgcatgggctaaaccaatttgctagccagaccagctaagctagcccatgcaatgtgtgtgtagttacagcaccctgttccccgctgtttcgtttgaaacacacccgtcatcgagctccgcgagcgacctagccgacagctccttaaattaaccacacgctcgagatcaccgtgcgattccgatgcagtactgacaaatgaatggagccttctattctattctccctctgaacttccaattcatgcagcatcggctgacgatttagagcttcgggaagatgcatatgcagtgatatggatttgactgctcgcaaatgccgtgtttatgccatgacccgatttgtggaagtactactagtacatatcagtacattggttgagttaaactaatccctaattcagatttgcacagttagctggcaaattcttctggatccaggaatgattagcgattcccttgcagcagcagcagctggccagggcggtaccgaatcttagcgcatgcatgtggccatgattaggttattggtgcccaaggtttttacctctcagcatcaaaaggaagttagaaatgcacatggaaaaaaaggcgatcggagtgaacaatccaaggtagctacactggtgaaacttatgttctgtccaaggttgctgctgcgtgcagctagctttttcttcctttcggccatggaaaggaggacacaaaatggtgagctcactgtgctgcactgcagtggacgccgcgaggcgcgtgcacatgtacgtttccggcaagtctagctatgtataggcgactatgtatgcggcagagatgagagtagctaggccgcactccatgcatgatctaagagcgtgcagttctattggacataatttccctcgaagtgcccagctgtgcctgtgagatgtgcacctcatcaatgttgtagattgtgttcgagatctatctccctttctctcatttatatgcagagatgcatgcaagtgctgctggacatgaacactccagcaaatcgccgttgatatacacatcaaaaacgagttctgcaagtgcctgacatgatgaggcaccgctagctcatcaagctttctctgaactctgaagataagttcacatgaatggaaagggaggaaatctatcccagagaagtggacaggcatgaagggaaatgtaccccatacagatgtaaatccatacgaagcagagtagatttatatgctgtgctgctgtacacagtacaagcatctgtactacagagtactaatggttttggtgcagtccatctacgtgctgtttcttcattttgctgaacagtgaacacatgatgtatagcagtgggtatgatacagttatgtcatatctattagaggatcttggacgcgattttcgccatcgttcatttgttcttgcagtcttgcacagttgcacctgctcttgcttaggaccccttaaatcgcagggtagaaaaatagaggaatagaaaaaacacaggattccgacagaaattgaagtgtaaaacagaggattacaaaacacagaaaaaacacaggaatggtcgtttgattggagcacaggaaaaacgcaggaatcgaatgagagagatagactcaaaggaaattttccaagaggttggagctcttgctaaatttcctctaaaatccacattcaatgtgccattccataggaatttcataggatttggaaagcttcaatcctttgaataaaagggccaaataggaatattttcctataggatttgaatcctatgaaattcctacatagatcttttgattcaaaggggcccttagagtttttaccagtctctctctctctctctctctctctctctctctctccttcctgattatcctacttaatttttgcaaaagaactactactgtaattctggttttgtcctgtagcagcaccattacatttactagtagtttttattcagtgagtgcaaagaaggaatcgatgaatactcctatataacagccaaatgcggctaaagattattttacatagattaaacaccattagaaccataggcttattttaaaggaacgttttttaagccaagtggtaagatagaaaacaaccaaaagatttgcttcaacagagaaagctagcatgagctgagccagcagcatggccagcttgtcctcacatgaacagttagtcaaccccaacaggggactcccgtcctattacgaaccgtggcaaagaaaaaaaatatactccatccacacaccacaccatctcaatatatcatcagtcatcttctccctctcccctacggtgtacactccagctcagaatttactgcacaaaaattaaccacctcgtgcagtcacaccagccatatatgcatgcatgctatgcttacagggcttacatctgcaactctcccctctgacatgatccccccagggatccaatctgaacatctttgcacccatgcatgaagccatgaaatgccatgaaaaccattcacccatacaccccccacacacacatactccgtataactagtagcagtgtgtagcactgagccgcactggactgtgctgtacatgttgttcacatatctttctcaggtttctgctttcctcttgcactgtccgagcttattttacccacacacttgcccttacacctctaattatccgcttcacatgctcgctctcttctcccttctcactgttcatgtcgctctatctttactcgccatttaatcgttgcctcgcgctctcacatggcgccccattaatatatagcaccactagctagctcctcttccagctccaagctccaagaactcaactcactctctccgagcttagctctcactgtctcgccgcgcacacgtcgctctcactggcttagctgagctgagctgcattggcttctgcagtgagtgcaggagtgcaaggctattgagcttagaggtacaccagtggcattgtccatgtcgggcaggtcgtcaaggaggggcagcttctcgctgcggcagccgccggtggtggacatcggctgcaactgccgccggccgaagctgttctccatcttctcctcgtcgtcgtcctcgtcgttccgccgcggcggtagcaagcccaagtcgcccaacgcctcctccacgaagacgaccacggtgttcacggccacgacaaggggcgccggcacggccacctccaccgactcctcg

SEQ ID NO: 70935 - DNA, 3985 bp, Oryza sativa
atactaccgttgaggaaattataggacaagtcaatggcggttatttgccctagttgaccaatattctctcttattgaaccagttagtaaattatgtgatagattaaggagagtgctaaggctgttgagtgaaaagatggaagcagggatgccccccttcagactgttgcttgatatgtccagtgaaagcacatgttggaggttaccaatctctactgggatttcaccaactaactcattatggttcatctcgagcctcgttagttgtgcaagatccccaatttctgctggaattatgcctgacagtttgttcctagcaaggcttagcatggtcagctctttcaatagtccgatttctggtgggatacttccaaaaagtaggttgtagctcatattgagcaaagtcagggaagataaacgcccaatggaagctggtatgtacccagttattctgttgccaccaacatatagccttgtgagagaacttgacaagttgccaatggaatcagggagtataccctcaatgagattctcatcaaaggcaatcagctgtagcttagtgcagttcataaggtcaacaaggacacttgtgttaccaacaatttgattgaatccaatattatacaagacaagattgtgaagaccgctaagtcccggcggcacagagccgctaaagtgattgtgggacatccttatactttggatgtttgtcacgttatggagagatggtgggattggaccagtgaacctattgatgcaaatatggaaaacaaggagccgtgggagtcgaaacccaacatcacttggtatcttcccatgtaggtcattatttgcaattgcaaagaaagaaagggaagagagattgtaaagtggctcaggaactgtgcctttcaggttatttatcgagagctggaggtacttgagctgtcttagatgaccaaactcgtaaggaattgtgccggtcaggttgttggtgctaagatcaagtgtgctcaacaacgagaggttaccaatatatcgcggaacactaccacttagttggttccctccaatcttcaggactcggagtttctgaaacgagctaatgcttgcaggtatagtaccaaagaaggtattctgtgacaaatcaatgatctcaagatttgtgcagtttattagagctgcagggatattgcccgtgagaatgttagcactagcatttagtgtttgaagctgtcctagccaaccaatttggtcaggtatttcaccagaaaactggttcttttgtaaatataaaccatgaagggctgatagattgccaatgctagggctaatcttgccaaccaaattgaggccctggagatctaacaccaagactctaccatgacgattgcatcggaccccactccatgtgcaagcggagccattaccccaagataatagcatgcctgatggatcactggtgaccagagatttgagaccaaggagggcctcttgatccatattatcggctggaactgactgagcagaaactaccaggaacagagaggatgacatgagtaagagtactaactgatggacgatgccaatccttatcttgatttggagatgcttacacagcaaggttgcccacatcttgattcgggtctgcacacataagaagatcgcaggttgcagacatgtggatatccagaacaagaattgacaaaaggaaagctggatcatcacaaatgtttgagtatatagaaaatacatacctggtccagtcgtgatgaaagaaacctataagaatcgcatacttaactatatactaccacagctcagggattttatacaatggcaacttgagctagcgatccatgccgtcttgttaagtagcatgacaagtgacaactcttagagccggataatctggacttcgtcactgtactctctcattcttgcaggggaggctgttcctaatgtcaacagaagaaaataaagataagacttttgatcccatacatagcagccttagaaattctggtcaccagagaggacgtcactgttttcctgtataagaaagttggtaatgagatgatcttggccattggaattaacttttccaccaaattgtacgcgaaaacaaagataagacttttgatccatatatagcagccttagaaattctggtcaccgtagaggacggcactgttttcctgtataagaaaattggtaatgagatggtcttggccattggaattcactgttccaccaaattgtacgcagcatattgaattgtatatgatatgcaagtctgagatgcaaaagaacagtacaggaataaaataaaagaaggtactttatgataggcaaaatacacagcactgtactttagttgacaattatatcacagtttgcagaattaggcaatcatatatctaaatattattaaggatgggaaagtaaatttaccaaagaaactatgcttccattaaagggggcaaagaagaaaatatcaatacatcctcaatttgcaatacatatttgggcttattatgatagggtggggttagattcattatcttcagctgacagaaaagaaattgaagtcaatttcttttgaaatcctgcctatccaagccaatcatggttgaggaaaatgggaacttattcaattggacgctttcttctttagcttcacagtttctttgaactatttgctgtactatggagtatatataggataaggaaaaaaaaaactcaattttcatcttcaaacttccacaaaagtacggacaccatttattcttcaatttttcaatcctctctcactctttcctctctttgtgttcttcctggcttcttcctccactctcactctcccccattctcaccccgtttccaaccccgcaagaagaagaagaaataaacctttgctgtcaactggcaagaccatcgtcattggcttgcccccaccaatcatggcctcctcaatctgcacaatgacgggcatttaactcacctacgcggcgaagggcgagggctacagcagatagatcagcgacagcagtcccctcgctgggccacactggaactggaagaggaatttcccgccagctgcaggcggcacgcgaggggggcgtcgacctcggcgaaggggacggactacaggagtcatatggcaacggcggagtccaggcctagccagcatgagtccacggccgcgtcggtcatcgctctagtccccaaccacctcggctgcagtacgagtgtgagaatggtgaaccgagagaggggaggtgggggcggaggcggcgctgcgagaagatgaggtggcgggggaaaaaaatgaaaggtcaaaatgggaagaacggtcaatttcagttggtcatgtgttcgatcaggcctcctccgtattttaatttacggcaccgtctgaattacccctaaaccacaaaactgaaaattcttcacccttaactatgcaaaccggacgaattactccccttgacctaatccacggtggtttttgtctacgtgacgtacgcgttgcggtccagtcagcattttatttattaaaaatatgtagggcccacctgtcatactcctattcctctctctcttctctcactctctgtctcacacgcgcacggcagcagaggaggcggcgaacgggggatgaggcggtgagcggcggcgggctgcggcggcggcggaggaggcgagtggcggcgggagctcccgctgctcgaggcgaggcaaggcggcggcggcggaggaggaggcgagtggcgccggggtgcggcggcagcggaggaggcgagcgacggcgggagctcgcgctgctcgaggtgaggcaaggcggcggcggcggaggaggcaaggcggttggggggagggggcgacggatgacggcgcgcggcgcggcggggttgagatgccgcggaccgaatgccggcggtggtactcgccatcgcagccgacgatgcagcgggacctccaggtgtggaacccgtcatcctcct

SEQ ID NO: 70936 - DNA, 3799 bp, Oryza sativa
agctccgtccgagatggaagggggaagccgtgccgagctccgtccgcccacacgcctccgagagggagggggaagccgcgccgagctcctcatccccacccctccccccccccggtcgccgccaccacgtcacgcgccgccgctccgtgtcctccaccgccgctgacccgtgagacggtgagagagagaggaagattgacagagagaagtgagagagagaacagagagtagtgtatgacatgtgggtcccacaattttttataaatagaatgctgactagactgccacgtgtacgccacgtaaaccaaaaccaccgcagattgggttgaggggggtaattcgtccggtattcatagttcggggtgaagaatgcccggttttgtggttcccgggggggtgggtaattcggacgaccgcgatagttcgggggggtaactcgtactttttcctaaaataaatgataattacataagttttttgaataagacgaatggtcaaacgttgtataaaaagttaacggcgtcatacattaaaatacggaggtagtatgatttaattggagtaaattacactagcttacctcaaacttataataagctttcacttaggtccacgaacttgtaaaacacacatcgagatctctaaacttagtttaatgtatcatccaggtccatagcctcgatggcatggaattttttttatttcttctcccttcttccttctttttttctccacttcacctcctttctctcccttctaccgctgacaggtggggcccacctgtcactctgtcagcccgcgcgaggctggcaagggggcagagaggccggcggcagcaacgacgtcgtcgataggaaggaggaggaggggaaggggaaggcccctgctccggccggccgcgggcacgcgcggcaagcagatgcggcagctgctcaagttcgacgagctcgcctactctctcacgaagctcatcgtcgggttctgccactgtcgccgtcgagctcgcgccgctgaccttgagctcgccctgccaccctgctgctgctgtcgagctcgcacccaccccgctgacgctgagctcgcagacgcctaccccgcacgcgcggcggcggtcggctacccactgccaccgtcaagctagcgcccagcccgctcgcgccgagctcactgacacctcccccctgccccggacgcgcggccgcagtcggccacccctcccctcaggcgcggctggcgacacctccccctacgcgtgcctcgacccaacgaactgtgccgccgccctcttcacccctgaaccactccggtggtggccctcacatggccgccggcagccgcttctccctctcctccccctcggccttcacccacggatcctctcctcccgccagccggcgccgacgcgctgctcctttctcgctggtcgttgcccgcgcacgcgctccgttcctctcctcccgccggcaggtgcccgagcacgcacactgaccgttgcaggaaacctcgtccaccacgcgagatgaggaagatgagaaaatatggggagaaaaaaaaagggaaaaagaaagttttgccatgtcatcatccatgtggcatgccacataggcaagaacacggtcaaaagaggctttggaccaggataatacattaaagcatgtttagggagctcggtgtgcgttttgcaagttcgtggacctaagtgaaacttcgttacaagtttaaggaccgctagtgtaattttatcatttaattggtatagagatatgactgaaaacgaatcagacacgaatctaatatattatatattaaggtgcaatccttttgcgcttaagattcggacacaaatgaagaatttctcgatcacatgttttagcacaaatgtttgtgtgttgcaataggtaaagatgttttttcagagatataatagttagaaggcaagcaaccattaggaccgctatataaattataattgaaaaagttaataaatatctttccttgatttttggctgaaaagtctttcgttccttccttttcagtgttagtccagttcgatacctcgatggcctagctagctctcctagccgactaccgtcttcaacctcacgaagagtctcgtacacgtatgatgccggagccgaccctcccaatcaaatctagctgaacctttttcgatctctcaaaatgtagacacttatcactactacaccctacgtcacgccaccggatccgcgcggggggtggccgccgccaccggatccacgcagggggcggccgccaccaccggcgcgccgccggatccgcgcgtggggtggctgccgatggatctgctgcagccgtcgcgtgccacctcatcgtcgtcgccgctatcgccgtagaggaggaaggccggggcgggcggcggccgccagatcagagcgggggagggcggcggtggccagatcgacccggcgcctcctcgtcatcggcccaccgcccccgctcgcggtgaaagaaaaagagggggagaggaagagagaaatgagagagagagagagaggggaacgggagcaatcgaggagggggatgggagagggagtagtgggcgcgcggattaaatggtggatgggtattttcatgtacggaccaattaacacgtctgcatgcaaaaataaggctatttttgcttgtggacgtgttaagtggcccgtgttggcggctgttaaatgtcgattctataccgccaacatctgcataaagttcggataataaaatatccaacatagtgataggtgcttaaatctaacatattccacagtgttggtgtatatttatatgcaggtgataaaccccgatgttgggaggaaatctagactaaagtgaggagaattctgtatccatacaaggatgggttgtgaacttcatcaaaacgtcagtaaatcagcccaaaataccaagaaatggataaaggaggatcaggggaggagatgggccgaagaccaggccagatgggcccagcccaggttcggccgaaccaaaatctcagccgttcaggctggggtttggcgtggacgctccaaaccatggcggttggagggcacttcggacatttccccttcaccaaccgtcatacctactcctatataaagacatcactccctcacttcacacacacttccaagcttaagctgaattataaaaggctctattgtactatattgtatactagaataggaagagagtagagtagaaggagtcgggagaattccggagttgtcggtaatcttctcctatttcttttattatgtttattactctgaatttaatataatattcttcttgagtaatttagatttatcttgtgagaattatctcttggttagttcctaaatagcatacatgattattgttcactataatcaactaaaatatagtgattgctttggtgagttataaacactaaaatagatattaattgcttagacgtagtgtttaggtaattgttaccagtaattgctgcgtatcccacagtacgtttgaggtaggtgtagaggtggtgacagccctcgagatcacttaagtcctccctgtccgggtatgtagtagagcgacatctagaaatagcaggttgccagtgcctgaagtattgcattaggattaaagttaagctttccctagacactgtttctcactattaaatcctctctatcctggcctatcttttgcttggtgtccttggatgaactggtggaagatttgaccacacatgttcccttggattcgatatccctggaatactccgtagggaaagtgctacatcggg

SEQ ID NO: 70937 - DNA, 1914 bp, Oryza sativa
gccatgtctctctctcgttctctcgctctccctctccccgcctccatccccgtcgagctccccgcccgcgattttcgaatcctccgcgcatcgttgtttcgcgcgcgcgcgcccacgtggtgccgcggtcgtcgccgtcgcctgccgcccgtgccgcgcctgcgccgcctggcccctcgcccctgccacactgcgccacctgcgccgcgccctgccccgcgagccagcgcacatgcccgagccgcgccacccgcatccgtccaaaacctggaggcagagctcccgctcccatccctctccctccccaactcggcaaagtttgagccctctttctcccccctctgtttcccgctttcctctttcggcccggcctctgccctccctccgcttggagctagcgccatggaagaggagcgcctggcgccggtgccagcccgttgcccgcgtttgaccgcgcccgtgagcacccgttccttcccctcgaagctccatcctgcgcctataagagtcgccctacccctctctcatttggttccattcactcgagctcgccgcgccattgccgctcccttgccctgttttgctgtcgccgtccgttgccgagtgtgccggaggagtaggcgcgttcgtggacacgtgacgtggactccaggcgctcgtcttcctcctcttccccggcccgaggccgaaatgatcacgtttcgcgccgtcggctctcgtcactgcgcccttcaccgtcgcggtagtgcatctccccattccccttcctcgttcctcctcctcccccagctttcggcagtagcatgtgtagacctcttgtagctagctggcgccgccccgaccgctgccgctgtttgttgtgtgctcgccgccgtcgtcgcccgagttcagtagacgcctctcgtcgccggccttcctcggtgtgtttcctcctaatccgacgctaggaatggtttcccggagtcgcgtagatgctctagtgcgtaggaatcgatcccccgtcgcgtcgtcgccgtttccctctcatctcgccgccggtggctgccgccgcaatccgccgccgtcgagccccctccggcaaatccgagctgttggctcgtctcccctcgtcccatgaaacctcccggtgtgcttgcccttgcctgcgtcgctgcgcttcgccccgaacgccgccgctaccgtccgccgtccgttcacggccgcgtcgtcgtcttcctcccgccggcccgcgtggcagccacgtaggcgccacgtcggcgccagctcggccggaccgggtcaagccgaccccggtcagccgctccctccgtccccgctcgcgtgtgcgcggcccacggagagccgagaggctatgcgtgggcccgccgcgcgcgtacactgcgcccctcttccaaaccctagcgtcgcgtcgcgtgcttcctcggcacggtgagccgagccgccgacaagcgggtcccactcgggaccgcgcgaggtggacccggcccaacggctccccctccctctctcccccgcgcgtgcctttgggccgccttcaagggccggccagcccattagctcggccgagccgcgccccttctctcgggtcgcgccctagctgcccgagggaagtctaatacccctccctcctccctttctttttcaaaaaggatttaattaaatccttttccctttagacaaaaatccaataatcgtagaaattcaatatcttctcaaccgtacatccgtttgactccgttcaacttccaaaaatttctcaaatctcgagatctatctaatggcatgcttagaggtcaataatagggctttattttcgccgtttgttgagttgtcccatttcgcgtgtagttttggagcctgaagacccgcagtgcgaggatttcgagtatcaagctcaagatgggctgcaggaat

SEQ ID NO: 70938 - DNA, 5825 bp, Oryza sativa
tttgtctagttatacacttgctggatttattacattagttgatcatggaaattttacatgcatcctactccctccgtcccatagtataagggatattgagtttttatttgtattgtttgaccactcgtcttattcaaaaaatttgtgcaaatataaaaactaaaaagttgtgcttaaagtattttggataataaagtaagttacggaaaaataaataataattctaatttttcttaataagacgagtggtcaaacaatacaagaaaaactcaaaatcacttatattatgggacggagggagtacgtatttattcaacatttcacgagtatgaatacaggtggcagtgttgtttcttctttctaaaaaaaataatacagacatatgttcatacacactcgcacaaacttataaatgcacatgcttatagcctacttttatgagcacattctaatattgggttagcatatattaagttcgatgaagttatcaccagcgtctttactgttgatgtgtgcgtcgtccacatctaaaaactaattaaagtaaatgcaagataaattttgctacatgagattgacttcggggttttagctgtagaacaccgtacaaatgaacctttggagaaagtcactcttgaaaattggatatttgttgataaacaccgtacatattaaaatatttatttccgattgaataggacatagaaatcgtgtgataagttagaaatatccttgggcccacatttcagctctcccatctctcttctctcctctctatcccttcgtcctctcccaatgatcactgccactaccttgtcatccctatccaaggcagcctccttgtatctctctgcccgtcaacctacgcggatccccttcctatgtagactgccactgtccaaagaccatcaacatccccgagaacctcctggccccctccccgtccaaatcgacgcctcccaatgaccaatgccaccaccctatcatctccatctcctctctctctctctctagatctggtgcttaggaaagctcatgtcatcatggactcctcgaccgccgccgcggcatgtggagggagaaggagaggtggtgccgtatcaacaacagtagtagtttcagggccggtcttggggttttggggccctagggcaaaaacttataaacacgtagcatttaatattcgatgtgataaaattatccatatataacattttaaaacttcaaagagaaataaatatcagtagtgagcagaaagacgaccgacggatgatcgacacgagcgtggctactggcgagccgtgatttgctgacttgatgtttccgtttacgagacgccgagaagtcgagaagtcgtcgagagcgcaggagtagcgagcggcgtgacgtgatcgagacggcacaacgcgagtggtgtgatgtgatcaaggcgaagtgacgtaagtcaaatgaagatcgcttcagcttcgctgaaacaggcttgacgatggactaaaatttattttctgtattaggctattcaattgtctaacttaatatagacccatggcccatgaactagaattatacaatacgtagtatatatactatatgtgtataggggccccctagattttgaggggcctcgggcggccgcacggcctgaacccccccccccagggctggccttgagtagcttgaaatgtggctttgctcggggcccaacgtggcttgtgtggtcggcaagcatggtgtcgcatgatcgttagtgtggtgaagggtgaccgatagcgtggtgagggaggagaggggatatagtgaaagagagatgggatagctgacacgtcagcctaagggtatttatgacatttcacattatttctctcttctattcaactgaaaataaatattttaatgggtgtgatgtttagcagtaaatatccaacttttgatagtgttttccccaaaggttcacttaagcgatgtcctatagctaaaaatgcaaatgccatgtaataaattaagtttacctaaattcaaacacccatgctaaatcaaatcttgaacttgaatgtgggtgggcaagtttcacctggaagaaacctagccatctacacttaattcacatttgcgtaatattgctagttgacttagcctcttcatacattttcagactatgtttacggcggtcgctactactatcagtgttatcatcaatgcataaaatgacgaacatctgatttggtagtaatgattatttcaatacccctattaataaattcatatgaatagaccaggatcagaccagagagataactcaaaataaattaactcctgctaactttcttctaatatatatatatatatatatatatatatatatgaattgagtttggcctagttcaagacataacattttagcacatgattaattgagtattaattattacaaattttaaaataagtttttttaaaaaaacttttacataatatttttttttgaaaaaacacaacagttaaccgtttgaaaatggggttaaatcgagcattggagaacgtttatagacatgccaacagggtttacatgtacggtaaccttatctgtttttgaaaccacgatatacctcgtggtaatcgcgcggttatcatgggtggcggtaaccccacccaaaatagtttggtgaattctgcatgtcagtgtgacacgaacgccacacgctcgtactgcgttgaaccaacggcagaaaagtttttaggtagcccagtaagggcatctacaaccaaagacactctatggggcattataaccaaagacactctatgggtgccctcactaaccgaagccactccgtgggacacctatctcccaatgaagcatactcgtacctgggttcttcaaaatctcaagcaaccaggtgaaggtactccaacccaatgggtaatcccaacccataaagctacaagtgttgtttttctcttttacccctctcttcaaactaaggaatttgaagacacgaagcattcagaatacatgaatatattcaacacaggaattttcaatcaagggtaacctcatatattataatccaattaagcaatagaatactatatattttctatctcactactctcaagtactactctctgctccctccgtcccataaaaaaccaacttaatattggatgtgacacatcctagtactacgaatctggatatacatatatccagattcatcgtactagaatatgtcacatccgatcctagattcgttttttatggacggagggagtagacaggaaagccttatcttatcctcctcattcatcgggtcattcaccgtatcatgtcccccccccccccaaaatcttccagaggcatcgagagcagcaaaccatcaaaatcaacagggatggctgagcgagcttgcgcgcgcggccgagctgggtaccgggcggagaaagcgaggcggcagtcagccgacgagctcgcatgggcgcacggtaggagcgagctgccaccatggccagcacaagctcgagctgcggggtttgcgactttgccccaccgcgccaccgccgattctgccacacagcgccgctcgtgagctccctccgctctctctccctctctctctctctcccgtcgcctctctctcgctgctgcccgtcgtcgccgccgacggagagcaggcgctgccggcagctggaggcgacagtccagcgccgtcgtgcgctgatctggccccctcgcggccagatcggatggaggggcgccggtgaaggttgtcgcgtaggtcgtcgccggcatcgtctccgccgctcgtctccctctccctctcgccgccgacgcttacctttctcccgccgctcgtcaatctctctccctctctctctcccgtcgcaagcggccgtgagggcgatgaggagggtcgccgccgccgccggagccatgccgttgctggtggaaggggacgagggtggaaggagaaaaaccggaggacagagcggtgtccttgggctactcccccacccaacgcgcctcctctatcaatctcccaatccaggcactcgtagagccgcgcccctctactaggggcgcgcgcttttgctggggccaggggcggagctaggtgtatcaagggggtgcccaggaacccggttcagaaatttttttagctatagtttatcaattttcaccatatatacacctcctcgattcaaacttaggcacccgtatcaagctaaactcaatctaaaatagactaaaatatatgagtggaaccccctcaatttcgttctacctccgcccctggctggggcacggcacggcgtgaaaaagggacgaggacggacgacgtgagccagggacacggcctggagagccgcgttgaacatgccctaactgtaaatacacatgacgatacagcgccccggaggaggagcagcaacacgagtacagtaaaaacgcgcatgtgcattgtgcacgcgagggggcgtggcggcgacgcacgggtacggtgcgtgcgggctccaccgcggcagcgacgggtcggaacctgacaacatgtgtgttgccccggaccacgcgcgacccccccttccaaacccgtcgcgtcaccctttttcccccggcctgtcggtgggacccacctgggcatcgcattgatcgatccttttttttttcttcttcccctacgacgtcgctcgcccaagtggaaagccgaggaaaccttgtcggtcacgagccccttttttacatgtttggactctgtaggctgtcggctgtgtagcagtagcttctttccgccgcgtatcgtatcgatgtccgaaagaacatcgaacggacgttttcagtgaacaaatcgatcgaatgctacgcctactcctagccgaatactccctccgcccaaaaaaaaaaaaaaaagaaaaccattcctatcatcgcaagataaatttagtgaggagtgaaaatgaccaaaatgacctttatcattgaaaaaagtagtaatggtaattggtagataaagggtatctaaggaataaaacatctcattttatatattgaagataggtaggataatagaagttgattttgtgtggaagaaaatttaaactctataagttaagttttttttttaaacggagagagtaggggtgtgtttagttcacgctaaaattgaaagtttgattgaaattggaacgatgtgatggaaaagttggaaatttatatgtgtaggaaagttttgatgtaatagaaaaattaaaagtttgaagaaaaagttagaaactgaaccaggcttaaaagtgcatatgtacgcaccaaaaccgagccagccgtccaagccttattacagtcgtaacaggtcaaattgtttttaaagtcgtaccccctctcctaaaaacccaaaggaaaaacgtttgaattatacccttagtctactgagtaagtacgaattataccctatacctaaaaatcagacatatttcattcttaattattacttaacaccagacaaattaccttctaatttaaataggagtggttttaattctacgtgacagtgtagtaaaaaaatataaaaacttagtactcgatcttgtctagattctaacatctaaacaaagaaatatttttgtgtacactgttaatgaaatatctgacatttggaatgtaatccctccgttcaaaaataagtgcagtcatctcgttcaaatttaaactagaggactatatttattttgggacgaagagagtataaacttttgcatgaaaatcaaataaaactccttgctcggtagcttattttcaccttattcatgggatccttaccgctgataatttgctc

SEQ ID NO: 70939 - DNA, 19201 bp, Oryza sativa
tactgacacctctctctccatcacggcatttgcatcgccagatggctatacaacagatcaaacaggtcatgcggatctgtaaccctggccacagcaacaaccgcaattcatgagcacttaatcgttttctctaggcactatgtggcattcatcgtcactttaattgccgtgaggttaccagctgatcttttaggaggagggatttaaggagttgttggagcttcactgcatgaacttggcttgcgactactaggatgccaggtttgcatcttcgattctgcatgccaggcgaactgtgcttgtgctgccttgcgctgccgacgcccacgctttgaatgcaacccgtagcatctctgcctcctctgtttttagccttagcccaatgcttctctagtaggcgtactatttgatcagtgatcttcagaattcagatgcgtgcggagagtgaggaggaagaagatggcgcgataatctgaagtgacgtagtaatcaatgtatttactcactgtttgtcagaacacgattactctgtctgtagatgcaggctgtattgaagcgaatttatctgcaagtgtgctgctatctattcggccatgtttcaattcatggtggtgtcgacatcgtaggtaaagccgtagtaatagtcgagtatagtaccgctactaatactccaaacttccagttggcaaaattgttaggcagaggacatgacttaattccgtgtgcagcagacgtggagcaacgcaacctggtaacagcctgcgaagttcgccgcatctggcgagcagagctgttgcttcttcggaaccgatcgatcgatcgatcgttgtagcagcagcaagcaacgcattcaagcgacaagggttggcaagcgagagagagagagaaagagagagaccgcgcgcggtttaatcgcctgacaccaatccggccatgcgcgccccctccccgctcggcgtcgctgcacaactgtctccaattactcgtgcatttatacggcttaaaagcgaattaatcggcaataggtctccctttgaatgatcctaaccaccgagcatctttccagttctccctcacgtcgcgtcacaggagaaaagattgcgcttccgctaatctgagaactttggtttttgtaggcaggagcagtggatcgatgattgcgtgttccttgttccaagcaggttgtgtttggcaaacaattgattactcagatgatatttgtgttaatctctgagtacatgacaactggcaaactcacaaaagtagtaacaaaatgtcacctgaactagaagtaaactgaacaatttcaggaggagtgaaagttaagaatgtttttctcagacacttgtagaaagctaacaacaaaaattttcattgtctaaccatctaaattaatcaaattatgatttacgaaaagaaatggaactgtctgaaagactgaaatgatattcgtatgaaccatgattgcgataggctttcatgctctcacctcctagtctccactagagttgtactcctgcattatctcgaagcacttccagtgataagtaacaacgtcactgaaatcgttctttaaaattggacaaaatcactatgttgataagcatacaatcacttctcccaccacaaatctgtgtctgccgatgccaaaaaaaaaaaagaaagaaagaagaaaaagggtgggcaacagaactcatgccatgtcacatgtttcatgcaaaagtgcaagatgagctatcacatgctagaatatatgatccccaccaatccatcccagaattttctgaactaaacgacaatagtaagaaaaataatacaaacagacttatttcctaccttttctgttttttctaattgaattacctgtccggccttgttttaattatgtccaagactctaagaccagagtctattaacatagtgcacggtgaatcgcgcgcctcaagcaatatgagcaaatatctgctttaaaatactgcttgttgttactttaagttgcttggtttcattaaaactctgacagttcatcaatggtactccctccgtttcacaatgtaagtcattctagcatctctcacattcatattgatgttaatgaatctatatagatatatatgtctagattcattaacatcaatataaacatgagagatgttagaatggcttacattatgaaacggatgaagtactaattattttgacaactgggaaattggcatgtaagtgtttttcttacattatattgtttcactgataagtggtctctcactaacatggatggcatccacatgtaatgtactaatgtggcaatcctgaagtgaaccttttcaggtcatcaagggtgacaaaccctcaatttattttctcattttttaggtcatttgggttatctttcagatggatgtatgccttattttagtttctatacaacaacttgcagttaaaagaaaaagatatatttcttatctaagaacagttcccttcggttggaaattcagtttccggctctgtaattttagtacaactgtgtacaaatgcacatgtattcaatcaatcacattacacattgctgcaacatatttatgtaccattcagtaccacagaaaagggtcaatactatatgacaggacaagagcattacttccattaaatgatttaaatgttgatgacatgataaacttaaagtctttgcactgttgcacgtagctctcagctgaacactagaacaggaaatactactgaaacgcgaaattattacctagaccaattccgtttgacagggtgcaccgcacgcaagaaacaggtctatgaaataattcctttcgggatccacgtaaactctgatcgatcatgaatgatggtaattaaattaaagctacgacggcgacggtgacgacgaagaagaactaaacgcaagaactgagcccccggctgttgcaccagctagctagcctcgccgatcggatcaccggcgttggcgcgggcggcgctggtcgtcgtcgttgaagtcgagcagcacggcgctgtggcaccgggggcaccggggatcctcccgggacagcatcacgtacatcatgcaccgggggcacccagccagcaccatgggcggccccgcgccgccgcccgccgcgtccgggctgccctccgacgacacgcacgagctcggcggcgacgcggtggacgacgacgaggacgacagcctgcgcggcgacgtgttcgcgccgttgacgccgccgctgtcgccgcccgggcgcacagtcgccgacggcccgccgccgccgccgccacgcgccctcgacaggctcatcagcctcaggcactccagcttggaactcttgccgttgttcctgctcatcctcgccgcctccaccaacaccacctccgatcactgcactcagctacgccaacaacattagcgagacagcacaagttcacaacacacacgacctagctaagctagccactatccaacaatatgacctagctagctagtgacacattgcactaaacttgttctgaagaaaaattcagtcacattgcactagaccaaatgcattacctcggattctaatatagggagcagttcgacgtgttggtggattggagctctccacttggttgcatatagcttttgctaggtaggagtatttgtcatgcaccactcctgttgttatataatggggaggggttgaggaggaggtgggttttcttaaaggcaagaacagccacatttaaacgctggtcaattccctccaagcctctggagtctggacgctgtcccgccatacttgtattttccattaatattgtagcttttctggagggtggaaaaatattggagtatatttattaattaattggtggatagacgtgacaaggagcaggtgtttctgtagatcgaaagggaagcacttgtacgggggtatgttaatgagctagctggaggttccttaatgcatggcctctgtaacaacatgaagtactaccattcatgtaacaagatgatcgtaaaatctatcatgtaatatacatgagcggggtattagtgtagaagtactccctccgtaattataaaggaagtcgtttaggacaatgtttaagtcaaaccttgggaatataaataatgaataactctcaaattgttgagtttaaaaatgtaaaaattatatgaatagatttgtcttgaagaatactttcataaaagtatatatatcacttttcaataaatattttatagaaacaagaagtcaaagttgtgttttgaagaccgtgtcgttgtccaaaacgacttcttttacgaatacggagggagtacacatttgactaaacatttttcttaataaattaggggctcatgacatctctcacactcttggcgcagctataaaatattcattctttgattaactccatggtcagataggattcacccttcaaatttttaaaccgagtacgatgtactcctctgtcattttggccatgtttttttatcacctaaagttgaagggtgagttaaaacattgggcaaaatgacagaagtactaatggggccagcactattcgtctatcttattagcatctcgctgtatgagaagagggcctaactgctagttgaatcctatatgcttcatggaaaataattgtgtgcaatccagatcacaaaagatcggtcaaaccagcggaggaaataattccatcttactagtgcattcctctagatcatttgaccggaaggaaggcatgcatcccctaatcccctaattatgagggtgtttattggcttttcaccgtactttttggttcgtaccatccaaaatagcctctgcgaaagtacagtttcaaaaaatcccgatccatgcatgattatgccatcatgcgcagatcattgcagatcatatgcgacccattagtaaaagttcagagactggcctgaaattaactgtagctgccggcctgcctgccgccgaggtcactgcgcctgcctagcgtgcgtgtccagccccaagggcgcgcagtcgcgacatcaatggcattatggccctgactccgcttattacgagttacgacacggcgtaagcacaaagctagtcaggcgacgaatgaagaagctctcgcgcgagacggcgatagagagagacgtgtggtatagctggcatccatccatatctcctcccctcgcggaggcggggcggggcggggcgggcgcaaccgcggcatgtgccgggcctttatgcttcgccagagccctccaaatagaaccgggatgaatgacgatgatgaggcgtcttgatgatgtgaaaaaaaaaaagtttccggacgtccaaagtaagtgcaattgcaagcgcgacgcacagttaatctgctcacaggcgtggtgcatttaggcacacagcttgctaatgaatgaaaccgcgagtaaattagctacagtatacgtgcaggcgtgcagtgaatgagggggctggctggctgcacggttcgcagatcatcgtgaacggcttcacgcaatttgggcctacgaggaattctttttagttgggcctcagttttggggaaaagatttggcccacgatgaactcgctggagagtcctggagaaaataaggggaatttttccgaaaaggaaaggtaaagaacgagaggtgaggcgcatggaggaggagggagagaaagtagtggcctgggcgtgcgacgcggagggggcgggcgatggagagcggcgcgaacgcacggcggcggcggcggctggtggataggggatccgatcgcctcgccttcatcaccggccaagctcagagcctcccctccgatccgtccccaggtaaccacaggaaagcctgctcttcctctgatgaacaaacctcaaaatctcaaatcgcctgctcttatatgggtcttgtgaaagatgttgcttccgcatccagatttgattcgcgggattactgtggttgtgatagggttagtattaagttcttcactagggaactatgcgtgcgttgcctggatgcgcgcaactattaggaggattgctgcacatgttatgtacagatctccaattaggtgatagatttgaattttatttttgcgaggcagaaagccaggaactgcctacattgcagcgctcgttctgcgacttgtaagttaattagtccctctagcccctaatataagtaattttgatattttgcttacactatttgatcattcgtcttattcaaaaaaatttaaaattattatttattttcttcgtgacttactttattatccaaagtactttaagcacaactttttgtttttttatatttgcacaaatttttgaataagacgagtggtcaaacagtacaagcaaaatgtcaaaatcccttatattataggacggagggagtagtttgttgatttactatgttgagaaaaaggagggatagaaacatgaaatagtttattagtttgttgtcaggagtaaattcttgtcctattaatgaaacaggatgtaccttgtaggatagtacataattaggtgctaggaagtgtgctagctgggtattttctttatctacaacgttttttttgcctaatactccagaacacagagttgtatttgtatacggcgaagacctatgcaagcaacgtttataccaaattaaccccttgtcgggctgcctcctgggctctccctccacactaacataaagtattcctagacctttttttggagagattgaagatgaaggcaaaaagactttgatacccctcattaaatgatggatggttggctgtgggtggatgattgggggaaatttcaaatgcttggaacccttatatttgtggacagagggagtagtaagtactcaagtgtagtttgattaattgaaccactgtctggagtgtacaaatttcagaggaaataacatttttgagacaggaatccttcatactcattgagttgcaactaagggagtccaatgtaacatctctttccacttacctactttgtaggttccttagaaaattgtcacaatgaggcatgataagtagtaagtttgtaaactttggagatatttagcatcatgagttttcttggtacttctcgggctctgtctggtattgcacttagggcatgttctaaacagatgttagaaacggatgattagtcacgcgcaaaacgagattgtgattagcatatgactgattgacataagaaaaacattttttaaaaaaaggcaacttctatatagaaaactttcgtacgggacacatcatttagcagtttgaaaagcgtgctaacagaaaacgaggaagtggccaagctgatccccactttagaacaggcccttagttgtgataatggaactgataatccagtccactaagtttcacaaaaagataatccaatccacacagatgataagaataaaatattgttctcaaagaaaatgtagcaaaatttgactgttggaaaaattccacagctgcctgtgttgctttgatgaaaagcacacacattgcagtaccataatcacaagctgaacttttattatgcagatttccttagtattgtcatttttcctactctatattgatatcaagcataatgctgtccatctattattgcctaacaactagttcatcacttatggactattgataattaaatcgtcctagacttctatttgcatatcttagtagcttacacttggtttaagtgatattcttgtcatttttgttttcacagttgtacttgaaagttaaaacatatagcttcttaaatgccacatcttaacagaattagttgctattttgcagattcaccactttatactgttgatgctgcttcccttcagcgatctgaacgtcagctaaatgaagttggcattggtgatgacatattcaactacataactcagttgcaaaaatcagaatctggtgttcaaccgactagtgaggcccacctggaaactcataaagagaaacaccaaggtaatgaaagtgacctccaaaagctcaagacaagcaatgtggttcctgaaattcagccagtaaatgaaaaggcatttcaaaggcacagtgaggaaaccctcaggaagaagaacagtcatgacagatcggcaagtacacagcctatgagggaaatggaaacaagatccagatatgtgcctccaaatcagtctaatcaatctgatagtgcaggttggtctgtggaaactctgaaggaaatcctgaatttcgcaccacatgagattacccaggccatatcagctacagagtataaccgatttttggcttccgtcatcattggttttctggtggttctttcaaattgggggctggacgttggtggcactatcaccaaagtattagttgctacaaggccaattctatttcttattgtaacgaacataaccattgtcttcactttgttgatggagaacaaggaccccaacgtgaggggtagaccagctggcagcaaccttggttctgctgataacttaggccaaatgctagagattgggttgctgctacagaaagccctgagcaccctcctgatagactgcagcgtttgcgctgtcatcatgatctgttttatttgattttgaggggtaccattgacagtattttacggaattgcttgtaagaacgccaggtaccattctgtctatcgttcgaatttggagccctttttgctttatgtatttatctactgttttctgcatatatgaatatgtataaaccttgtccaagagaacggacgcgtgacagagtgaggttggtatcagtctatcagaggaccaaatttctctgtagctaaggatctgataatttgatatgctgatgaatatgggaaattttccctgtaccttaatcatgccctgataagcatgcaactcgacttggcagtgcaggctacacacgcagatcacgcatggtctgcagaaatggatagctagacgttgcacagtttgatagctagacgatggtagggacttttggagtttagttgtgtgatgaggtgtgacctctgaactacattggtcttaaaatataatgcattttaatcatatggttatatgggtaaaatcctaataatataaatctggagatatatctcgtgtttatcacccggattgttcttgagttgttgttcctaatacttgggttgttcaaaattactgtattttagaacggaggaaatggtggtaaacactgtttggagttttgtgtggtgtgatacataggcagatcacgcatggtccgcataaatggatagctagacattgcacagttggatagctagaagatggtaaggacttttggagtttgtgaggtgtgacctctgtacgacggtgcgttagcgacaaaagagaagcccgcgtttgtttgcactgccaagtgtcgcgcacttatcaaccacgtgccgcccaaaccctcggaacggtgccgcactgccgccaactacgtggcgatatccagatgttcccagcagtgcatgcttatcacaacacagcaccgtaatgactatgtaaaatgatttcgacagcatcattcatcaaaacaaaagcacaaaacccatattaacagtgacatcttcgtctgcatcaaccaaacctagacacgacgttgccacgtcaaaccccattagtccttgacttagctaatcctaattaatgctgaaaaacctaaagcccaaaccgtgtgccgaccggagctctcaacagcctctgtttccggcaagtaggccgtccacggttatggatcagagagccccaagtgacaaacggtttgacagtactacttgcctatgttgtggtgtaggatataatgtacacgtcatcgcctaccccttgcttgtttcacttaatccaaagagttgcaaagaaagggggtgggtcgccgtcgccgacgctggtcaaggggtggtgatgtcatggatgctcttgcgcttggagtcgcgggcgccggcgttggcctgccggatgaagtacttctgcgcgtggctcgccacctgcgtcggcgtccgcgtcctcaccgagaaccgcgagatgttcctccagtctccccgcccgtacctgtccaacccctcgagaaacaacctgcacacacacgcatggtggagcaaaacgaagtgaatttacacgggaaaggcggttgcgattgagggggggtggctggcaggtgggggccatctgccagctgggaagagtttgttggtttctctcggctttgacgaagcaatgcggaaaagatcgcgagaaaaatcgagaagcctctggaacagagacgagcaggggaggaggagggaagggaaggagacgagggtttgaggtgtgcttccgtccgtacctgtgctcgtcttcggaccagggtacgccgcggcgccgctcctcgccgcggggcttgccgccgccgccgcggcggtcgttgccgtcgttatcgtcccaggacccgggggcgtcgacggcgccgcgcatgatgagatcgatgtcggcgacgagcacctggtagtgctccaaggcctcctgcggcgtgcgccctgggagctgcgccgcgacgagcgcccaccggtcggggacgtcctccgggcacagcaccagcgcgctctcgaacaccttgtcctccaccttgctccacggtcgcctcgccaccggtcccccgcccgccgccgcgccgtacaaatccatgccgagtgagtctcccctcctttcctccaagcctctcggtcccttcccgtggacgacacaaacacggacgatcgcggtgcgaagtgtggtacgctactgctgctacgagcgacgatgatggcgttgcgtgtgccggtgggtgtgtggatgggtgggcggcgccgtgtgttgttgggcttggttcgctgcggctacgcgtgggaaacggaatttataaagatttcgcttgggggtggggacggcgcgggtgaggtggatgacggggtgagctcgagagaatggaacggtgggttgggaatcccgtgggggttttttgtgatgctctggccgcgtggacgcacacgttttgggcgtgcggtcgggtgcgagtcggcggggccatgggccatcggggcatatcctttgtgcgcgcacgggcggcgccagggtcggtggacgcgtgcgcggagggccgaacggccgtcggctggcagaggcggtggcgtagcgcgcggacggggttgctttccgctggattctgggattctcgttgagttcgtttgggcacggagcgtcttacggtgggttgttgttttgtttcattctgtttttgaggtgtcacagtactcgtttggaccaacggaattgatattctaccgtcgcaggaaaattgaaggggaaagtttcgagtcgtcgtatccggtttgagattcgtgcacgcaataggtttaaaaaccaagcgcaagaacagggccggacattgcttggtggtacatcatgatttttattttactaggaaaatacccgtgcgttacaccgggtaatatcgcagttgatgaagttgaacttgacgatgtacctggtgttgtgattaacaaaaaaaattatttaaaataggtatttttatcatttttatcgtaataccgatgaataatcaggatggataaaaatacttttgggtatttatttatagcctcgtagtggtcacgcgtgttttctcgctttgtcaactctcgtgttgcaagcatgcgtcttagtttccaagatcatatgtggactcgcgtggagaccggtcacgtaacatatgatgattttgcgcaatttttttcacaatcgatattttttatatcaaacaattgttttttccttccttcgttttttttattttccggtttttcatacttttttatcatcttcttttctccgttttctccgtaagatgaagatgaagattaagtttttttatgcaaaacgaggtggtattaatgtatgattgattgagttttaattataacaaacttgaaaaatacattaatatgatattttagagaaacttttatataaaaagtttttgcttgaaacgcaccgtttagcaatttaaaaagcgtgccacgaaaattttaatcttcatcaacacttgttggagaaaagaacgagacctaaattattctgattttagataattacataattaaaaacagaataaagattagcgaggagataaatttgtgtggtatgtcgacatccttatcctatcactccctcactctatcgttctctctcccattttgtctgtcgcagtgtcgtgtccctctctctctcgtagaggtggccaaacgggccgggccaaaacgggcggcccgaggcacggcggaacctgtagccggcacggcctgctacagtaacgggccgtgccggcacggcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggtcaggacggcacggcccgtttcatgagccgtgcctaacgggccgtgccgaaacgggccgtgccggacccgtgcccgtgccgtgccgggccgggccgcccgtttggccacctctactctctcgttactctccaagcagttcctctattgttctctctcccattctgtctctcactctctctcaatctctcgttactcaccaagggtccaaggtgaccgacagtggtgctcgcttggatcccgcggttctgccgtcgacggcgacgggccggtcagatccaccaccggcccaagccgtggttgctgcttcctcgcgtcgatccagccaccaccatgttcatctccatcgttggctggcggcggtgaggctggtgagcggcggttccggcggttgggaggctcgagggcggcgacgaggctggtgggcggtggattcggcgtagggaggcgaggcagtggactcccgtagccggcggttgcccagcggaggtggtggcggcggcggccgcgccctcccctccgctagatctggcaggaggggaggcagcgggctctcgcggccggcgcctacccggcggaggcggtagcggcgccggcggctgggccctcgatgggcggcgggttcccataggcggtggtgtcactttctccatgtttctcctcctcgtgctcaaatgctctcgatggatccgtcgccttcctccttctgctacttccttcctttcgttctttcctctcggttttctctcctctccttcgccactcagcgacgccctccttctccgccgatccccctcctcgaccacccaccgacggcgcctctccctctcctccgctccccttcctcgtccccccaccgagcccgccggcgacggatccaattcccccgagctcgctggcgatggatcggccttcgccgttgggtggcattcgtcatcgtaggatcgagctgccacaatggtccagttcggtgccgagcagattggggcggtctcgtcctttaggcggaggaagcggtcggagacgaggaggccgattgagtcgtggatgcaggatcctgtgggtttttcttgtctcgtaatgtcctccatgatcactatttggtctgattggtactccctcgtatgacgccgttgactttttgacaaacgtttgacctttcgtcttattcaaaaaatttatgtaattataatttattttattgtgatttgatttatcatcaaatgttctcatgacataagtatttttatatttgcacaaaaattttgaataagacgagtggtcaaatgatgattaaaaagttaacggcgtcataagtatttgttttgttggatgtctcaggatatggtgcagtggacgaatctggaggtggagttgtacaagcagagctgttcggtagtccggataggagggttcaaattgtcggacgaaggtggacctctatggattttccaacaaggatgctgctgtggccgccggatccagtgacaattgactcccccgcagtagaggtgcttgaactggtgagtttttttaagttgatttgagttttcactattttttttgtcataataattagatcagaccctagtttatttgatttgtttggtttgagtagatcaaccaagagcacatgtgtaggtggagtagtgtaacaatattgattaaaaacttgtcttgttactctatattggttgaatgcccgatgctttcatgtgatattttttgttgaaataggaaacaatggcatttcagcacatagagacaaatacatcttaactaatcaaagatgagattcagatctgtaattttcatcagtttcaggacacatgcagtatttgacactgtctaattctatgtcttccaactgacaccaaaacttttcttgcgggtcacaaatctaggttcactaaacccaaaggcttttgtagcaatgggatgccaggtgctagtggttacttgagcagctatgggggtgatggtgggtatggcagtacaccaggagcccaggaagaaaatatatggtcaataggtaagatatatggtaagttcaatccccacaccacctctaatcgttgcgcaatattgctggttatagattgattggtttatgactggtactatatcaaatatattactgtctttgatatgttatctctgtaggaatcagattactgtcatggttcttatattgtgcacttccacttactgctagctagcttgtatcctgtatattttagttagtcaagtaatagtagcatgaaaacaccaaaacattatatgtctaatctgaacaatcattttgagtagcctaattgattgcaagctcttgtgatgattttgctgtgtgcatgatttatgttctgcattcatgtgaatgtctgaattgaaggactcgtctggaacttccacgttgctacgtgccgctgaacaactgaaaaaattggttgttgctaacttgaaaaaattgactgttgctaactgttctacatcgacgggaaaaaaaccatacatagcattggttgtgcatatgaaaggctcagctaaacattctcttctgaaaacaaggctcatgtatgtctggttgacctctttaatttatgtataaaaacttcatgtatgtctggttgacctcttttattttatgatggtactgttagttcgaattcataagctgacttatcttatgaaattaaaattgtattcaggattgagttggttgataacctagaatcgacattgattggagattgcttgacgtcctagaggaagagccttgcgattaatattttcttgtgtgcttctattatttctatagcctgattgaaaggtggcttgatgtcctagaggaagagccttgtgatatatgttttcttgtctgcttctattatttatacttctacattatattgcctgtaatgtaatgtaatattaaattggagtaggaatcggtgtgggggatactgaacctgtgcgcgcaaactggattagaatcggtgttgtttttttttaaacttgggcttgcgggcttaatctggtagactggagtaggaatcggtatgggattttttttttgcgtgatttgctctagagtaggaatcggtggtgttcttatttttttgatggggtgggaaaagtagtgtcatattagattagatccgatcacaaatcggataacagaaatcgcagttgtgggggctgcggtggaaaaaacggaaaacacggacaaaaaaaagggttacggacgaaaaaaggggtttcggactaaaaaccgcgtggggtgaagatgtgacgaaaggaaaaatccaaatcttttaattattattaagatagggtactcttttttgttccaaaaaattaaacttgtgatataatgtgatctaacctaatacaacgaatctattcatattcaaattcgttatactaggttatatcatattgtatcataggttgagttattttagaatagtgaagtaatttatccgacctgtatatgcattgactggaaaagatgtcagttgttgtaacaaaggctgccaaatatgtctgttatatagttattacaatgtaatttaaaatgttattataattatattatatattttttaaggaaaagttacgataactatactttagatagtactctcccaaagtaaagctgtcgtcattcgtgggcaaagcatcgacccactgcatttgagcccgatacaggcattagcccatggaccgtatatacggcctgaatagctttcaccgggagcccaccatagcagcagcaaatattttctggacggttgacaagtgggcggcattttgtttccggtgggcggcttttggggattccggtagcgccgattccgccgacatccgatgcgggaccggcggggatacagaccgccatatgccgcggtacagcagccaaatgcacagcgcactccgactgaaaccgcggtgtttcccctggctttcctcccgccttttgcggattcgtctcaccgaaccgtgcaatgcgatgagcagcggcactgctgtgttcctggagcgtcctgttcttcccatcagcactcatcccgtctttaaagatttgatccagtcttatcctaaattagttggcaccccggcgtcttgccgcggcttcgtagttttattgtcaaacaaaaacaaaatcgtagttttattgtcaaacaaaaacaaaatcgtagttttaaatggttagatacaactctatatataaacaaaaacaaaatatatgataatatgtctttatatatatacattatgttactataatacaattcatgttttattttttcaaacgtcattgtatattgttataatatatgaatattattttcatgcacaatatgggtaccgttgtagttagacgatttgcatatctctgcttaattcaagctttttctaaaaattgatttaggtaacgatacctaataattatatactatctaatcatacataataaaacaaaacgcacaccttaaacaataatttgagttgtattcagaaaacatggtgttatgcacaaaataatataacagtgctatgtgtgactatgaggtggagcaaagggatgtgattgaataactaataaatgattgaattagatgaataggtagtttcttgatccaatggttgttatctttgtagacttgtagtaatgtattctgatggcttaaaattgttgatgatgtggcttcttgcttgtcttgctttataggagtaaatgctccttagtgagtactaactatatagtactccctccgtcccaaaatacagcagtctcatgtccagattcgttggcttaggatgggtctcatccaatactaagttgctatattttgggatggatggagtatgataggatatgaaacatttatacgattataattacccgataagattcttatttgaagaaaaaatgaatgttaattagagtacaatgttgttttttttcctgaatatgatctacccaaaaaactcttcttctgcacataatttgtatttgatgcactaaccaagtcgagttgtctatgaaagaatgatcggctacatgtagggttaagattggtttcagcaatggatcatggatgtttttttttaatttactagaaaaatgctcgtgcgttgcaacaggtaaatgctattttaattttattattgttatatggtttagctaagaaaaaattcattctgcgaattcccttggataattttttcataaaatcataagctgctattatgagtgtatttcatctcaagttagcatgcgagttttttttaaagagatttcttatacgattcctcttgtatttccaaaagaaaatgagcttaaaatctaactcaaagatggatatatatttttaaaagtgaacgaatttaaaaccgactcaaatatggatgacgtatcaaaataccaataaaaacatcttcgatttttataatagtaaagatttcattcaatatgttgatgtgaccatcaagtatatgcatacaaccaagcatgagaaatataaaatattgccaaagaatacatcggataaatggaggatctacaggatattaaagtccaatgagttttggaatccagttcggcctccggagacagcactgatttcaaacggacctagcgccttcatgccaactccgatttgggtgatcttggacttcgtggaaagcttatctcgctacctttcaaatgcatccagtctcacgtccaaattcatctcgagtctacgggaatcgccaaaacaagacagtactgttgctgaaaccgaacttaggccttagaccttgtaatagactaggcccatctcggaagtgtctccctccacctccacgaattagcacttaaccctagctttattttccgctataaatagctttgtacattctcaaaaacatttgggttttgtttagttgaattttgccaagtgccattcaccttgtctctagtcctcgctcgattagtcggcgactattgattcagagcccccaatagttggtgtgttgatttgccgggtcgattagatctaccacttcaatcgcaactatttctttgtgcttaatcacctattcgcaatatttagattgcatcttatcttgttcttgcagtgttctctcgtttgcattgcaggaatcatcaaccgcgcgtcacggttggtacgacatcgtttgtggtgtagcgattgcacggcgttctggacttgttctggttggtagccacgtcgcaaacgtcgcactcgatcaaagtgagagttatcccctcaccagaagatcgggccacgagagagagcatcatcagttggtatcagagcttcagttgcctggtgaggattttagttttgtaattttttcccatcatccactatacagccgcaccactttttcctttaccaaacattagttttgagccttgtaattttcattcaattttgctttattgagt

SEQ ID NO: 70940 - DNA, 11206 bp, Oryza sativa
aataccagtacaaattgatcaagataaggtttgaatatacgattcattaaatccataaaagctgccggtgcattaatcaaaccaaatggcattactagatattcatagtgtccatagcgtgcatggaaagcagtcttgggtatatcactaggtttaatctttagttgatggtagcctgattgaagatcaatttttgagaaaacccgctctccttgtagttgatcaaatagatcatctatccttggtaagggatatttgtttttgatagtcaccttattcagttctcggtaatccgtgcataatctcagacttccatcctttttcttgacaaatagaacaggagcaccccacggggagacactgggacgaatgaatcctttatcttctaattcttttagttgtacctttagttcctttagctcaacaggggccattctgtagggtgccttgtaaatcggagtagttcctggtactatttcaataccaaattcaatctctcgatctggtgataatcctggtaattcagctggaaaaacatatggaaactcattcacaattggcattccttcccaacttgcttcctttctcatgatttctgccactaaagatcttgataaattgttttgatctccatggtaagtaatttagttttgatcccatggtttaagtgaaatttgtttttcatggcaatcaatatttgctttgttcttgcataaccaatccataccaagtataatatcaaaatcatgcatacccaagggtatgaggtcagcagctaattcccatccatcaatagtaattggacacgatttacaaattaaattagttgtttggctatccaaaggagtttctatgcagatcctttcttttaactgactagtagggatggtgtattttctcacaaagttggtggagataaacgaatgtattgcgccataatcaaataaaactttaccagggataagagcagattaagacattacctgtaaccacggtgttggattcttcagctgtgctcttagttaagttgtatacctgagcacgattcccaccttgtgaattattcgaccgtattcctcatgtagtattagtatttgcaagtggctttccttgatttggcccatgattatttgctgaagatggtccaggtaaataaagcgagggtactggagtcaatactttagtatttggctgagtagttgaactaactcgatttttacccttctgtaacagaggacaaaggtacctaatatgtcctgcttctccacattcaaagcacctccagcgataggacaaattgatggaacatggctacttggcatatgggacattttctgccttgattttctaaagattccctctgcatttgtccagaatagttttcacggaatcttccctgattttgttgattattagtcttaaacttcttttgaggttgtccgtgttctattctttgttcatgatacccctcctcaagaagttgtgctttacttactacctccctgaatatggttaattcaaaggcttcgacacgccttttgagcggttgacgtaatccactttcaaatcgtcgagctttagagccatccgtctgtacaaattcaggagccaatcttgcaagtcttgaaaattctatttcatattctgctacagatttattacattgcttaagctctagaaattccttctccttcattctcttcacactttctggaaaatatttcttgcaaaaagcttatttgaataattcccatgtaatagagatacgttcggaatatgactttttgtgagcatcccaccattcaaaagcactagattgaagcatataggtagcatatataatcttttctttatctgtacaacccatagcttcaaatgccttttccatggctacaatccaatcttccgctttgggtggattggcagttcctgaaaatgttggtggcttcaatttctgaaattccccaagtccattccggttagcatcacttttagtaatacattctaaaagctccatagcccaagggtcttgattgcttgcactaggtataattattccagtggcaccattactagtattatttccatactgactagtaccattgctgttgttgttttgctccatctatcatattcaactcattagccagaatacataaatgatcattggatggatctcaaaatggtaagaaaaatcagatttactatatgaatgtgagaaatactaaaatgacttacattgtcaaacggagggagtaatcaatataggtaatattaaaataaaaccatttagttatattatcaccattatgcttttctcttcttattttagtcttatcatcattcttaacatgcaccaatttaaaaataataaaaattagtacaaaccacaagcaccacagcactactgcattacttcaacgcattacttcaacgaaaagaaagtgcaggagcctatcctgctacacaaacactaaggcaaacacttactggtatactattgccacatacagagctctggtttttacataagagatgtctagaaagacatcaccatgagttctgatgttaactcctcagttctaaaagctcctttggttgtctcgtagcccatccacacatgctactgatgctacaagacttattatagtggagtacatcccatcccaagggaaaacaaaacccatacttacaccactcctacatctcacacactgccactagagctgtcactacccccacccctacgctgcagaaaagtagtggtttcactcaggtagcagacgcggtggtacaggcgatgggtgaggcactccagaaacataacttcattctcactggagcgaacaatagtcaacagttctgcatagagcttctcagcctccacccctaccacgcaagcacgccacctgatgacgcagatgctgcacctgagggtaattgacatcctggcgctctgccgctaaggcgtgtatagccatgagtgaagtagtttgctcagcttcagctactgtggtcttagctgcctcataataaaggtagggaacacgatcagctggaccaaggttaacctgcacccccacaatatgcagtccagtggaactatgcctcccagtaatagtcggtgggcaaaatttgctacaggacactcaaagaacgtgtattagctgctggacactgcaaaaatgtggtaattagctacaggacacccgccttattattatattatttccggtggaaacagagagagaaacattggttaaagacaagtttgcccatgagcccacttgtcaatcttacatatcatttctttctattttcgtcttcttcctcatgtcttgctctcttgccgccgctcatgcccctcggtgaagacaacgaccgccgtcggcgccgatgagccatgatcgccctctcctttctgcattcctcaatcttcacttgatgccatcttcgttccatctaatttcgtgccattccatgcaacggtgaacgcggaccacgccctcgctgccctggagcgcactttgagcatcgcgccgcgacatcattgccgttcccgtcgatcgggtgaagctaaggccaagccaccgcaccatcttcatcacgacgacctcctcttcggaagccccaaagaaacctagccaatggcgtggcgagcttatcgatcggcatcgtcttctccaactccggccagcgagctcatctttgattccacccgctccggtgagccaccattcaatccatcgcgcatagaagctccctaggatgtccataacaccatccgtgtgcatacttggcagctcttcgagtagatcaagccgttgtcgtgaacctagagttcttcttcgcagtcgagccgttccaaccgaagctgctgttgtccaagcctcgacgatcccttccaataacttggtgagcctcctggacaagcgcggcagcgggcggtagagggggtaggcggcgggtgggacggcagtcggcagagcagcaacggcgtcccgtcggcgttgtccttcatcgccgcttccgaggaccgccacgattgacagcgagggagcacgacgaggaggcctaggagcacgggccggagcaagcatggcagggtggagcagcgctcgcggcaggcagcgcgagagtgacaccgctgaagaagagaagagaagaaaagagagaagtaagaaaagagaagagaagagaagcaggaagaagaacaatgtctaggggcatgtgtttcggaagaagagaagagaagcatgaagaagagaagagaagaacgtggagctttagatttgaactttattaacgatgcatgtgtttcggatgacctccttgggtcattatggaagaaaataaataagcatacatataggggttgtcacgacccaaatattttttttccgtgacagtctgtcgtatccttatacgcatatatacaaagcaagatgcagtgtctaaccatcaaaactggagcttggacacctacaacagtggttccatttattattattactttttttttcaccagatacattgcatattacatcggttgattcactgacgaacttattattaccaggacgataccctatacttagcatgcaagtatgacctctggatgcctctaaagactaagtagaccacactctccactaggtttgcatgtcaccatttccctctggcatctcatcttaaatagtttctatgcacatcaaataataataataatatatgaatatgttatacatactcagcaagattagtacatatagctatatatatattttttaaagacaaaagaaaatactactacccatagatattaacggccaataaataataaaggacattaaccatagtaaatgagttaaatccacactgcagaggtattaacataatcgtcgtaatcttgttccttcaacccatttttctctccaactagtgataccctcatctgataatcacgccgccggattccctacttgtgtgaggcattcctcatctcacactgatatcagccacccgatatcgttatctcaggctaagtatcataatcacattattattctcactgattgttcgacgaaattttgtgcgctttttttataaattaattataaaaatgaattgtgcggagtactgtagttgagaactaatgggcaagtcacgcgcaaggaaatacttggttgtttgcctgtgatttactttcatgtgtgcattccatgattatttaaagaaggggaattagtacctagtcatagctaattgccgataagcacacacatgcagcaaatcatcagtacttagctattcaccggacctgccagaagtgccatttatctagccgggcccacaaatctgctagatgtggacatgatcgctcctgatcaatataacaacatggaaatacatatgatcatatctcctcttgatggtataatttcaggatatatcattttaatggaaatacatcattcacagtatcacggttagatgaaaaatagcacatccatttcctactttaatcaacaggaagcttcctgaagaacacaagtatagaagtgagacaactaaatggcaagttataatctccgcattcagcatttttttggtaaagccatgcacgggcatgcatatgcaccgacctgcagctgctataaaaggccaagcaaattcacaaggagaaaaacagacagaggcagcagagagaggacacagagaggcaggcagccgagagagcctgcaagctcacaccgtcgccactgccgtcgcggccttcaggcgctgcgctgcgctgagtgcctcggcgggaacgtgcgtgttctgcggccggcgacatcggctgccgtacctcggcgtccggcgaggaggcacgtgtgctgaggaagcgcgctaaggaggagacgatcaccagggagacgatgccgctccagttcactgccatgggtaactagcctattatcttttcatccctttgctccatttcagtgcatgcatgccgggacgatgctcctcagcagagaagatgtcggatgcaccgccatcgccagagttgccaggccaaccgatccgttgacgtcatccgcaagtctccatcaaggttgagacgatgtttctgcatggtgcggcgatgtcgccgggatgcttggacgtcgtcgccttgccggtcgtggcctcttctccgcaacgccgtcgacgtccgctcgccctcatcaacgcagctatcttcttcacactcattgccttgctgcttgaagagaacgccggccggagcaccactactcggtgcacgcaaggcgtcattacctccggctgcgtcatgaactatcttgttggagtggccgtggtcccgtggacgccgctgagccgcccaaatccatagacgacgaggcattgccaactaacgttcgtctccgtcaccgtccgttgcccaccggagaaggccattatattctcaggtcgccaaggtgctggttgccgatatccggagaccggaggtcactaacatgtcatccacaagccgcgatggtatcgtcagaccctgttgccggcacctgtcatgatgcagccttgctgggcagggatgtcccactgagactactaatcggcgacgccctcagtcccccacgctcgtcgtagcctctgcgggtcgccgccgacgtctactaagtcatcctcgccagtgctatgatcttcctcacgttacaattgtcgagccgcccgaggagaacgctggagcaccattgcttggtgcccgcacgtcgtaaccgagtccagccatgatcccttcgcttcagccggccgaggtcgtcgtgccatccatccacgacgctttcgcttcggcacgtcgggatcatcctcataccaagagctacagtgtcatgctcgccggccttgaccgcttgatgacaaaatccttatatgtacaccgtcatcgatgatgattgtcgactcgccactgtcgccagtcatactctcagacccgcaccgccagggcgtcttcatgactgccatcgacgccggtgatgtgatctcgtccacaaaccagaagtatcctcgtctttcatcgatcattggcatacattaatcctcgtggctgtcaccaatggcaaacctgttcggctgttcctggtgatcatcgcccgtgcagattgtttctctgccaatgacaagcacggccttgtcgtcgttgccgacgccaatcatgcattcatcgtcaacgtgcaaatttggagccgctagctgttaataaacgagctcggcatccccactggtgtctctgtcactctgcagcgcccatacacatgacggcttcttcatggccgccatatgctcactcccgactcaagccattacgatcggaggtggctcaacatcatttgagtttggccccgattgtcggctcatataaaatagggccaccgacacctggagtgttatccatcgctcccaggtttcgctacgcccctaacatcccctacagccacttgatactaagtgtgtgctgcagcgatcagaaggctaactcctgtgccatgatgatggtcaaccggtgtcgtggagactagatgggtgatgctaccccaaccgccagtgaccacaagcttggaatctccaccggtgtctctattgctcctagcgatatcaatacatatacggatgacttcttcgtgaccaccatcggcatatatactctcaagctcgacgccaccaccgatgtcattcatgctttcgctgatgacctcttcatggctaccatgaacatactcgagctcggcaccactaccagcaccgtgatcttattctcaccccagccaatgccatgctagttcccactacaagcaccatcttcacctccaccgacgaggctaaatggcagggcgggcagagtcgacatcaagacgacatcaccaacaccggcgtgcggactgacgaggccgcgaacactgccggcacccactcacacacatctataccatcatcaccatcatgcatgggaggacgtgaagcgaagacggacgacgatgaccagcgtaccttaatcggaggtatctcacgggtttcacccacgagagtaattaaccgggtgtcttccgagaccccgggaaccaggagatcacaatcgccaagtcagatccaccttgcctatgggccgtggagcgtatttgtccaaggattttgtattttttaattcttcgagaattataataaaatgcatttttcttcgtccattttatttttgtgtacttagtacactggcatgcccgcacatcttatttccctgggtggggagattctagttaaaattctctccaaacactgataaaatcatcaatccattattcggtgttcataatactttctgttagattattagtatcaccatttcaataataatggtaaacaaatttagtcaaagttaaatagttgatgggcgcaatcttgccttgtcttctgttgttcttcctctacatctacatctctcgggattttagttatcccgtgaatgctaggagcaacggaatcccgtggggtagcagccctctaaacccacaattactttttttccccttctttcgttttatttagtttactaattctatttgcgggccaaacaagccgcctctggaccatgggccgattcgtgctcgggccggcctgtgtacgtgaggctggcacggcacagcccgccaccgggccgtgtcgggtcgggccgggcggcccattttgccagctctccccaaaccccaccatggtgagcagcaaacgatctctcctccttccctagtccagactcccgacgcgaccaagcgccgccgtcgccgacgcttccccgccgtcggagatggacttccaggtcgtcgtcctcgccgggggcacctccgagaagctctcgcccctcgtctccaaggtcctctcctccccaccgccgtcttttaactccggcgccctaactgtgaccctcttcctcttctcccgcaggatgtccccaaggcgctcctccccgtcgccaaccgccccgtgctctcctacgtgctcgacctcctcgaggccagcgacctcaaggacatcatcgtggtgagcgcgcgagctcgcgtgtttctgcttggacgcggcttgaaaaatggtggggggattgtggctgatgcgggtgtttcgcacggtgcaggtggtggaggggcaggaggccgcgcgactcgtcggagcttgggcctcgagcgcctacctagaccgccttctcgtggaggtgagctcgaagcctaatttggctttcgattgattgaagtatgatagaccctaggtgtttccctttgctgtcagaatcagctgaatttatattcatgtttctttctttgttagatgtcatgggtatctatgggctaacttttgcatagtttgcaaaagaatttctcttgtggagatatcattgaatcattttgttcaggttgctgtattgtatggatgaactccttttaattttcgtgtatgatggagtttttttcacggagatagtctcgtggtgccgtgcatattatacagttgtgtgcttgcttatctgggttctcaaggtaatgatattaagaaggtttgaatgctaaaggagttatggtatatgaagcagcatgatatggtcagcttcagaaagcatgatataatcaagtttcctagttctaaggctgttatgattattttttagtgaaaattggttggctaggtgtatttattgtgaaatcagtcaaagggcctgtttgggggagctttagattctgagaagcagctgtttggtagccagcttctaaaaatatggaaaagctttgaaacccagcttctccagcttctggcttcttagttcatttttcagaatctgtaactacagattctcagaagctgtggactgtttggggcagcttctaccagaagcagcttttgggaaaagctgcagctgggacaagctcccccaaacagggccaaaaaggctgtgtacctattcgtctaaattaattgaaatgctgcccctctatgttcagtgtctgtccaatctattacgagctggccttttgttttggaaccaaaggaaaaccccagtggcagatttgtattgcgaaagaatgaagccagtgtctactgactacagttggcgttttacatcccagataaagcttatttattagggcatgcgcaatgtatcttacccaactagtaaataagatgggccccatgaccaggaggtagtaagctgcaactcttctcacaatgcttatatgagtgtagtggtaaacaaggtggggtccacctgaaaaaatccatccatcccaaccctccattacctggatcctgtcagaatcttcatattttatttggttgttgccggcaatagcacaaataccaggtagtaactactacctcttcccacaatgcttactattgggtagtaggcttgaaataaatgcttgttacctggttttttgccacattgtggttgctcttaggaatttccactattctgcatttccctttgaacataagatctacattgtagttattgcaatctccaatcccgccctgtccttttaagtttggggcatttgtaaatttgccaccggttttttcaatattgcaaggatgccactcgaatgacagttctagtggcatttttgcaattttctagtggcaattttgcaataacgattcaaagtagtggtaaatttgcaattgcccctttaaggttcaaacataggcgagcagtctaaatggttagaacttacaatatttcacatagcaatagaggaacatagaacattgttcatctctttttgtttaatatcgtagtttgtttttcttagcagagcgtggttgattgattggacaaattagatgggcacattctgctgatatcttgcatgttaagttgttattcgttgcttttgtttgaatatttgacatccatcacaatacgtagtttaacattggcttgtggctaactggctacttgaatacatatatgtgtatgagcatattttgatgcactcttctgcacttttttcactttgatacaccttccaacagaatgaagctaattcaatatcataagtcttctgtgaaacttaaaataatgtgtgattgaggtctttgccctgtctaatcattgcttttcattaatatgttataatatgaaaatttcagcttctgatagagagttagagac

SEQ ID NO: 70941 - DNA, 790 bp, Oryza sativa
  unsure (1)..(790): unsure at all n locations
atgtattgctanaatcctccattttttagcggcttcaactccttgggtttatgtttggatttcatttatatttttgtctgtgttatcttctaatcattagttttagttgtccattagattttttctttggttcctcaaattaaaataggccaatttgcctggtaccatcgcaaaaatcatggaactggaaaatactaatgtatctgtcattgatgtgggtccaggacccacatgccattctcagatacgctcgtattttgcaactcacatatctcaactatagtattttccgattttttttattgaaataggtctcgtgtctatgtggagtgtatcagtctttgggagtaacttatctttctcttgtataggttgtggcagttccagaggacattggaacagctggtgcactacgagctatttcaaagcgactgactgcaaatgatgttttggtaatgttaatgcttttatagaaccttaagaatgctaaaatatgcatgctaagtgtaatgtagatattaatgtattagaaccttgttacaataggtgattagcggcgacctagtaactgatgtacttcctggggctgttgctgctactcatagaagaaatggtgccgctgttactgctttactatgttctgttcctatcagtggtccttcagatgctgcttcttctggagggaaagataaagctaaaaaaccaactcgactgaatatagttgggctagacataacaaggcaattcttgttgcatattgtatcaggtttgtatgtcttgttaaaaaggt

SEQ ID NO: 70942 - DNA, 1741 bp, Oryza sativa
tcaagttgcttaagcaaataaaataaagacaggctccgacacagttacaccacacaccggcataaccatgccccacacaactccaacaagaagacaaacgagaaagaacacacgcgcaagcctactaactgctcgtctaccgctgcgacgggccaggacggaaggtgagcaacagcgcatcctccatgctaccaacgccggaggcttccccctcctggggaaccacgggcgcaggctcggcacgaggggtctccacgaagcaagtccacgccagggactgacgaacaagctcgggcctggaggtgctcttgcgggcggtgatcttctggctgcggcagacgcggcgacacttggggcgacagacctctccctgggtgatcttgagctgatgcagctgcgcctccactgcgtctaggtccttcttcagctgcagattctcctgacgcagctccaggatcttcatgttgttctcgaccatcccacgacgcaccatctgatggaagtcgatacgagccgcatcgtacgcctccaccatgcgcgccaggtgcatgatggtagcgtcatcctccgagctagcatcccggaaggtggcgaagtcgcgggctcctccgcgacgagggtggtagcggtagggcgagtgctgcaactcgtccgggtagccctggtgaagagtgccgatggcgaggagagcggcgctctggcaagcggcggggaaagaatctccacccgcggtgactgccaacgaagtccgctcgggagagccagtgaggatcactgcagtaacctcccaagcagcatggggctctgcatcgtcaccctcctgctccgggagcggcctgccctggtagtccactccatgcggataccccaggacaacgcacatgccccgcagctccaagacgaaaccagtcatgtccagaccacgacggctgacgctgccggccatctacaaacaaaaacaaaaagaaaagcaacattttaaaggtcatattttggcgataaatgaagcagcaggacagagagagactagaggattttcacaaataagaagggatttttattttgaaaatattgctaaggcttgggatctaaggctcgtcctagggtcaagggggctctgataccaacttgtcacgaccggaaataacccaacgggtgttccttacgtgcgtgcattaatccttgtcccaggaggcaaggtacaccaaaagttgatacaattcagagtttaacaagcggaagcgtaaatagttaatttattacatgggcagcaaaggcccagcacacacaaagacaaacgagaaacagcggaagactagggcgatgaccacaggcgcttgacggcaggcacgagctagacaccaaagccttcatcttccaggggctcctcttctgggtttgggaaaaattgagcaagactaagtacaaccaccgtactcaacaagatacacccacaagtgcagaataaatgcaagggagtacaaaggagttatactataaagggttagggttgcagtaaatagcatttaaagatatttagttgctcaaaactatttagtaaacacgattctagaactatacaatattatttatcaaggccgtgaacccacacgaacctgccttaacccaaggcctacgatgattcataccgaactggcaacccgaccctgggtcccagctcgtccccaagccaacacaggccaaccattaacaccttttagttgttaagcaggttttaaga

SEQ ID NO: 70943 - DNA, 6497 bp, Oryza sativa
tattgtgtgcctcggctgattcctggacgagggttcacacacatgtaagcgtttggaattttggatagaaattccgggcgtgacaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataactccatataacaagtagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatggatttattgcgtcagccgaggggagagggcgcgcggaccgggtccacgggagtggggcccacgcggcagcctcacggtccacggtggaccgggcgcacccggctcacaccggccggcgccgtgggtcccatgcgtcagccgcacccgagggcgcgggcggctgacggccgggccccacatggcaaccgcgggacgcgcccgaaggcggccacgccggcacaacacaccgcaggcggcgcacccgcgccccgatggtcgccgccggcgaccaccggcgcggcggagcggcgcccgagagaggggagggaagggggaagcgaatcggcggtccacggctcaccccgggtcgacggcgacgacgggaacggcgaccggagcggaggaaggcggcggcgcggcacgggtcgacgggaacggcggcgttccggcggtcggcgaccgaaacggagaggtgaacgaggtcggcgaggttgcggcgaacccgaagaaggcgacgccgaaacgggagaaggtccggggcgacgacggcggcggaccggagctcggcggcgacggcggagagagagagcgacggcgcgagctcgattccggcggggagagagagcgacgagtggcggaaacggcggagggaggcacggggagcgtttatatagggttgggagtgagagagggcggtcggatgagggggaaacggccgctcatttcttctttattcattgtacagtatgcaattccacgaagctgatagaactggagcaaaggttggatacgtcgatccaacaagaatatgcaaaacacaacacaccgtagagctgagagaagactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatggaaggtacaaaacaaccagtaaccgagcaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctctgccgattcatccttcgtgatgtctgcaacgcaagaggtctcttctacgacaaccagagtgaactcacaatggacgacaaatttaaacctctcagagagtgggagaaagaacatatgcaataacatgtacactacttatacatatgcaataacatgatgaaaaaactgtgccacttgctattatatattcgtatgtaaattacgattgaattaatggttatgtattacatgtttgttactgcggcacttgtcttatcttatatgcttactactccgaaatacgataataaatccctcaataatttaatattaattacgagacacatctcaccaaaatgctagaataaatattattttagctattcggaaattgaatttcgcatgcggtctacttaagacgcccgcatgcgaaaatagatcttcgcatgcgatcttcttaggtcaaccgcatgggaaaatatatcttcgcatacggctgcgacatgcgggccggccaaccgcatgtgaagatcgattccgcccgtatgcaaaaacgctttctgtagtagtgaacgttgaaggcgggaggagcggcgcgggcgggggaggcggcagcccccccgatggacgcggtgggcgtgccgagccggccgacaacgacgtgaccacacgggagttgggaggcatctgcgtcaagcattctcctgctggttgccgaggcaatcggcaagagacgacagatgaggactgactggactgcgactagcaagcggtagcaacaggcagtgcatgtgtgtactaacatcaagcggcaagccaacaagcaaagggctgactgacagagcaatgctgcagataggcacgcatcgtctcctcgccggacggtggggcggccgcggatggtccaggtacgacgaccctccccacccattcgcacggacggagcgcggccgcggaggagggggacgcgaggggcgggagcctcgctggccctcgagcgccccccgccgccggcgctccagctcccgtccctgcagacatgcgaaggggagagaagagatgtcggatataatcttgacttaattagttgctgcacattatgtgtatgtgcagatgtacgtggtcactgagtcagtcacgtagttagccattacttgatgattgcacgcagatgagctagtgattagttactgcatgtgcgtgtattagtgggagttagttgggttgttagtcgtgtgagctgcttacatatccatgcagtgcatgctgaagttagtgcctagagaataggtcgtgcatgagtggagttggtagctcttttgtgtacataagtactagataaatgaatgaaaatatgtggcatggttgccgagaaagcaagatgtagtttatgtgtccacctctgttcttcctccctacttgtaatattcttgtgtgcgtgtgtctaccaaagagaatttacgtgtttgtgattaacacctagagagtgagaggagatattcctaacaagagagaggagggagagagagagggaggaggatgaagaggagagaggataatatgtgggccccacatgtcagtgggttcacaaatttgctttgaatgataaataggtcccacacatattttttaattctaatgatacctaagcgccacatcaacgccacgtggacagaagatcgagtcaatactgccacataggtgccacgttagtaaaaccgccctccaaaaccgccgagggagtcaaattgcaccggttttaagagttgggggtcgagatatccggttttgtggtttagggtcacagattagatttcgatcacttttgagagtcacgaagtgaacttattccacatcggaatcagttgggcctaccagacaaaaatgggcctccatatcacacctaaagagaggggttgctcaatatataatccaacgcttggtattagctggtctgagctgatccaacgacgccaattaactgatgacgtggatgaataagagggcagcaaattagtattaactgcagtaagtgtggattaatcgtatagatatataggatttttgctatgctgactgcagttctcacgacgaccacggttgttgtcatcattgtgaggatgaggccacgattgttacgatgatgtcagcaaccgttgtcctcattactcctttggttctcgcgcttttccctccatccattgaggtgttgacataagtctatcagcttcatcgtttggcctaaacagtcaaagaataaaccaaaatttaaatttttaaacttaattttgaaattgattttgaaatgcttttaacgtaatttttgttaatgttggcttttaagtcgctacgaataaatctacagaagttttacttataaattaattttaattttctaataagccattttggataaaatgggcaattgatgggagcctacatcattattggggggaggagaattgcgtgttctccatcatcgaggcatagattgatcttgattgtggttctgacttcattattttggccttctgcaccgtcttggttccttgcgggagattggtgatttgctgaatgtcatccctctctttgttgattgttcacagttttaaatgtagtatcgaggttggctgtcatagacttcatatgttccaaccaagctgttgcatctggattggtcgttgcattgttggggatttggtccagcaatccatgtacataggtcaaatgctcggccggtgttagagcagggtttgttggaggagtatgttgtgagaagctaacgtattcaccttcctcatgggatgctcttgctccagcactggttgccgcttccccttgattaggatcattaaccttgtgttccgagttggccccctcatcttttcgcttatgcttatacttatcagccaaaatttaaattttcaaccttaaatttggagttgattttaggattttattcattgtagtttagttttcagcatttgagcctttgcttttatatcgtcaagaacacgtatataaaagttttatgcacaaattatttttcatttgtaattatgttgttttgctttttcctccaatatgcctaatgatggggttgtaaaatagccccatattgcatattcaggcatataaactatcacaaatgaaaattttatcaattagaaagttgtttatctcattgagctatataactttgatatacgtcatgtctctatctgagatcatttaaaaaattcaaaaaaaaattccaaaatagatctcatcatttgtaacgcttatttgaacatgtaaacaatctcaaataaaaatattgaggtctacaactttgatatagggcctatctccattcaagtctgtctgaaaaatttaaaatttatttttcaaaatagatcccatcacttagtgcatattcagacatctaaacgatctcaaataaaaatattatcaattataaaattaactctacaacttttacataaagtctgtctattcgactacatacacatttttttaatacacatttttttatcaaattttataaaaaaaggttgtgatttaaatatattccctcatgtgtgagggttcgtaactgccactcatcatagatcatagatatgtgtgatgtgtcgtagttacgagctattacgatgacgggtcataaatatctttgatgggtcataagcagggcttcccttactgccgtaaccactcttaccgtgggggtacggtaatggttaccggcggtagggtttgatgaattttaaccaaattcaaaatttccaaaacaaatcgaaaaaaacatggatgtagttcttgatttgtagtggcggatggtaaagaaatttgatgaaaaagagtaatataaaataacatttgatggtaaaaccgagagtacattagaaaatggtaaaaaaataatgcaatggacctttaagttgcactgtttatccagcaaattaaggcccaatagtggagaaaatatatatagggtggctgggtgctacatatggacatcattatgatttgaaatgtgaggttgttgaattgacgttgttgacttattatgctatgaattgttgaattgcttcgaagtccataacatagtaaaggacatgctgaatttttgtattt

SEQ ID NO: 70944 - DNA, 2934 bp, Oryza sativa
acgtggtggtgatggtccacgacgagacggcgggcacggcggagctggtggtgctcgacgccgggaagatggaggtggcggcgacgtagcagctcgccgagcagagacttgattaattagttttaggactccctccgttttaggatgtttttgacctttgtcaatatcaaactgctttaatttgactaagtttacagataaatatagtaatatttataatactaaattagtttcaccaaattaataattgaatatattttcatattgaatttgtcttgagttgaaaatgttgctacttttttctacaaacctggtcaaacttaaaacagtttaactttgactaaagtcaaaacgtcttataacctgaaacggagaaagtatttcttattagggggtgtttagatggggttaaaattttttagtccatgtcacatcggatgtttagacattaatttagagtattaaacatatactaataaaaaaaactaatttcataaatgagaactaatccaggaggcgaattttttaagcctaattaatccataattagcaaatctttactgtagcatcacataggctaatcatgtattaattaggctcaaaagatttgtctcgcgaattagtccaaggttatgaaatgtattttataattaatctatgtttaatactctaaatttgcgtccaaacatccggtgtgacagggactaaatttttgtccctagttcccaaacacccccttagtttgttgctaccaggtttaaaatttcagttcgaaatatctgaaattaatttcagtaatttcggaaatccctgcgaactcacaccggcaagcaaatatcttgtacggaatttttggtttttcatatttttatgtaagaatttggttaaaatttattcacatttagtcaaatttattaaatttttaaataatttcgttaaaaaaataaattcccaaaatatttgaaattccggttactactgaaatatcagaaattttggttttcaccaaaattataaacgttggtagctacaagcttctcggatattttgattttttttctatttcaaactaaatatattatcaagttttggaagacaaaacaaatatattatcaaactatatctcatattggatttaatggaacaaaatatttaatgctacgcataatgctattttttttaaaaaatagtaagtttgacttgaaaataaaaatcaaaaggttgtacgaaacaggacgcaccatatgtaggggataaatactctcttcgatcagtaatatatgacactttgaatgtcatagattttttttatgagggcaagtatatctatatatttttgcatgtattaattaacattttgaatctatatatcttcagatcaccaagcgtgtgtgataaacaagcacccgtgtgttgctcggcaaataggtagcctttctcaaactcaaactcaggatgatatttgaactgggctttataatcctttttttttaaaaaaaaaacagttgctcacaaatagataaccttcctcacgccgcctttgttgctgacaaggttatgatatgctcgtgttcatcctcgatatgatttacatgaagaggtcgatcgaggtgtcatatctagaagacatggagatctcatcaacgaaaaatatatgtgtgcaagcactaattgccacaaatatgtcgcatgaatattattagttacatcatcagtttgatggatcatttacatgaattgacatgaacaaacacaatgtacatttgcgctgtgtcaatgctccctccaatcaaagatgtcgcaacaaaacgcatctggacaaaatttcgaggcatcaagtatcaacgccttatgatacaaaattaatgtatggatgcatttgatttagagtgttaccaaattttggtaatgtttttaagagttaaaacttttgaaaattatggtaggatggtattgactaaagtatgtttattaaaatttattgacttaccaaactgtggcaagtttaaaagtgacaacaaaccaaacatgtcttgaatgaatttgtatatgatttagggctcctttaaaacacgggattcgaaaaatataagggtaggctatcacatgttgaatcctacaaggaaaaaaattcacaagaattaacgaaacaccttgattagtaacccaatagaaaaaacagacgaactctagacacaagaaagagaaactatgaggtaagacttcatgttagggggtgtttagatcccactccaaaattttacaccccgtcacatcgaacatttaaacacctatataaaaattaattatagacttaaaaaaataactaattgcacagtttgcgactaatttgcgagacgaatcttttaagcctaattgcgctatgatttgacaatgtggtgctacaatacacatttactaatgacggattaattaggtttaataaattcgtctcgcggtttacaggcgaattctgtaatttgttttgttattagattacatttaatacttcaaatatgtatccgtatatctgatgtgacatgccaaaactttacacccctggatctaaacacagccttaggatttctccaaaaatcccatcaaatggcccattccatagaaattctaaagagacttttcagagttattcttttcttcaaaacagtcacataagaattatttcccctaagaattcaatccttgaaaagtcctccatttcccctttgttccgaaggagtccttagaagacggtgtctatgtccaagactttacataattgcgaccatatagaatatatctcacggtatacgtgaggactgacgtgccatggttctatcatggtacacttgcacagcccccttggaacgatcttatgatcttcggagacaacaatgcctgaaagttgtggagattttagctgcaaatgttaccatc

SEQ ID NO: 70945 - DNA, 4113 bp, Oryza sativa
actaaagaatggtatagaaggtacaacaatgaccaatacaataaacctgaagttttggttagaatcattgcagcaatggacaactgaactattcgtgtacctctccacttctccatatacacaaaggaatggtcgtacatgtgagatgatttacttgctgcaggaccagggcaaggatgcacatcaaaatgatgtatagacacactctttacacaataaaagaaaataaatacaccaaaagggaaaaaaataaaagataataaagcacactctctccaggcaatccattctcctgatccttacatggatgttcaaaattctcttctttgaacagggagaaatggcattcgttgtgtaattgcctcgttgacacctatgagcaaccaagacatttacttactggacctaagaattccaggaagctggatgtcggctgaggtgttgtttcctctgcccttaaaggtagatgtctgaggaatgccctgactacacctgacacaccgtcttcagattccatggccttggcaagctccacggctttttctttcacctgaaattacatgacacaccgacaaagtcattgatcaggtacgaaacagacccatcatacaatgtacaccaccatgccatagaccatcttatccacgctatggaaaaaatactacttttcatcgtatcaaatatttcgatttatgttaattgacacttacataaaaagtacataaaagtaaaatctatatatatctatatcggctggtttacacagcagataatggttatgataacttggtacagtttgtattgaaacaaacagtggaaattgacgactttgtgcaatgcaaaaaataccctgctactgcctattgccaaccattccagcacaaggtaatgttcaattctaaatggtattatcatatcttcagattatttgattattttaaaaaggaaccccaaacctagaatgggtaggatgcggggaatcattatctcctgtgtgaatcaagtccagaaactatttctttcaatgaaatgaactagcaactaggtattccagtatttcatttgagggaagaaaccaggaaagcaaggaaagtgagttatcccaacagaagagaaaaaaactagctagaactttttggcaaagacggtcttaaatactgtggagcaagtaagggtctaatactagagagtaaaagaatagcatttaagtagcacaagtggtgcaatgaattaataaactactccctccgtcccaaattttagggtgcccctttttaagaaaaatcaaacttggtagcttttgactaataatcatactaactatatcaatataagtattatatatgctatatcactagattcatattttgaagtactttcatgtgatgctaatttcatatttgttgggaacatagaatgcaataaaataaataaatagtggtcaaagtatattattgaagaccatgtaaaaaaatatagaccttatagtttgggacagagggagtactactataaatcaacacctgaaaagagagaatttaaataaccattctagggccaaaaaacggatattgccagttctggttttcatcctgaaacaggtgatttgcagcacaaaagctggtccattaatttggaaggcaaaaagtgatataatatataatcttaaaaaacaggtgatataatgcctattcaggtcaaactgcaaatacaagcagatctaaataaatagaaaaccagccaagcaaatagagaccaaacaggataaggctccagagaacactggttttccaaaccctagcgagttcaagacagacagtgcaggagcaactctgttgtcacaaagtaggagcagtatatatgcaatgttggttgtttcggtgaagcaaatgttcgttttttactagacattttgcacatcaacagtccctgatgcgcatgttccattgctacctttttcaactatatatttacaaaaaattgaaacataaatatatgaaagtatttttcattataaatttattaataccattttcacatatcaaatccaaatattttttagcatattaaaatttaagatctcaagacgtaatctacttgagaacggaggtagtagattccctgttaactatttacatttgttggacggttaaacatgtttgaatggaagatatcatgttatgtatgaaagaggaagcattagaaccaagttaaaatgcaccagctagtcagcatatctacgaggggtgaaatctatatattcgcaatcctattgacaacatatatacatccgatccatattcttgttgtctttatacatcttaccaacaaaaataacagcaacattaagaacatatttgaattgtgttgcaaagtagatgttacctttggctccatcatgaagtttatagcatcaaccaatttttgcaagctgaattgatcaactggtataggtagaggccctacccctctagcatgcactcggtctccccagaatggttggtcaccaaagaaaggtacaatagttgtagggcactacaaatcacacaaaggctaggttaggagaactgaatcattttcaagaattagcccaaaaagtagcacaccacctgccagaccctattttttgcaactgtgttaacaggaatttctgaaagttaggtggaattggaactgctgttagagttcataaattcattcaatccagaagtgtaaccccaatttttattagttaagccaggtttttcttttgagagagagaaaggagggagatgggctaagaagggagagagggaataccgctgctttgaggccagcagctgttgttccagcaccgccatgatgtacctacagaagtaaaaaaaaaaaaaaacaaagagtgagctagcctctccctgaacgcacatgcaaacttaacatcataagttctttcaatcaaattagataaatttctaagtaccgttttagtccgtaacaggtacttatgccatgaaagctactcataatcaataactgaaaatttaaattttggtttataatttcactaatcagtactaaaaactattaagaagtaataactactaatctctgaaagttaaacttaaagatatctacttcatgccaagcatgacaagcaaaatgcttaccactgctttacactgcaggaagagccagtcatgggggcagttatcaagtagatatacaaaatcttttggctctgccactgccacaatgttttggagttgtcaggatggaggtaaattacacgtgcacagaaaaaaaaatggcaatgagaaacaaggtcacatcttaagaggtgaacttacatgttccaagcccaccccaacctttgttgatgatacctctctgtccagttatttcaagtgctttgacaatgacttcagtcatctttgctggatcttgaactggctagtatacgaacaaatgaaaggagtgaattttcaaaacacaacaatcatagtatcctaaaattcattaagaaaaaaactgaaccatggaatcactatttgcaagcagctactatgcatgccgcacagatcaacaccaccaaggcaccaacaactcattatcataagcaaaactaacaaggaagttcatccttgtttcctaagtgtacacaactgtttgtacaacattgacctctcccccaaggtcaaatattggaattgcagttgcagaatggccaaaaagatcacagcataacaaaatgtcctgtgtggctatgcttgaagttacttttttcataaatttattctatacaaattgagcatagcattttatgtaacaagcttctctggtgcatcaaagttatggtttccataacaatttgatctcctgacatccatataccattttctagagtaagacataaactattgtgaataacataactattgtttgccatgagatgctatgctaagcttcataagtgacataacagtgtactattagatgtaaatatgcaatggtaaaaaagtgaaaacactgtaaagtgttgtttcatgcagtaaaataaatattccctccatccctaaatatttgacgccgttgactttttaaaacatatttgaccgttcgtcttattcaaaaaat

SEQ ID NO: 70946 - DNA, 9681 bp, Oryza sativa
aaccccccccccccccccaaacaataaaaggaagtactaaaggaccctatcctatttcctgtgttaacatgaagtttggatgtccacatacacaaaatgtccatatctgacgttaaatttcattggaattactctctctgtcccaaaatataagcatttttagcatggtgacaagtcaaacattttcaactttgactattaatagcaaaaaaaaagatcaatcatgtcaaatttatgttactagatttattattaaacaaactatcataatatgtaactctttttatttaaaacatcttccttttatagatattgctggtcaaagtagcatctcggagaccgtgtcagagttcaaaagttcttatattttgggacggagggagtagcaaattttcatgctcattaccaattagaaaaatgtggtatcaaactgaaaggctaccaatttcagttggcattactaatattgacttggttcacagtgttatcacagcaaatactcaagcaagctcttttcaatacaacaactgaatgctataagaaagtcaaatgaaaagaaaccataggaccagattaaggtccacaagttttaaaaactatacaatcgaaggatgacaaggttaagcatgacgtgaaaagggataacatataaatttcagataaagctaatactcatcaggaacctttcggttttggaacaaggtgaggactccagatgtaaccatgaggaatgtcattcccagaaccctgtgcaccacttaggtatgttaccggacgcaacttcagcttcttcttcctaaattcatttatcatatctcggataccaagccaaatcatagagtcaacaatttgataagaaagctgcaagtgtaaaccatttgaagattagataacaaatcagatcagaagaaaatgagtgatttgagaatgaatctttcaacaagtgcttgatgtgagttagggagatgatctctaactttgacatgtggtgcatggttgtttttagggaatgcagcaaaattgcaacctatttaattacaagaattactataaattggatcaaggtcccttgcaacctaaagagcactcccaagaacaccagccacactgaatgaagccagaaactaactctctgcatacagtaactcacttgagtttaccacccaaatcagtctaacaacaaacgagcacaagcaggcaggccaaaattgtcagagttgggatcctatcccagtagtatgcacaacaatgcaaacaaagtaagcacaacaaaacctattgtctgattgccatttacaaaataacagttcaagccatttcaaatatctctactattataaaaattgaagatgtttccaccggaattttggtacgtatccaattcgacatgagtctaaaataactattgtagacccccccccccccggcccagcccaacccaaggtcccaagcctttttttctcttttttttttcttctttgccttttcttctctcctgatcatcctgatttctccctctccttccaatctctgttttctgataaactttagctcaatattttagaaaactgcaacattagtgcacaattttatcagaaaactgcaactccatccccatttgtgtccaataggttggcccaatctgtaaaggccctattgcatgttgctaacagaatgtcggttctctaataaaacctacactttttgcagttccttgaaatgcccagctaaagttgaagatagttttgacagaatagttgcactttctgaaatttactctggcattaacccatgtaataatgaatagttcagatacaatccgtgggcaagaacatgttaaggacatagcctattattacacatatgcacaagcgtgcacatgcctatggccagcagactagccatctgcgcaccaaacaaattacagccaggtgttctgcatcttaatctatctgttggcacattgttcagttggataaggtctttgcttaattatgggttagtcacctacttaagaaggcagccagatatagtaatcgaacgcaagaaagaacaaataaaatctaatctcatctaagtgttcgtcatatataatgttctctcatcacaagcagctgacactgccagctatcctccctgcagtgtctgccgcatttaatagtataaggatcattatgtattgattaaaagagaatgtaagctcccggcaaccttttttgtagtatttctttcagttcatcaattagcatactgactaagaaatgggaaatcgaagatcaatccttgcctgccattttctaacatatgattaacgctatgcttagttgcttactccaaaaagaagtattcctgaggcctatgccataaaaccaactgcagttttcaataagcctaagtgtcacaaaatatgatagttaatcaattagacgcggttgatgaaaaatgggaaatgtctaaagcccttagaatgctgcttctattcttccatgtcccaaatcagaaatacccctctaaatcaactataaggttcaaggattaaagatctactgaccttgaaaatattgaacttaaactataaatgcgaaaatgtataacagcaaacagcagagtgttttctttcttatgttcttagaatatatttccatagatactcatatctctttttgttctttcatgaggcttagaaagggcattcccagacaaatcattcaagtatgtgttgtttatcctttctgtgaaatttacaatgatccagaatggcctacaccacagtattagtttgtagtatgtgccaatgctgtgggtttggttcaaattaagagatggttatgggctcaaacctataattaagctacccaccaaaaaaggcatagagtaagctaaccaccacaatataagcactaatgattctgttttttctactgttaatgaagcaaaaccacatatctagcctaatggcaattgcatttaaactgtctaagtttgctgccaaaaacaaaatcaggtttagctaacacagctgggttatgccggtagggttaatttaatcattgagcaactataacaaatgtgtctaagagaagaagtttaaaatatttcctgaataaatatgtaagatgcaaactcactcgatatccagccgcttgtttcacacgagaaagaggatgggggaattcactagttggcctgaacaagcagcacaagttagatctccaaatgagaatattcctcagcaaatgtgctcttcaaagaggaagcagaacaatagtgactcacgtccatggcatggtaaagaatatatgaataggtacttttagtgcctctgccacatgagtatgtcctgaataatcgttaaggtcagcagcaaagaaacatttataaattttcatagaagtgaattgcaattggctactggaccataaaatacaaaacatgcaaaaaaattcacactagagcaccttgtaaacacatcattgcctaatcatttgagctggaaatgactatgattggttccaaagtgataaacacagaaaaatcctgaaaagagatgcctccagaaagattggcgaaacagaaagagcttttaaagatgtcaacttcccaagtatattactaggtcagtctgcctattaattgcacaccaaagaaaagcaccaccatcataaggcatgaatcaagaaatgattgttctgaaatggatgcctcaaatcagaaaaataaaccaaattgaagcagtaagaaagaattgtacatgagcaaacttataaaaatttaagatcttttcgttttaaaaaatatatgatcttgactggaccataaaatatgatgacgctgatcccgttggatcctaacgtgcataggatcttttcaattctgacgaccatgcaaattagtaacttataacatataaccttcacagtaacaattttcacagtgcaatactaagactccaagcatgtcaggacaaaaaaaaaatcctgccttggatcctgatcctcacaaccttgtatatgagtatgtcagaaattggtgttttttagagtagtaggtacttagttgagcatataataaacaaacttggagttacacttgtaaggtagagagaaagtaaagcaaagcgcaagaaatcaatccaaagctggtaagatatactgaccatatgctggagggttagcaatgatagcatccactttgaaaggaataccagtgtcaggatcaggctccttgcacgcaggtagcaaagagaatataatttctttcatctgtttcctctgaataggaatttctgaaggaccagaaggcaagaatcctttattcttcaccatgtctgctcaaatatgaatataccaaatatattaatcatcgtgacgtagaaactgaaaaaaaatcaactatgtgaatacaaggatttattttcatacattcagcaagtatttttggatcaccgccaagagggaaaaactccagaccagccgttagaacgaactccttaaagtttgcatgggttgccaatctcacacggtgtccataatcctaaaaaaaacaggtaatggataatcctagtcatacagaaaccatgtatttagaaacattaagcttgagaagcaaaatagttcacctgatgagagataaaataatgtgaaattaacaaacaatggtagcttttgatctaacctgtaagcgtttgcctatagcaatgaatggctgaacatcacctcttgtgcccacaataagaataacaatatccataggaggcctcacagatatgtctgctccatccaatggttcctcaacagtaacatcactatagccatcatatgctacaccatcagttgtacttgtttccagagaacttggcacatcaaccaccacagttccatcatctttcactgtagctatccgatttagcatttcgagctacaataaaatgtaaaatatcacaaaaaactgttgaacaacatcaagcatccagatacaaaagagtacatctggcactgagttcctgactattcgaagctaccatgcagtgtatcacaatacacaattgttgtgaaaaaaaggctgaattggctgcataataatctgaataatcaactatttttcaatcagttggaatgtttctcaagtttaatcgtaaaatagactttactccctaattacagtgaactaatctctgatctcatgtagtagtgtttgctttggagatgaagcagtgaagcacaaaatacaacatgtcaagcttagcaagtgctgtttttaagtggttataacatgtcataattttcatgttttaattgactttagttataaataaataaattagtagagcataactatcaaaattctgattaatcagcagtatcacacataatcgtttaacagatatagctatcttagccctcacctctgcaacaggctcctagccctttttcacaatgctgcattatactaaaatgtatcaaattcagatatagctatcttgtccgcgctcagaagataaggctaacagttcacgtgactgttcaaaatggcttctcttatatgaacatatacatgctccaaatttcaaaggtcaaatgcatgaagaaaaggaagctacaagggtaaatagatgaaacagggtgcattgcaaatgaaggaaaggcaagacataggcaacaggactatgttatccgcaccttcttttttagggaaattttatcatcaaataactgtttagtaggatcatcagctggattgttttgtcgacgcctctctgttcttgatctttccagattagatggaccagcagtttcattggttatttcaacattattaatcccacctggcatagtgcttgatctggggaggcccctgtcatctacaaaaacataatgatggtttgaaaaatatggatgacaacattccttttattttacactatcataacttactgaacaaagtgagattaaaatgtatcaacaaaagatatatttgcactatgatttgaggtttgctgcagtaaattatcctttaaaaaatgatacaactataaacaccactgcataatcctattgaacacaactcacaagccacatggtacaactaagcctagcagtgttaccctgagtagtgagtagagcatactttcacactgtgcaatggacctacaatattgtgtaataaccagagctgaagagcacaacctgcttgacagtgtaaacaaaattacaataagtttagttcattggggtttcgatgtaatctaaccctccaaaacggcttcgttttgtgaagagatttgagaaaaccattattcagaaaggtaaaatctaggagaaggcaggccatcacccactagtcgtggagtcaacgcctaaaattagcactcaacacagcaccaaacccccacaccaaaccctcacacgcagcattcccagcaaccagcgtgacacagacagtgaagcagccatcagagtgtccaccaacaaggcgaaggtgcgctcgcaactagcagccatccacatgagcggagatggcagaagccgccgcagatttgggggggcgaagctgaactagggaaggcaaagcaaccgccaccaatcccaacaccctaggttgcctctcgcagcaaagctacacgaacgaagacgaaaggagagaggcaggcggggtgtggggggtacggatggatggatcaccagcgggggaagacgacgaggccgcggccgcggcggaggcggaggcggtggcggtggcggggttgtcgccgccgttggcgctggctcctcctcctccttcctccacgcccttggcctcctcggcggcggaggccatttgtagccgctctctctcacacacgcggatgtaggcgggcgcggtggaactccggcgccgcccccgccgccgccgccgtggagcaccgacgccgaggcaaaaagcgaagatgcgtctctgaaatcgaatgcctttgctttgctgtgttgctacgtgcgtgctctgctgtgatctcttctccttcttttttcttttcttttctttttcatttttttagagtaattttttctttgggtcaccttttattaccggttgtcgaggagtgatcctctccagcgggagatcatgagatccccttttgtgagttcggccgagggaaaaggctcgcttttcgagattgcgtatccgccctgaatgctgctaatcgcgtatgggcgataagattatacaggttcgggccgctatcgagcgtaataccctactcctgtgtgtgagattatggtcgagtgttacaagggttccaaaactccggagagcactctcgctcttctttccctagagttcaggcctactgagtggcgttccccttcccggtggacaaggtcctccttttatagttcaaggggataccacatgcaccgcttctacctactctttctacgggagggggacccactctaccttgaccggaccgcgattcgtgccttcgcccggaagctaaaaagcggtccgcccttcagtgtcacccggtgccgccccccacctgacacgggggacagccctgtcactcactcttaaatgggcggagacttgtggctgccctccttacggggagagaactccggatgatgctccgatgtgacaggacatacctacctccactccgccggatacagaggcgacgtgggggcacggccgcctgtccagtcagatgtgaccgacgacaggccggtcacagactggtcagacccgactgacgtgcatcagtcgggcggcaccgcatgtctgcccttaccgcattaaatgcggtgaggggcagttggggcgccgcgcgcattgatagcggcttggcttgggtctcctccccgctcgctccccccgccacatggcagttgggcgagggcctcagggcgagtcagcgcgggggcccgaggggcgtgatgtggcaccccgaggccccctggctgcccctgcgtctcccgaggcgcggggggagggccaaactgtagagtcacgtggctggatgggaaggtaacttcccctcactttgcatacccccgggcccatatctccgacagtagcccccggcaccacgtcggacattggtcccctgagggcagtctgacgtggcgcctcacgacttaccgtgccgaggttgtgggcccgacgaggactccagacggttgccggcggcaaccaggatggcacattagccaaaatggcgatttgaccgccactgaccacgctgatgatgggggcacttagggcgcgaaaatcgggggtttggtcagaccatgcccagaatcgctatttacgccgcctcgactcccccgcctgtcaagcatgcgatgggaccaatggcgggcccgcctaaccgtgcctgtgagcatcgcacgccccacgccgagtgtgccgctgacaagcgcactaaacgcgggacgcgggctccgcggggcaacgtgatgagtgggcgcgagatttgaggaggcaaccgcaggcgcaggaatcgagggggcaaccgtaggggtgtgaaacgaggaggcgagtgcgggcgaggggtggataaaaggaaggggaggcggagagttcgtcccctttctctcgccaactgcatactcgcatactcgctcctaaagccctagcgctcctctcgctccaccctgctccatacaccaagctcctcgccgttttcccgccggccatcatggcccaagacgctggtgacgccgtccttccggcattgcgcatcacggcggagaggcaccttagcctcatccgcaagatcatgccggaggatgccgccgtgagggtgggggagtcgcggctgcggccgcggtaccccgacgatccgtgcacctcctgtccttcgccatggtggggttgatcccaccattttccaggttcttccatgaggttttggatttctacgaaattcacgccttccacctcgcgcccaacgtcgtgatgactctggccatcttagcgcacttgtgcgagatgttcatcggggtgcggccgacgatgcggcagttcctgtccttcttcgtcccatggctgctgcaaggcgcggtggtggggggatgctgcttccagccccggccgggcacggcggggcaatacattgagagtcacctatgcaagaagtgggaggattggaagaaggattggttctacaccgcgctgccggaccatccacgacttcggctccccgccggccctcccgaacgatccgccacgtggttggtagtttcggaactaggcgaggagtacgacgcagtgcgggatcgcctcaggggcctgcgaagccagggcctaacgggggcgatggtgttcggtgactacttccgtcgtcgcatcgcgcctctccaggagcggtctcgcggcgcgtgggagtacactaggtacaacgatcccatgcgcacccatgtgggtgagcactgggactgggcgaggaggacgcgaagacggtgatccggcgggtgctgggcctggacactgtcgagcaaacgctgactccggacgggatcctccccttatgcagcttccgcgaccgggagagtatcctggctgtgatgtcggccgtcggcgccggcaggggtcggtcccgtcggggcggcgccggtggcggcgccgtcggcgcgggtagcagcagcgcgtccgcaggcggcagccgaaccggcaactccggcggggacggcgacttca

SEQ ID NO: 70947 - DNA, 6523 bp, Oryza sativa
  unsure (1)..(6523): unsure at all n locations
tatcatgaacgataattgcaacttgttttgcgcggagaaaaatgcccaaactatatagaggtgacaatagtgtaagcacgaggcgtgcaatggatttatagtaagtggttgtgtcaatttcaattgaatatggcaatataccgtgttgtgtttgtgagagtgtatttggtaaaaaaaggtatgaaattcatcagtgtgttatcttttaagtcaaaagctttaatgacaaatgtttcatcatacacatatagttaaccttgtgggtatgaaatgctaaattaactaatgcactaaaataagatcaataacaattcgtttggatttgtaaaattttgaccatcaattcaatattagagcaaccttatatagtgaacttatgatattattgataatatttttcaactcaaagctagacatcattttttcttattttaaaactaagcactcgagaagttaatgttggtcaaagctttaaaagtttaaccaaatattgttataaacatcaaataattaatgattgaacgaagtaactattataatctgtgaaatgttgccttgaaattttttgattttctgctatgagactaggcaatctacattttcagtcatttaaaccaagcaaaatcccctgatagattactttctgtatggtgcatacctagcattaatcaacaacttcatctccagggaattttggtgataggcatccatagctaaaataaatcttatagttgaagctagtataaagtatgatgttgtgtgggcccacattccatacttaaaagagacaaatgcttgaaccaatttgtttgtttacaaactccatgttatacatctacaggaaccgaacagcccacctctctaacaagcttgtagttacatagtagataagaccatagcttatgtatgtctcatagagtcatagagcgcaaggctaaccttaaaaggtctatagtttagtgatgatcaacatggaacatagccccctgttaaccttaaaaggtctatagataaaatgatagaaaaactaaacactaacgtcttcaaaaggagaattggcacttttgttttttatgaaagccaccctgttttcaaagtgatggcccctcctagttccctacttgagcctactacttattatgctggaataaaattgtatggtagctttgggtacttataattttataatcccatatttgatattgtaagccgttctagctatgtcccaagttaaagttagtttaacttaaacaaaacttatagaaaagtaattgatacacacaataccaaataaaatacaccagattacatgtttcaaggtggattttagagatactaatttaatgttgtagatgctagtatattatttctataatcttggtcaaagctagagatgttcgattcagcacaaaactaaaaacacctcataatagtatggaacagaaggtgtaatcttagcaactggtgaatgtattctgccaatgaattccttttcatatatttttttatgttgtcataggataaaactagaaaagtatattttcatcattccacaggaaaaagagaaaaaaaaagaagaaataaaactgaaagaggccgccaagcccattatctgctggacgacaaccaactcgacagataaaaatcaggcccagtaacctgacgcaacccggcccggcccatgaacccaccaaggtcggctccaatcctcgcgcgtcgccgccatagcctgcagccgagccccacctataaaaatcgcccgagccacccgatcccatcggcttcctccctctcccccttctttttttttcccctcccatttttttttttaatctcgacacctctaaaaccctcgcggcagcagcggccgacgggcctgcccgctttccccgtcgccgccgacgatgtggagcggcgggccgccgccgccgacgatgtggagcggggggccgccgcccgctccggcgatgggggccgggccgccgccaccgggcacgggcgctccgcctacgccgacgncggcgggcgggggcccgcccggtggcgttggcggcggcaagcccgtgacgccggcggagctcgaggcgcagctggtggagaaggcgaggaagtggcaccagctgaactccaagcggtacggcgacaagcgcaagttcggcttcgttgaggcgcagaaggaggacatgccacccgagcacgtccgcaaaatcatcaggtaaagtctccagatccgcgccgagttgttgcctgtggatgtgttttggtgttgtggtgctttgtgctgtagttgtttgtagcttaggacctagggggatgattgtggttgccctctcgattgaggctattttcgttactagtgtatgatttgatacgatgtttgaaatttatggctgtaactgtgttaagtatttaggcatggacttagctgtgatctgctgctttaccttatcatcatgttactgttgatatcagctgcttatgttctattgttactggagtatgaagagagtgaaaaaaaatcagcctgatcggtgcagccgctgctctctcgctagtagcaacgagcagctgcagtcagcagttccgttcacgtcctattaaactgctttcttacaacatttggaatgggatattggaagtcaagttttgatagttatgggaatgttatggtttttctaattaacccaactcaattatgattgtagatattgtgtaatctagttatggtggtgatttttttgatttgctaattgtcttggctgttaagatgaatctctttatggttggggtttgtgccatttgtgcctgatcctcagttattaggaatggtggcaagtgacatgttctgcttgaatttgctgtcatatatcccatcttcaccatcaactactgtagttcatgtgtatgttgcggacaatttatttatgattctatttattgctgatcagggaccatggtgacatgtcttcaaagaagtacaggcatgataagcgtgtatatcttggagcactcaaatttgtgcctcatgctgtttacaagctattggaaaatatgccaatgccctgggaacaggtatatttattgtgacactctttgatgtgaacattgatctagccaagtagctattggtgagattacttatacaatggcaatacagaatagaatgacggaactcttgttttcaggttcggcatgtaaagatcctttaccatatcactggtgcaataacctttgtaaatgagatcccatgggtagttgagcccatttaccttgcacaggtactgatctaaaacaccttatcttttttttttcttctttgccctgttctgggaacaatagctactgtacggatctgtcataattgataggcattatataacttaatctgatctttagctttgtacttcttatttttgtacttaaaccatctcaaacatgtgtgttccacagtggggcacgatgtggatcatgatgaggagggagaagagagataggcgacatttcaagagaatgcgctttcctccatttgatgatgaggaacctccattagactatgctgataatttgctggatgttgaaccactggaggctatacagttggagttggacgaggaggaagattcagctgtgcatgaatggttttatgatcataagccgcttgtgaagactaagcttataaatggccccagctaccggaaatggcatctatcgcttcccataatggcgacactctatcgtcttgctggccaacttttgtcggatttgattgatcgaaattatttctatttgtttgatatggagtctttctttaccgccaaagcactcaacatgtgtatcccaggtaaccttattgtgttcccttttataacttctaagttttttttactttaattcctttaattgtcatacatgattagcatagttgtagcattgatcttatggttatatcaaaatttataccacttggtatctgactgctggcaaaatgttgtggaaatttagcttgtgctaagaaatgggtttataccaaaacatttttttttttgcatttacgtgattttagtgcattaattgttactcaatatttgaagcatggaggaggtagtttatgtccatagctgttcatttttatggaacatctgtaactgtaacatggggatttatggtaatgaagtagttaatggctttattaattagatgatgcatgttgtatgggcgacagtgtgagaaggaattaagttttcctgcatacatatgtctgtgagcttggggctttgaaaattagcaagcaggttgggatgtaaaatctgccttctctactgttctattcaccccttctcctgtaagcacgaatttcctttttctttttttgcaactagctttatatatgcttccatatgagaatcttgcagttgattaatatttacactgaaacattttcaaaactgttgaatgggcatccaatggtagacataatttgttacattggaatgttttatgttattttttagctttgtacaaagattgtgacatgtaccttttgctgttgctgcatcataagctcttttaccatattaaatgctatgttgcaggaggtccgaagtttgagccattgtaccgtgatatggagaagggggatgaggactggaatgagtttaatgacatcaacaaactcatcatccgccaaccacttaggactgagtacagaattgcttttccacacttgtacaataacaggccaaggaaagtgaggcttggggtatatcatactccaatgataatgtatatcaaaacagaggatccagacttgcctgcattttactatgatcctttgataaatcctataacttcgactaacaaggttgatcgtcgggagaggagaacaactgaagaggatgaagatgaggacttccgtctcccggatggtgtggagcccctcttgaaaggaacagaactttacactgatacaacagcagctggcatttcattactctttgctccaaagccttttaatatgagatctggtagaacacgtcgtgctgaagatatccctcttgtatctgaatggtacaaggagcactggtgagtgccattatgacatcctttataccttttcatgatccccttttgccaatgttctgcctgatgcacttgaactttcaaagctaatcacatcaatctctcgtttgcagcccaccagcttatccagtgaaggtgcgtgtcagctatcagaagctactgaagtgttatgtgctcaatgaactacatcataggcctcccaaggcacagaagaagaagcacctgttccgttcactccaagctacaaagttttttcaaacaacagagcttgactgggcagaagcaggtttgcaagtttgcaaacagggttacaatatgttgaacttgttgatccacagaaagaaccttaactaccttcacttggactacaacttcaatttgaaacctgtgaagacactcacaacgaaggaaaggaaaaaatctcggtttggaaatgcatttcatttatgccgtgagatattacgacttactaagttagttgttgatgcaaacatccagttccgcttgggaaatgttgacgctttccagttagcagatggcttgcaatacatattctctcatgttggccagctgactggtatgtaccgctacaagtatcgtctgatgcggcaaatcaggatgtgcaaagatctgaagcacttgatatactacaggttcaacactggtcctgtaggaaaaggacctggctgtggattttgggctccaatgtggagggtgtggctgtttttcctgcggggtattgtgccactgcttgaaagatggttaggtaatttactggccaggcagtttgaaggtcgtcattcaaaaggagttgctaaaactgtaaccaaacaacgtgttgagtctcacttcgatcttgaacttcgagctgctgttatgcatgatgtccttgatgctatgcctgagggtatcaagcaaaacaaggcacggactatactgcagcatcttagtgaggcatggcggtgctggaaggcaaatatcccatggaaggtcccgggcctacctgttcctattgagaacatgatacttcgttatgtaaagtccaaggctgattggtggaccaatgttgctcactacaatcgtgagcgtatcaggcgtggtgctacggttgacaagactgtgtgccgtaagaatcttggaagattaactcgtttgtggctgaaggcagaacaggagaggcagcacaactatttgaaagatgggccatatgttacacctgaagaggcagttgctatttacacaacaacagttcattggcttgaatcaaggaagttctcgcctattccttttcctccactttcttacaagcatgacaccaaacttcttatactagctctggaaaggctaaaggagtcttacagcgtggctgtaaggttaaatcaactgcagcgggaggaacttggcttgattgagcaagcatatgataatcctcatgaggcgcttt

SEQ ID NO: 70948 - DNA, 8148 bp, Oryza sativa
ccccccccccccccccccggtcggtcgccgtttccgccccgggtaggaagagagccaagagaggaagagaaagaaaaagaaagggaaaagagaagagagaaaagaaagagagaaaaagaaagaaaagaaaataggaaagaagaaaaggaaaaataaaagagaaattaggggagagattaggaggatttaggaaataaaaatggttggggtttaatcgtagattatttttggaaattcctagagtgtaatagtatttcgatcggaattccgggttaattataggaatatatttctcgatcggattttattagaattggtggtagtgaagtatttgtaatttcatgaaatattttaggatgtataaatcgaaattcgatttgcctatttcacgagtagtataattaatataaaagaatcgactttcgcattcgacttctatttggatttatttggatttttatttgaattctaaccgaattcaaatcgaattttcgcacgtaattttagagcccgagggagttgcggatccgagcgaggaccaagacccgcaaagcttcgaacaaggcaagtcatcactattccttgaacatgttgatctcatttgcaaaattattttgtttacaaataaaattgcatgcaatgatgaacatcctacttgtgattatgccatgtcttgattattgtttacccttaaatcctataacaatgatttacgtataagtccctagacaactatgacaaatgcttagaaatgctactctagatttatgcatactcatatttatcaaatgctatgtgcttgggcaattacctttgggaaggtaattgagatgcggcatgtggagacatgagcgccacattgccataatattaatgacatgatttgtgaaaggaaaataaaactaaacaaatgttttcgactggggcggatggaggatttgggtggtatccggaaaaggctagtgccgtccctggtcaattaaggaccgagccatgaagttaagcctgaaacgactcccgtacaaccgtacttctcgaatgggtatagacctagcggattagatagccgagcggaggcagtatccatgcatagtggtttctcattgagtgaggcaggtgcgctacggtgggacagccgttgaggtagggccgcgaggcgtgccctacatcggtgtcgccattggtaggactgccatgagtgtgcgagaaaaaacttaactttaaaccataacttaatatgtgtgtgagacttcttcccccgggagcgccagaactcctcacactgctagaaacatggacgcctagagtgtatgaggatgtaaagttcatggcgcgggtactgccaatgcgaggttatcgaaaggctttgccgtgatgcgtctcatgtgttgggacgaggctcatgtgttgggcagtcgcggagtgcgggtaaagtgtacatccactgcagtgtgagtaaaccaattctattcgaatagccgtgctcgcggttattgagcaccgggacatgtattacacttggctagactctaaattcttaacttgtgtgggatgggatactgcatgaagatttttttatgctgatggagccacttcctgagaggagggaaggtggacgtcctcagaaaaccatgacgactcaatgaggggaagctatccttgtgatcacaatggatggtggacagaaccgtcgttgtctaatgtgaacactggtattaaaacttgatcagtctatgctaggtcttaggcttgtgaaaagaattacaaaacttgctttgtgcaaaagaaccatagccattctttgaataccctctatcatgtgcattgttgctgtggtggtttgctgagtacggttggtactcacccttgtaatatacaaacttaatcagaggtcggagatgaagcttcggaggatccctacgcttactaccaggagggtgatgaagacgatggcgctcagtaggtcttagttacggtcgttgcctatggcgatggcgtgccgctgccttaactccgctgccttatctacttttgcttttggaatgtattccggaccgttcggtcctatgttctaagactatgcctgggggcctatgatgtaataattcgcactagactctcgtgtatgtgcacttggtatttcagctatgaactcgtgagtaccagactacttgatccagggaaatgatactgtttacacgattgattcctgttataaaaacgggggtccacagagctggtatcagagccatacgactgtaggaaagaccaaatggcaccccacccctttctagttggccaagggagaaattcccatttagtaatactttcaaaaaaaaataaaaatgctatgtttacaaaactctatacgattttcatcttactcttaactattttcttcacaaaacaagttttacttttagctgactttggtttttcttaaaaatagatgacagatcaggattcacccactacctgggagatgggcgtaccccactcagagggatacgtcattgagctacatcggttgatgaggcgcctacggtaccccagatttccgatctaccgagtgagacagtgtggacccgtttgggaggcccagattgaggctcatacacgagttccttcagagtcaggctacagctttccgacacgccaccgtcgcgacttaccggagaccgcgatgcaggacgcagcccgggaggccttcctccgacttagctctattcaccgagctgagttggcgagtaccgagtttgctcaccacccgtttcgagaggagagcaactccgtctgcacagtccaggacacaccttgctgctacaacccgatagtgacttgactgtcccgatgtgctgaggcagtagacaacttcgacgaggaggctctgttagagatcgacgaccagcagaggcgtgtgggacagttagagaccgaggtgactgacctcacagtgcagcagcttcagctagaggaggagcatcaggcttggggcagtgagatagactcactgaaggcacagctctaggtccatggtgaccagtttcagcagctatctgatcagtgcaacgatcgccgcgggatgatggatacacttgaggagcagctgagagaaagccaggagcacgtcagccaacttgaggagcaactatagttagcaccacgagagcttctacttccacagcagtagggcgttgtcacgcccagaaattcactagtaatttttgaacttatttgtgcgtaaaatcctcgtccaggaatcagccgagggacacaaactgacaattttatatacaaatccatcataataataacgttacatacttacaaaagaaaagaaaacagcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacatggataccaaaggatggcataatgtagggctcatttgcaaaatctgtatttagcaaacatttgagaattataaaacaatagagtaattaatcatcaatattaatcaacactgaacagcacacccatgctgcacaggcccaaccatcctgaacaaccatacccggctgcacagatctatctctaaaccaggagctaaacaaattattaccgattatattatcatttattatggtgagaagtgtgagactaatcacgaaagacattgttagacccgcccatgaccgcgggcacggctattcgaaaagttttactgtggccagaggtgtaccactgtacccacaacatgtcaccatgcgccacaacatgcgcctcaataccaccacggtacctctgaaaggagctgtgacattacccctcgcacaacacaatccaccacagtgcaccgttcccggatcatagtcacccccttataaacaaggcatggactccccagcgacccccgtgggcttatctccgccacttctcagtctggtgctccgcaatgaaccatgctatacaaaaggtaaagccgttgcctacgctggcttgtggttggcacggttaatgtttcacaaccgaaactcgtgaaccggttcttaattgtcatgagcacgactctcaaaaccatgtgctcacaacccaccattatcaagttttaattggcaagtaattaattaaccaatcacgattggccatcgtgagctatcattaagccatcattaaataatagtgggtcataagttatcccaatagtgtgctaatgtttctaagcatggctaagcaatcatatctaatatctagctgaaccaatatatatatagcccaactagccaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccatgctggccttggaactcttcaaattcttctcctgtgaaaacgaactctccggaaacgtcggaatctaaatagaaaagagcaaaaacaccaaaacagcacataaacaagcatgaacagtacatgtggatatttttaacatgtagatctcaattttagaaaaatttagagacttgaaccaactaaatccgagctaagatggattagttatgaatttttaaagattaaatcggattaaaacacttatatggattttaactgaattatgacgcaataatgaattatttttgaaaaggaaaagggaattattgcgtcagcggctagggttcacggtggaccaggtgcacggcggcgtctcacggaaactaacagccgagatctttccatctaaaatgaacggccgagatcgaccggtccacggccggacaacggcggacggcaacgatgatgtcggcgatgacgtcatcaccggcgacggctcggcctcgcatgctcgccggcaaacgacggcacgacagcgcgtacggaggacaccaacacgtagagggcgacgcggcgaactcaccggtgaccaaaacaacggcggaagatcaacggacggcgacggcgtcgaggaagagcggcggcgacgatcggcttgacgacgacggcggtgttccggcggtcgacagcgacggcgtagggcggacgaggacggcgacgcgatggcgaccatggctgtgacctccccgagcgacgacgacgactggagcgacggcggcgcacggctggagcggcggcgacaacggcggcgggaggctacacggtgctagggcgctaccgacggcgagaggcgaatgcaagggtggcggcgggtagtggcgggcttgggggtccttttaaagaggcaaggaggcggcggcgaaggcccacggcgaccggcgacgagaaggaaagattagggttcgggagagagatcgatccgaatcgaactcgaatccgcgaatttccaaacgaaattagccgacgattccataagagaaaagatagaggggatcccggggatcatttcccctctactgatttcatcggaaacggaaaggggcggccggattttgaaggagacggcggcgcagctcggttagggttcggccggcggccggccggaggttgacaacgaccctgacaggtggggcccacctgtcagcgggagagagagaggagagcgccggctcggttgcgggccggcttgggccggggaggagagagagagagggttttgggccgactttcggcccaaagccaaaagaggattttaaaacctttttcaattataattattcatgaaatgcaatttcatttattaaaaatacttccttggctcaaatatatcccagaaaaatctaggaactatagaatcaaccaaagtatttaatgaaattttatctggccccattttatattgggatttattaattaaaattagatcttctcttctaggcttttaagatcatttctaataattcccttttagacaacaatttataaattaaggatttttaaacaagaaaagcacttaacattataattagatcattaattgattactaattacttaactgttctttgtatcatttaggaattgagctccgaaaaaatccgagaaaattttagagagtataattaatcatggagaatttaataaaaattaaatccacccatgctttatatttaggaaattttatttcccacattaaacttcacttgtaaattaatgaacattaaatataaattctattaatttataaaataatttataaatcctgaaacgaaaatcaggatgtgacaggcgtgaccgctacttcttccttaccccgccgtacccgccagcgttccacgctctgttgggagaggttgatatgctagctaccgagtcagcaccttacctggtggacccgacagtgacacagccacctgccccggagattgtgcacactccactgatctccactccttcaccgcagctgggttccagtttggagactccgatccaggtcgactccaagacagaggggaccgacaccgagccagagatagagccggacatcaccgacccttcagaggacgagactcctgtccaccgcatcacctttgtcggaggccctcgtaccctcagcactgcctgcaagagcacacgaccctcgggcaagaagcccaagctagatccagagacccctacttccgagccgtggggactcaggtttgcacgagccagcgaccaccctcttcctgccccaggttcctgcggatggttggatgactagactggaggactattgcagcttcgatctcgcttcagatggtttttggatagcatgcgagacacacccccctacctagattgacgagtagcttgatgattagttcgatgtaccatttggatgaactttatttggactgcgtatatgtgcagtcgattgtatcatgatttatgtactatctgtggaactctgtgttgttatttatgatattttactgttgtgttatgaatgagtttattccaccatgcttgcaaaacaaagttcacatcaaaacaatttccttaacggaataaaaccataagggctagttaggaaactaggttacttacctaatcggcctacacagatggcaagccgacgtcgggcatcaaccagcaatgaagagactcaagcacccgacctaaccaccctggctggcgttatggccacccaaacccaacttctgcaaaccattgcaaacaatcaaggcaaccgtcgaggatcgaatttcactagtaatttccgaacttatttgtgcataaaatcctcatctaggaatcagccgaggtacacaaactgacaatttaatatacagattcatcataataataacgttacatacttacaaaagaaaagaaaatagcagcggaattacggtctagcgaagctccggctccactcccacaggcagctcaaccggggtataagcaattatgtctaacatctagctgaaccaatatataaagctcaactagtcaaattataataacccaaggtatcaaggaatagagtaatcaatgcaaattggccataacaaaggaataggttcacaccacccagtgacattcgaaaataaatgcacagttgaattaaatagagaatttaaatataggatcaacatgctcaaaggaattgtgtttaggatctgtgtgacttgccttgcaataacgggtcttcaattaatcttcttgaacacttccggcgcactcgcgaaccttcggaacgacggaaacgacaagctaacacgcaaaacgagaaaaaagactaataaaaaccaaataaacaatacataaaaagtaaacaaacatgtagatcatgattttagatgaattatgagacttgaacggcctcattctgacttcatatgaattaattacgaattttacaagattaaatctaattaaagcccatttaaaaaggattaaataaatttaattcaatttatggataattttaatatgtagatatttattttatacaacttttgaaacttggaccacattaaaccgagttacaatgaat

SEQ ID NO: 70949 - DNA, 8573 bp, Oryza sativa
tatgtaggaaagcttcctcatcaaacaaatattactgacataaatgagtttcaaatgtgagaatatgagcatcactggcttcacttgtcaaaccaaatatgtactgaatgaacaaaaaagtaagatcaaaacctgctgtagatgtatcagtcaagcctatgcccaaaagatcctgtaggaaatcattaggtgctgtagtaggggcggaagtagtcgcaggagcatcgtcagaacttaaatcaagcaaatcagctagaggagccggtggtggctttgctacaccatttggaagcttaagcgagcttccaggagttgctgcagcagctaatttatctgatgaaatagttgcttgtgtggaagcagctctcttagccaagtaactagcttcatctatcacaggcatccgctcaagcaaagatgatctgttcatacaacagcatcctcaaggttaatctatcttacagaaacaaatatattagagaaagcacccacagcaatggcagaatctgtcacccactttatagactgatgcctctgtataatggagttgaattcaattgacctctgttgtagttcaagcacagtattccctttattctgtgcaactatttcctttatcctcctggcaataagataacagagtatggtgacaaaatgcaaaccatcttgagatagatatcacaaatcacgctacttatattaaaatatttgcaagaggatcaaaagaataccacacaaagactaacagaaacttcaaacaaagggttggtacattagctttgtttttccatcacaagcaaagttgtttggtgctaaaatcatatttgtatccatgtaaagaaaggtaaagtgaaatgaagagagatttgttaccaacaagtatggcaatcagctcgtgaacatttcaatgttattcagtatgttaattaacaagaaaccagttcataagaaactgagtgacctacaaaaatgtttgaaaacaaataaatatttccttcttcgtggcaagttttcattatataataagcacaggcagtttgtgctcatattaggacaaaatcagaatgggatgatcctgtggcaatagctgttctacctcagatcaatcaataacatgaaaccagaacgactgaaataattaagatagctatacaattcatttactactacaaggtcaagttaaatgataacttactctgaagtcggtgggaatcgggaagagagcttcaagagagatactagacacatagcccgagttgtcacgtctgcagagtatcgtttaagagagacctctacagcatccacggcatcagattctgttacctgaacaggttacacaaaaaaaccaagctgttttaaaatttttaaactggaaaagcaatggtactaaacgaaaaacatactgagaagcaccagcatacactggaaaagcattgaactaacaaactgacgaattctataaagcatttcgtggtgaaccatctacaaaagacatgtggataggtggaaatgatttatcatgtagcttttccttttgaccatcattacatatagcacttgtaattcggtaattccaagttgatcgttacaagaggtattatgagacacttttagtgtgtctaagagttatcacttatcagtcctaaaaataaactaagccaaattgaaagcatcacatgcctgaacaagaactgcagtaatgtttaattgcatcctgacttcttggcagaagcatgcagccaatgagaatggtggcaagaattgttaactcaccgtgattggttcctctatgtccagcataccaacattgttcaccagcatttcaccatactcaccaatgcaccatacagctaccctaaccaaactttcctaaataattcaatgtagaagagattcaggtatgtcagataagtagcaactcaatggtatagatcataaagaagactgactatttctccatacctgttcaccgcaagctagcaatgccttgtataatgatctcactgagtatccttggagttcagatgcattgcttattaagactattagagcatgccatacatcgtccttcacataatttccagcctgaggatgtacaaggtaacataattcaaacaaaatggatttttactgattgaacggtgcaagagaaaatatccccatagttgtgcttctgtacataccagagataaaaccttgaacatctggtctaagtaccaaagtttatcttgggaaaacctatttgaaatgctacattattattgtccataaatcaacaggagacagaaaggtataaatcaacaggagaaaaaaacaaaattgaacaaatataataaagggacaacacaggtaaatgtcgtaaaatgaaatacttgttttataggcttatagcctgttaactaaaccaatgcagaagatagtgtattatgttatgttgatctgacatgattattatcctcctgatagaactatgtgcaaatcctttgctatgtaaagaaaggttaggaatgatatgaaaaggaaggaactatgtattctcgttaaacaaattgtctacccttatttatatttccctttgctccacttggggtaggaaataatactgtaccgtatgtgaagtttcaccattaattgtataggatgagtatcctttttgattgtctgttacgtttcaaaatgcatgtaacaacaggatacaaaggacctttgaaacatttacagaatatgcaactaagagttcttacaaaactagtagagatgacatccacgaaaaattgaccctgaatcaagtcggtcagtaaaaaaaaagataaggagggggttatgctacgtcaagtcttacttttcaacaattgagcatatctttgctgtgaggtcgtccttgaagtcctgatcacttacttccaggtaatcaacaagctccttggtcaaagattttgcatttgcatcgttgacaagaaggtaaacaagttcaagggcccttttgcgaatagatacatcagcatcctggaaaaacatcagcagttacgaattattgaagtgtaaaagaaaaggaacaagaaatctggtaacaataaagtgaaagtgaatagtaggcacatcaacaacgcaaactgcagtagacataaaaactatggcaatgctgtttttttctttaaaatgatcatgcaatcatcatttactacgggatcaagcagaagaaattttccttaatgcactcggctaaacctgactagaaatgcaagaaaggaggatggtctgcacttgtcactagttatgattagctgtagtctcaagaagtgcggaaataaacagtatactttcaggaagctaccataggtgtgtctcagaattttacatacatgagcattattttacttccctagaggaatgagaataaatccagagcacattaactggagaatttaccttgacacactctaatattgttgctctatgcctctgcactgcttgcgtgtctacctccatggccttcataagcatgttcagagcaacatatctgaaagcacagtatgcacactgagaattatctctcatatggaagaatattttactagtcaaaacacctaaatcatacaaatgtgttattccctccatttcatattagaaggcattttaggtttgtcctaagtcaaacttcttgaagtctgaccaagtttataggaaaatgtagtaaaatctacaaaaccaaattagttccactaaatccaccattgaatatatttttgtagtatacttttttgggtacggaatgttgctacgttttcctatactagctgaatgcccatgcgttgcaacgggaattaaaagaagactttaaaacctcaaacattaaataaaatggtcccattgtaaatcattcacatcatatttttcatcattttgtatatcactttaaaataaattttccttgtgtgatggcttctggttggggaagggataaaagtccacctatctcactatttggggacccacaaggtagtggtggtaggtggtggcagattcaccactcaccaccacaattagggtcttttaaaggagtatagaaacttggtccaattcatagtacaacttactcctataatatgagggagtacaaaagtaatagtccaattcatagtcaatcataagcaccaagcagtagtaccttgaagtttggaacaatgctcagggtaagtaacccattgaattacaagaaaattaactagcaaacttttactttaaaccctttattcacaaaagttaagaggcttgaacatcagttgtccaagagaaaagagtgaattacctgatgttattatcacggttggacagaaatctacccaagatattgattgccagcacacgtaaaccactagtagcttcgatgcccattatagtctcaacacattcatataaaatagcatttcctgcgttcttatttgactcagtttttgttgcaacctggaaatgcaatgcaaataattcgatataagatacagagcacagctgcgggaaagaagacttcaacaaaaaacatggtttactaaaagaataattcaacaatgagaaaaacataatcatatcactgagttcttaatccaagagtaacaaactaacaatgctacaagacctaaataaatatctgggattagtaccactgaagacgctcatttcgatttacaatacattaataataatgcaatttgtgagggtgtaatgatcatgaactgtctacaaaatgatcagaacagatgtgatttgcatagtgaaatttctgttgtgtataaaataaaaacaaacaattcacctgagcaagaatatcattcacaaactcactgcaatctgcatctccttgacccaaaattcgcatgagcttaagcactctgatatgcaagaacggatccgtaattccagcaatgtcatattcaggagcatatgaactattggacacatctctcagtattctgaccaaaccatcaaggcagttctgtagaacgaaaattttatcagaagtactgccgcaaatgaatacattagtttgatatgatattgtaggtatcagcaaccaacaaagtgaacacactatgcgatagaacacaaaaaaatcctgcctctttcaatgaacatggtattgggtcaagtgtcacatacataaacaatgattaactattatactaatgcttttaaacgactctgtagtgtcaatggctcaatgcatcatcaaatgaattatgaggagcaggaattggggttgacagtttggaatatataggatgctaaataagcagggatttagccataggttattagtcccaagtcccaactgttaactagtctgatggatctgaaaattctatggtggtgattccaacctttagccggaataattcattattcagaagaaacgaataaaatcaccaaactctgcacttccagtattcggcaaacatcatctctagtcttcctatcaaccacgaccacaggaacttggggactgtactgcattcccagctttcccaccaaacatcataaaaccatcggacaaaggattttttgtacagttaaaagatatacagcaagtgtgtcaacgcctcaacagacacatcaccagaaaccctattatctactatttgtgcctacacatggatgtttggatgttcaaacatcataaataccacactgggaaagcaacaaatggttcaacaagactaaatcaacaatactcgtatgattttaacttgatacgttcaaaaaggtataagtttcaagtcagtaatttgggcatcggagacagtagagtggcagctggcagtaattagatatcaagaatctgatgattggtaagagcaaaaaaactgaaacaaataagacagtttggtattattccaagggctttactgaaagggtatgcgttaatatggaaagaggagatgaaaataagtaatttgttacatagtaactttgagaatgcaaacagaaggtaataggcagcattgtccaaggaaaaaatataacggttcctagaatgcatcgtaccttcctcaggtactccaatgcctctttgcttgctttacaaagttctgcgcagagctgaacagcagatatgagaaccccgtgatgtttttccttcagtagtgaaacagcagagcccatgaagttctctgccaaatctggaaccttccgtacgatccttatagagcataaggcagcctacaaaacagccaaacctgtacaattagtatgacaattcacctcaagtatttcagaaccaaaaacaacaaaggcaagacacctttgcagggtgaaacgacagggaaataaaaggctcgacatgtaataagctttgaataatgatggtatagacgacaacacccacaaaacaaagaatgattgtttgagttcaaattgacctttgctaacttacccagagcatatgctatgagctattaacctatcacattacattattacgatttacaagtactaataaacacagaacaagactcatggaatggacatactgacatcatgctaaaaacagacttcagtagaaactataacatcaagtctaaagtaaacatataccttcttcttggtatttggttccctactttgcaatagcctctccacctcaggtgacagatcacgcgccatttcagcggagcaaatgttgccaagagcacagagtgcaagccccacaatgaactggttcgagtggttaagatctctgtccgcgttaagtactaccaaatgctcaaagcagaacatagcattctaagaaaaatcaaaacagatatggagcataagtatagtatgggtggatactgcttgagcgagttggtgacgagcatgagcacctcctgccgctcgtcgagcagcagcatgaggccgaggtacccgatgcgcttctcggggaagcccgcggcggcgatgagcttgaggcactccatctggccgaagtgggtggggtacccgagcatgtggatgaacatgagcttggccatgttccggtggcggtagtcctggtccccctcgctgatggccgcccgtatcgccgcgcactcccgccgcaccaccgcccgctcctccgccgccgtcttgcacgcgcgtatcgcccgtatcatgtccctgcaccacaaccacgcgcgcggatctgaggaataggaggggatacgagaggagacgcgggtggtgatccatccgaggcgagggggagagggctaaccggaggcgggtgccggaggagaaggggttgatggcgaggtccatggcgaagtcctcgacgatcttctcgacggaatccagggtggggcgacgggggagggatctcgccgccgcggggcgtggggggcggcggcggcggcggcggcggccgggtggatctgggaggaggaggagtaggcggtggcgatggtggtggtggtggtggtggtgggaattgcgatttgcgaagaggcccctctcgctcgcgttggggttcgtttttttgaggattagttggggtgatttgggatctgatccccaccacgctgacctcactggctcactgacatgggtaattccaagtttccaacggtgtcgggaactcgggataatcaacgtggttcacttttcatctttagcattctttctagggactgtagcataagattttagtacccttcgattttatatgaaatcataggaaaattagggaattttaatcctaccgaaaaattcaaagcctttgaaaggattgaatcctatctactcgtgttgttttgaaattcctatggaacaagaaatcctataaaaaatttgaagaaaagttagcaagtggtccaactccttagaaaatttcccttgtgcatctctcattcgattcctacgttttttttcagcctaatcaaaataccatttatgtgtctttccagtgttccgtaatttttttttacacttccattcatttttttattccttcgttttttctaatcatatgcttcaaattagcaatcattcatgtattgtttccatgtgttttgcagtcatatttttcatacacttgcattcctatatttcttatccaattcccgcggtctactcaagcaaccatttatatatttttctcctcgattttgcaaacatatgttttatacttatattcctatcaacatcacgtacttctaattctctatgtttgtcagtcttgcgtttcaatggaatccttagtggtatatgaacttccttaggtgacattagatatatagtacttatactttgtattttgtatatcatgaacataattgcaacttgttttccacggataaaaatgcccaaactatatagaggtgacaatagtgtaagcacgaggcgtgcaatggatttatagtaagtggttgtgtcaatttcaattgaatatggcaatataccgtgttgtgtttgtgagagtgtatttggtaaaaaaaggtatgaaattcatcagtgtgttatcttttaagtcaaaagctttaatgacaaatgtttcatcatacacatatagttaaccttgtgggtatgaaatgctaaattacctaatgcactaaaataagatc

SEQ ID NO: 70950 - DNA, 4349 bp, Oryza sativa
taaaccgagttacaatgaattagttatgaatttttaaagattaaaccggattaaagcatttatatggattttaattgaattatgacgcaataataaattatttttgaaaaggaaaaaaggattattgcgtcagcggctcgggttcacggtggaccgggtgcacggcggcggtctatggaaaccaacggtctagatcaaccctatccaaaacggacggccgagatcaatctaatccattgcgggtctacggctagcgtcagcgctgacgtcagcaacgacgtcatcaccggcggcagctcggcaacgcacgctcgccgacaaacgacggcgcggtggtgcaaatggagggcaccaacgggttgcaggcgacgcggcgaaccttaccgaggcacgaatggcggtggacgacgacggcgacgaggaagaagcggcgacgacggtcgggttgatgatgacggcggtcttccggcgatcctcggtgacgacagaggggtggacgaggtcggcgatgacgtgatgaacccgacggtggccttctcgagcgacgacgacgaccggagcggcggcgacgcacggctggactcacggcggcggcggcggcgcacgggcactcgtggctagggcgctacgagcggcagcaagctaagacgaggttggcgacggagagaggaggtcccggggatccttttataggggctaggaggcggcgacggaggcccatggcgaccggcggcgagatggaaggttttagggttagaggagagagatcgatccgaatcgagctcaaatccgtcggtttccaaacgaaactagacgaagattccaaaagaggagatcccgaggatcatttcccctcaattgatttggccggagaaggaaaggagtggccgaattttggaagggtggcagcggctcgggcggctagggcgcggttacggcggcgcgaggttgaagactactgacaggtgggccccacctatcagcggcaccgagagagagaggagggagggcgcggcggactgggccggcttgggccgggcgcgagcaggccgaggcgaagggagagacttgggccgacttgggcccaaagccacaagggagattttaaaacctttttctatttaaattattcatgaaatgatattccatggattaaaaatacttccttagctcaaataaatcccagaaaaatctaggaactatagaaacaagagaaatatttaacaaaattttttctagcccacttttatgttgagatttaacaaattaaaattagatcttctcttttaggcttttaagatcatttctaataagtccttttaaacaacaatttataatttaaggatatttaaacaagaaaagcacttaacattataattagatcattaattgattaatttaatgattaactaattactgaaatattatttgtattattaagattaggatttgagctttgaaaaatccgagaaaatttcagagagtataattaatcatggagaatttaataaaaattaaatccagccatgctttatatttaggaaattttatttcccacatttaacttcacttgtaaattaatgaatatttaatataaattctattaataatttattagataatttataaatcctaaaacgaaaatcaggctctgacagaccgacaccgagccagagatagagccggacatcaccgacccttcagaggacgagactcctgtccaccgcatcacctttgtcagaggccctcgtaccctcagcactgcccacaagagcacacgacccccgggcaagaagcccaagctagatccagagaccactacttccgagccgtggggactcagggttgcacgagccagcgaccaccctcatcctgccccaggatcctgtggatggttggaggactagactggaggactattgcagcttcgatctcgcttcagatggtttttggatagcatgcgagacacaccccccctacctagattgacgagtagctgatgattagttcgatgtaccttttggatgaactttatttggactgcgtatatgtgcagtcgattgtatcatgatttatggaccatttggggaactttggtatggttatttataatattttactgttgtgttatgatcagtttattccaccatgcttgcaaaacgaagttcacatcaaaacaatttccttaacagaataaaaccataagggctagttaggaaattaggttatttacctaatcggccctacacagatggcaagccgacgtcgggcgtcaaccagcaatgaagagactcaatcacccgacctaaccaccctggctggcgttatggccacccaaacccaacttctgcaaaccattgcaaacaatcaaggcaactgtcgaggatcgagctttggagtttatgaggactaagccacacacattcgctacggcagacaagcctatggaggcagaagattggctatgcatcatagagaagaaactgacccttgtccggatgcgcgaagccgacaaagtgatcttcacagtaaaccaactggagggaccagctggcgattggtgggatacttacaaggaagctcgggaagaagatgctggagaacccacttgggatgaattcactgcagcttttcatgagaacttcgtgcctgctgcggtgatgcgtatgaagaagaacgagttcagaaggccgcgacaaggaaacacaacggtgcaagaatatctaaaccggttcactcagttgacccgctacgcaatcggagacctcgcagatgaagaggaaaagatcgacaagttcatagaagggctgaatgatgagttgcgtgggcctatgattgggcaagatcatgagagtttccagagtttgatcaataaggtcgttaggctggaaaacgaccggaaggttgtggagcacaatcgtaagaggaggcttgccatgaaccgcccacctcaggtggcaactcagcatcctaaaggagctgcctcatcaggatggaaaccaacggtggtaacaacgaaccgtcctaccgcacatagcaacttccacaggccggttaccactcagaaccgagctcctgcaccgaatcaggccgctactggagtaatgaggccaggaagctgtttcaattgtggagagtatgggcattttgccaacaaatgtcctcatctaaacaagacacccattcgcaccggagctaatgcaatggctattcacggggctgctacccctgctggtggacgaggtctgttcaggactcctcagactaacaggaccgccccggatttggacgcggacaagtgaaccatgttcgagctgaagaggcccaggaagaccagggcgtactgataggtatgttttctatcaattctaccccggttaaagttctcctcgattctggtgcatcgcattcattcatatccttggaggctagtcaacagcacaacttaactctggtaggagttagaaagcctatgatagtacactcgcctgggggtgaggtaaccgtaagccatgcttgcatcgacgtacctattcatcttagggatgtggtgtttccctccaaccttatggttttgatacctcagacccttgatatcatattgggcatggattggttaacaaagaacaaaggaattatcgactgtagacgtagagaggttaccctgaccacgccctggggatcggatatgagagcaactatggatcaagatcctagattgactgaacgtgccggaggcatattcaccatgctacctatgaaaggaatgcccgtagtgcagcgattccccgatgtatttccagaagatttacctggaatgccaccagatcgtgacatagagttcattattgacctgatacccggaactgcccccatatcgaagagaccatatcggatgtcagtcaatgagttggaggaacttaaaaagcaaatcagagagttgcaagagaagggatttgtacgccccagttcgtcaccttggggagccccagtgttattcgtcaaaaagaaggatggtagcatgagaatgtgtgtggactaccgctcactgaacgaagtaactatcaagaacaagtatctgctaccacggattgatgaccttttcgatcaacttaaaggagctaaggtgttctctaagattgaccttcgatcaggataccaccaactgaagattaggatcggagacatacccaagaccgcgttcttaacacgctatggattgtacgagttcacagtaatgtcgtttggtttgaccaacgccccggtatactttatgaatcttatgtacaaagtgttcatggagtacttggacaaatttgtggtagtattcatcgatgatattttaatct

SEQ ID NO: 70951 - DNA, 1166 bp, Oryza sativa
ctggtcctggacagggatttaatgcacattcagcttagaaattctggtttgagaatttcggggcgtgacaagttggtatcagagccgaccttgaccgtaggacaagccaactggaaaccctaagagccctctgaacccctttttcatctgcatatgccctttttgcacctggaattgtttcgggaaaatttggagttttgcctctttggtttgcgggaaaaatcttgtcgttctttcgggtcggatttttttttttttaaaaaaaaaaaaattattagctcagcctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccacccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggcagcgaagagccgatcaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcggcaagcacagcagcaacaacagaacctgcagtttggtcctccacctcctcagtccaaactgttagaatt

SEQ ID NO: 70952 - DNA, 956 bp, Oryza sativa
gtggtccatcactgttgtgtatgggcctcaattggaagccgataaaattgcctttctctctgaactcgaaagcttacaaccctccatgaaacgggcttggttgattattggtgattttaacctcatctataaagcttcagataaaaacaaatgaccgcctcaatagaagaatgatgcagcatttccgtggcctcttagacaaaatccgggtgaaggaattgaatcttcctggccgccgtttctcctgggcaggacaaggcgcaaatccaacacaaactaagattgaccatgctttcgttaccactgactgggatttaatgtttgatgggtccaacttatatccactgtcttctgcgtgctctgaccatgcacctctccttttagttggaaatgagaaaagaacgaaatttccaaatttcagatttgaatcctgatggcttaaaattcctaggtttctggggattgtgcaggattcttggcaaaggccaattctcgccacaaacagcctagccaatttccgcttgaaactacgacgtcttgcccgcgacattaagagatggagccgtaatcaagttggagatatcaagttacaacttgctgttgcatccgaagtgatattccaactagaggtagcacaggaaaccaggaccttgtccaatgaagagcgtcttttgatctctaatctcaaaaccaaattttggctctcttagtcctaaacaaaattcagattaggcagcgctttaggcaaacatggcttaaggagggagatgtccactcaaaattctttcacattaaagtcaacttcaggaaagaagaacttcattccatcgctgcatacaccttccgggatagccatttccaccccagataaagaaggggaattgttccgtttcctcaaggaaagacctgggacatgttttcaaaaaaggccaggaatcaattggaatatgaaggaa

SEQ ID NO: 70953 - DNA, 10540 bp, Oryza sativa
tgcttaggtctagaatcgtgttccaaaatagcttttagcaactaagtacctctaaatgttgtttactgcaaaccctaacccctttatattataactccttggtactcccttgcatttattctgcacttgtgggtgtgtcttgttgagtacggtggttgtactcagtcttgctcgatttttcccaaccccagaagaggagcccttgaagatgaaggctttggtgtctagctcgtgcctgccgtcaagcgcctgtggtcgtcgccctagtcttccgctgtttctcgtttgtctctgtgtgtgctgggccttcgctgcccatgtaataaattaactattcacgcttccgcttgttaaactctgaattgtatcaacttttggtgtaccttgcctcctgggacaaggattaatgcacgcacgtaaggaacgcccgttgggttatttccggtcgtgacagcggggcaccagactgagaagtggcggagataagcccacgggggtcgctggggagtccatgccttgtttataagggggtgattatgatccaggaaggtgcgctgcagtggattgtgttgtataaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaaagatgcttaaattggtaataatttgattagctcctggtttggaatggtacattcctggtttggagatagaactgtgcagccggggtggttgttcagaatggttgggcctatgcaacagggtatgttgtatagtgttggattaatattgtttaattatcacttaactgttttataattctcaaatgtttattaaatgctgtttttgcaaatgaaaccctactatgccatcctttgttatcctgtgcacttgcatatttgctgcgtggcttgctgagtatgtcatatactcaccttgcaatcattcatcagaggaagagttttacagtgatgctgatggtgtggaggattaggtgtagccttggtccagctgcctgtggagtggaaccgtttgccccgtttattttattttccgctgcttagattttattgattgagaggaactatttacctctgtaatgacattttattggttaattaattaaagtaataattggactttattatccatttggtaatgtgtgcctcggctgatttctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttgttagtactgtacatctattactgtactaacgactcattcatcagcaaaagttttacaatattgtttcatttgatcttgctacaataaaataaatttagcatgttgattttataactttcttttatttcttttgaaacctgttattcaaaagtacaaaatttgtaacctcgtttccaactgttttaaattatcttgcaagcttggtttactttacttacctttttactttgaatttctaaactttattcaaattaatccaaaaacttgtgctattaattggataaaggtcttaactctctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaagagaagtgccgaatcaaagtcaccttgaacagcaatagtgaagatatcccctcagtgatgttcgaagctggaggaagaaactacatccatgcatgtcaggaagtggcaaggatcgccataggagggctccgtgatcgctacagtgatcagttggccgacactgagtatcgctaccatcctcgtcaacctcagggaagtgatcgtggcagttaccttgagactgaaggaattgagaatgatgctaccacaaggcatttggttgagatgttgtgggctagggatgaaagccgtgcagagactgtgttagcagctcaagatcgtgaagatcggaatcgtggtaagatttgtaagctagaagacaaggtggatcgtttggaaaaggaattagccgcattgaagggagaagcaccgccgcagaaggccaggattcgtcttaccgcaaggaagagagctctatttgtccctcgttatcaattggcgccaaaggttcgtgtggtggagaaagaagttgccccaaccctagcggatcctccggtcatgatcataagtgatgatgaagaagaagaatccaagcgcaacaattccaagattgagtgggtagcaactcaagatgatgaagacgagccaaatgagccttcaatcgacctccgatgcttggaagaactagagtagcttgttaagccgttgtcttagatcgttgtgttagtttgcttgctttaagttggttgtgtgtgtgggtcttgcatgtgctttacatcagtggtgggatgtaagtgcatgcgtttgtttgcttttgagtgttaggaagttggtgagtttagtggtgtgagagtcttcagtttgtaataatgaaactcagttaagatcaataaaagctaaagtaattctctgtcctaaatagtttcccctggtttctcttcttgtgccctgccagatggtgaatactcgcagcaacgggaatggtcccaacaaccccaataacaacaatggagagaatcccactcttgctcaagttcttgctcaacagacacagctaatgaacatgatgatgcaacaacttcagaatcagcagaaccaaggaaataaccatgtacctcctcagaataagttagcagaatttcttcgtgtgaggccgcctattttctctagtaccactaatcctgttgaagctggtgattggctgcatgccatagagaagaagttggatttactttagtgcactgatcaggagaaggtctcatttgcatcacaccagttgcatggccctgcctctgaatggtgggatcacttccgccttaacaggactactgctgaacctatcacttggcttgagttcaccgctgctttccggaagacgcatataccatcgggagtggtgtctctcaaaaagaaggaattcaggtcgcttactcagggatctcgctctgttacggagtatctgcacgagttcaatcgtcttgctcgttatgctccggaagatgtgcgcaatgatgaagagcgtcaagagaagttcttggaaggacttaatgatgaactttcttacccactcatgactggagattatcatgatttccagaagttagtggataaggctattcgtcaggaggacaaatacaatcgcatggagcagaagaaacgccggattgctcacttcaaagcacaacaggggagtaatcagaagccgcgtcttactttaggaccccagcctatgcctgtcgcgaccgggaaaattgccttttcccgaacgctagtgtattaatccccgtcccaggaaaggccggggtacaccacacaaacatgatatagaagacacatctttattacatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggagatgcacaattaatgcaaaggagtacaaggggataataatataggggttaagttttgcagtaacagcctttaaaagtcacttagttgcccaaagccattttataaagacgatcctagagctacacagtattattaaacaaggccgtgaaccctcacgaacctgccttaacccaaggcctacgatggttcagaccgaactggcaacccgaccctgggtcccagctcgtcccaagccaacccaggccaaccattccacattttagttgttgagcaaattttaagaattagaacactgacttgggtacattgctcggcttgcccatatccgagggctcggctattcgaatagatttactctgatcagaggtgtacatctttacccacaagacacatcttcctcacgtgtaaccacgcgccacataccaccacggtatacggacggaagacgtgacatagtttccaacccatcctagccttagacaagagtaccgacccaatcccacctacggccgggatacccgggacaggcaggcggaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccattagacatgtggaagtacggtagtgctttgcaacagaggcccaagcttaatccttatagtacccgaggtacgactaacaaaacccaaccacgcacctcgagcccagcctaaaccattttgggggttttgaaaagagggggaggtgtgtgtccaattccaacataagccaaccattccatagtgtccaaatgatatgagaattcccaaagtctaaagttataaaaccacctaatgttgcctaattaaattgcgaagcatctacctaaaattaaactagtggtgccatgagtagagtgtccactagttggggttttgtttactctagggtgaacaaggaaataataacaatagcaataataataaggtcataacaagggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaacgccggcttcgacttccacgaaaagcggatcttccgaagctgcagcgtctacacgaccaacggaaaagaaaaggcttacacactaataaactccaaataacaagcaggaacaaagcacaaaaatgggttcttgacttcttaaggaaaaattagagacttgaacggtccaattccgagttcaaatggccaagatatggccctttgaagtttatatgctctttaaatggatatttgcgaatttcttcatttaaattttaattaaaaatcccatttattgcgtcagccgagggaggggacgcgcggaccgggtccacgggggtgggggcccacgcgtcagccgctcggtccacggtggaccgggcgcacgcggctggcggcggtcggcgccgtgggtcccacgcgtcagccgcacccgcgggcgcgggcggctgacggccgggcccacctggcagccgcgagggcgcgcccgagggcggcctcgccggcacggccgacgggagcggcgcgcccgcgccccgatggtcaccgccggcgaccatcggcgcggtggagcggcgcccgagagagcggagggaagggggaaagcgaacggcggtcttcggctcaccccgggacaacgacgacgacgagaacggcggccggagcggaggaaagcggcggcgcggttcgggatgacgatgacgacggtgctccggcggtcggcgggcgaagcggagcggcggacggggtcggcaaccactcggcgaagccgatggaggtggcgccgagtcgggaggaggaccggagcgacgacggcggcgaaacggagctcggcggcgacggcggagagagaggagcacggcgcgggcacgaaaccgacggcgagagcgagcggcgagcggcggaaacggaagagcgaagcacgagggacgattttatagcgtcggaagggagagaaggcggccggggaggaaggaatcgcgcgcggagatctcggccgccattgaagacgccggcgatgattgcgggattcaaatcggacgaatccgagggagagagagagggaaaagagggggaatcgggagagggaaacgcggggagtaattcgcccctctttatggcgcgcggggaaggcgggaagcggcggattcggcggcggcggcggcgctagggcacgggcggcggcgggcgcggcgcggggagggagatgacaggtgggtcccacccgtcagcgagagtggcgggcgggcccgcctgtcagcggcgcgcgcgcgcgggggaggccgatgggccggaggggaggagagagagagagggagagaagtgggccgagccggcccaagagaggaaggggggggaaaaaagaacttcttttagggttttctttttataaaaccttttcaactttgtttatttcttaataattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacaaatccaccccccttacaggaatctcgtccccgagattcgaggatgggttgggcggtcttctcttcttgtctgacttcttccgtcgcgtcttttataacaaacttgcctagcaaaacttctccactctggactgcttggctcgatctcctattgcagatggaatcttctcttcacctgacttatccctggttgaacctttagctgacttcgactgggttgcggcacttgaagatggggattcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagggaaccaacttatcccacttgatatactttgacgtcttcccaaatagttttactgctggacttcttattgtctgatcgttatccggccaaatttgaagcttcgttgttagatgtgattttactctgacctctgtagactatcttcgatcatatcacttggttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctcccaagacatggcgtcgcctggtaaccggggcttgcacttttcactccgtgtagcgtctgataccgagttgaagatttcactccttgccttcatagaaacacttttacctaggtcatcttgcttacttaatgacaaggtgactgttgtggggcaattacaattaggggtcttccttgagcgatgcagagcatgtttctgtttatcaatcacctttcggcctacttctttgatgctagagaacatctttgccaatctcttttatcaatcttctttcggcttatctctaacagggggtattctttaatgtggattgcggacgcttctggggacgatgaggtcctttggcttgctgcctttcagtgaaaccttgatggggttcgtcaaaaactatactgactgtctttgcctttgatccgaaaaagacacatctgaaactcttagtccaaacaaatgtctctttggttgatcacttgattttcttttccatcatcaggttgggtattaactcgaggttagaacatagttcctctgaaatgagaccctaggtctcctttgacagtaaccaattatacacataatcccatatcagcatcttccaaaagaacccccatagaacttgtctgtattacacatttctctccttattacatgaatacaaggcactgctttaaacaaaaagggaaggtgcttaacatcggtacattgtttctgctatggattctgattaacacaaggcctcacgggtacggtgtttgctccagtgaccacaatacgattgggatgtctgattcttgtaaattggcggtaatgtggaggtcgattttgccttggttgcaggcagtccctcgagtaatgccctggttctttgcaattgtagcaaatcaacgtcttctttgctgagctatccgtctgaggacgatcattctgacttggagttggaatcggtggttggaaatccttgctaacattggcatcagtggtaccatagttgctatcaccattggagtctttctcagtgtcaaaattgctaaggttgtcattctgggttccaacattgatactatcattgacatcttggtgaatgctactgacattgcacgctttattcgagtggtcactaatggggcaagaaccatggttgttggtggtatcatcatcattagtattgctagtgttgttgtctgcatcgcgtccgtcttcttggagcaggaactcttgatgcacaacagaagacccggtgatctgaagtggctcagtgcgctgcctttggttaccacatggaattactgggatgttgacaatccttctcttgcagttcgtcattcgattatgctcactttcgagttgcatggctttgtccacaagtttctcaaaatcttcataatcctctaggagtagttgcactgcaagttcatcttttaacccctggagaaacttctcttgtttgtcttcatccgtttccacatcttctggtgcatagtgagccaaacgatagaactcgtgcaggtactctgtgacggtcaaatccccttgcttcaggtagcgaaactctcgttttcttagtgtgatcattcccgcgggaacatgtgatctcctgaatacagaggaaaactcgttccaggtgatggtatgtccttctggccgtgatgcctcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggtttcgttgatgcttctctcattcccattggcttgggttcttgagtcatcggatccatcattcccatagcctttgttaccagtattatccatctgtcacaaggtagaggttgagagggaaagcatacaaggaaagaatagaccagaactagggacaagaccttacaggaactaactctttttgttgatgtgttgtttgttttgcttattctgcaggttgattaagcaaacaacctagcatggttacatcacaacccactgatgcaaaccacgcgctacacacacaagcaaggaacacacgactaacaacactaccctatagggtggcttaggttctgcgacgggttcccaagatcttcactccttcacagctggcttcactgcttcctgcactttctcaagcggatcctgcagtcttccggagcttcggcaaacaactgacgacatcttcttcttcgcaaagctgaccatctagtactaattgaaatttgaagaaggaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaggccggggtacaccacacaaacatgatatagaagacacatctttattacatcgataatatttacattattacaaaggcgcttcaggcctgacaatcaaaaataaacagcagcggactagcgggcctacggctccatcttcacaggcgctcaactgggggtataagccaggactccacctaagacatcttctccaaa

SEQ ID NO: 70954 - DNA, 800 bp, Oryza sativa
acttctttcaatattgcttatttttaatttcgaatttcaggtatttttaaattgtatttccacttggactcttttttttttaattttggattttattttatttttatttcgaattttaattaatcttgtattggtttcttatatggaaacttctttcaatattgcatatatttaattacgaatttcagctatttttatattgtatttttgcttggactctccttttcttttttttctttttctccgattaatctgggaatttctagcccccacaacgaacgtggtgtttcatttcaaagctgttttaataatataatagaaagatagatagatagattatgactttacgtagagggtcaaagaatcgggtgtgcagccgtcttggaatgacgtgctcggtgacatccgccgatctggtgttctggtgacatgcgactcgcaaggaggtggcgaagatcggccgcaaaaacgttcagtgcgggtgtcatccttgtggcatggtcggtttagaaggatagggtattcgaagacaaagcaaccttggtgactcagctatgcgcgaccatgacggatgagtggggaactaattagacagcggtcggtctcttggcgctcataagcgaaacctgaacgttgcgaggtggacccaggcatcgggccaactgagccacggcccaaggcactgaaaagcctattatgcagtacaaaacttcgccatgtaaattcaagtttagcccaaaataaatcctacatggcgttgatatgacatgccacatagatatgatgtggcataatcttga

SEQ ID NO: 70955 - DNA, 3186 bp, Oryza sativa
ctggtcccttatcatagatgggctcacaacgcgggtcgccctagtcgcgctcaactacaagggcggcactcaccgtgtgggaggtcgcgaccaagtagagcagcaacggtttctctggccccggggccaccaagatggggggagaagtgaggtaagctttcaactgattgagagcttgcaccgtccacacaaacggctcggggcatttgaggagcttgaataggggcaacgccctctctcccagcctcgatatgaatcgacttagggcggccatgcatctcgtgacgcactgcacatccctaagtttgctggggggcgcatcctctctatcacgcgtattttctcgggattagcttctatgcctcgggaggagacaagaaaaccgaggagtttgcccgccggcacaccgaacacgcacttttcggggttcagtttcatgcacgtggacctaagactgtcgaaagtcttggccaaatcctgcaacaatgtgtcctggtggcgtgtctttaccaccaagtcatcgacatacgcctctatattgcgccctatttgattactcaaagtaatgcgagtcatgcgctgaaaagtaggacctatgttcttgaggccaaaaggcatagttgtataacagaaggtgcctacaggagtaatgaaagtagttttttccttatcttccctagccatgcggatctggtgatacccggagtaggcatctaagaaagacaaaaggtcgcaccccgcagtggagtcgactatctgatctatgcgcggtaaagggaagggatccttagggcatgccttgttgaggtctctgtagtcaatgcacatctggagcttgctgttggccttcgggacgaccaccgggttcgccagccactccgggtggatgacttctcggatgaagccggcctccaggagccgcgtcacctcctcgcggatgaaggcttgccgctccggggcttggcgccgtaccttctgccggatgggtcacgcacccggccgcacggtgaggcggtgctcgatcacctccctggggatcccgggcatatccgacggcttccacgcgaagacgtcggagttcgcccgcaggaaggagatgaacgtgctttcctatttggcgtccaaggtgccaccaatcttggcggtcttggacggatcatcgccaaggagaatctccttgacgggcacctcatcggccgaggcgaggcgcttcttggaagcgcgggacgcagaggcctccggggcctgcggcttcgtggccgccgccaggttatcagtgcgctgctccgcgcaggcgagggcgaccttgacatcgccacagacggtgatggggccgttgggacctggcatcttcatctggtggtaggtgtagtgggtggtggccatgaacttcaccaacgcgggcctgccctggaccgcgttgtagggcaggttgaggtccgccacatcgaagtcgatccgctcggtgcggaagttggtggagtcgccaaaggtcaccgtgagctcaacatgacccaggggccacgtgtgacccggggtcatgccgatgatcggcaatgacggctggagcttcatccccggggacttgagcgcatcaaaggcagccgaggagatgatgctcaggctgccccccccctccgtcgaccaggacacgcttcatcttgacgttgtggatggtgggggagaccacgagggccaacttccctccctgagcgagcactgtcagatggtcgctctggtcgaaggtgagtttcatctctgaccagcgcgccttccgtgccgcctcgtgagttgggacggcagccagaagctcacacctcatggccttgaaaccgcggcgggaggtgtgagcgcaagcccccctatcaagagtggtgacggttccctaaggtatttggaattccagatcctcactgttgtcgctgtcatctggggggccttcttcttggcctcccctcgccggtcattggcaggggtcgcgggggctttgccctcccgtcgactctgccgcttctcctcatcggttttccggaaccgctcagccaagttcttgaccgagcggcagtcggcgaggctgtgccgataagtgttgtgcaccgagcaccacttgtctgccgaccgaccctcgccagagggagcggtggagcttggcttgtcgccggtggctttctccttgcgcggggcccgtgagggcccatcggccgcaaggacgtggccctcgtcgtcggagcgggccggcttccttttgcccctcctatctcgccgcttagagtggggaacagattcgggggcagccgcagccgccgcgccggtgctgggggagttccagacccacgcctcctccttccgaaccaccttgtccgccagctcgaagagctcggcggtggtcttgggctccttggaggcgatcttctctagcatgcggttgtgccgcacgccgttccgaaacgcataaacgactgcgtgggccggaatgcacgaaatagtgttgcggacctggcaaaaacgatgtatatacgagcggagggactcatcagccttccgctgcacagcatgcaggtccgcctcctctcctaggcaggggtacgtgccttggaacttcataatgaactgctggcacaggtccttccaggagtggatggagtcggtgtcacgtcctgataaattcatcccgaaataaaaatcattctctaaaaggaataatagaattaattaaaattcgaaaagaaattggcaaaccctaaaatacgtacaagaaaaattcaaatgtggcccggagaatttttgttaaattctccttggcctaaaaggagccctcaaattttagtggaattttcagagcacaaataataattgaaaagaaataaacaaagttgaaaaggtttataaaaagaaaaatcctaaaagaagttctttccccccctctcctttttccttcttgggccggctcggcccagtccctccctctctctctctcttcccccgcggcccatcggcctccctcgcgcgcgcgcgccgctgacaggtgggcccgcccgccactctcgctgacgggtgggacccacctgtcatctccctcctcgcgccgcagccgccgcccgcccgtgccctagcgccgccgtcgccgccaaatccgccgcatcccgccgtccccgcgcgcattgaagtggggggaattactccccg

SEQ ID NO: 70956 - DNA, 12301 bp, Oryza sativa
tggcggcgggcccgcctgtcagctgcgcgcgcgcgcgggggaggcccatggtccggaggggaggagagagagagagggagagaagtgggcctagccggcccaagagaggaaggggggggggaaaaagaacttcttttagggttttctttttataaaaccttttcaactttgtttatttcttaataattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacaatgccacagggaggttcttcgtctgttgttcgtccgcagcgtcagttcttcaacaacaatgttggcaacaacatccgcaatcaagctctacgccctgttgcagctccaacacagcaacaacctgccaagagggagcaaggcagcaagcccgtggtgtgtttcaactgtggagacccaggacattatgctgacaagtgtccgaagccccgacgcatgaaggttgtccctacccagagcaactctaccgtaccagcatcaaaggcccgtgttaatcatgtcgctgctgcagaagctcaagatgctccagatgtgattttgggtacgttccctgttaactcagttcctgcaacagtacttttcgattctggtgctacacattcattcttatctatgagttttgcgggaaatcatgggatggaagtagaagatcttagacgtcctttgatggttagtaccccaagtaattaagcactctctttgcaacgtagcccctcggtcagaatagaaattaaaggagtaccatttctggccaatcttatcctgttagaatccaaagaccttgatgtcatcctagggatggactggttagccagacataaaggtgtgatagactgtgccaacagaaaagtaactctcaccagcaatgatggtcgagttgtaactgttcatgcattgtcttctgagtctttaaggtcaagattaaaccaaataactttggaagagattcctatagtccgggagtatcccgatgtgttcccagatgatttacctggtatgccgcctaaaagggatatagagttcagaatagatttggtaccaggaacaactccgatccataagagaccttatagaatggcagccaatgagttggcagaagtcaagaggcaagtagatgatttgcttcagaaaggatacatcagaccgagttcatctccatggggagctccggttatttttgtggaaaagaaagaccatacccagagaatgtgtgtggactatcatgcattaaatgatgtgactatcaagaataagtatccgctacccagaattgatgatttgtttgatcagcttaaaggtgccaccgttttctccaagatagatcttcgatcagggtatcaccagttgagaatcaaagaggaagatatacctaagacagcttttaccactaggtatgggttgttcgaatgtacggttatgtcttttggacttaccaatgcccctgctttcttcatgaacttgatgaataaggtgtttatggaatacctagacaagttcgtggtggtctttatagatgatattcttatctactctcgaaccaaagaagagcatgaagaacatcttcgccttgcattagagaagctacgagaacatcaactgtatgctaagtttagcaagtgtgaattttggttgtctgaagtgaagttccttggtcacgtcatctcagcaggaggagttgccgttgatcctagtaatgtggaatccgtaactaattggaagcaaccaaagacagtttcagagattcgcagttttctaggcctcgcaggatattatcgaaggtttatagagaatttttctaagattgctaagcccatgacacgactgcttgtcacgaccggaaataacccaacgggcgttcttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaacagcggaagactagggcgacgaccacaggcacttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaagggttagggtttgcagtaaacagcatttaaaggtatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaaaacacatcttcctcatgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataactagactgagccacaaactaagccttacccactagacatgtggaagtacggtagtgctttgcaacagaggcccgaaaaccggtccttatatggccgaggtgctactatcaaaaccatgcaccccgagcccagcctaaaaccattttggggattttgaatagagggggcggtgtgaagccaattccacaacaaccaaaccattccaaagtgtccaggtgatatgaatattcccaaagtctagagttgtaaaccgcctaatgttacctaattaaattgcgaagcatctacctaaaattatactagtggtactatgagtagagtgtccactagttggggttttgtttattctagggtgaataaggtaataataacaataacaataataataaggtcataacaaaggtaaataggcatggctaaataaaacagtgataacgcgggaatttaaataaagcgataatgcaataatttaaatcaacctaattttgtaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaaccccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcagcagcctcacggtccacggtggaccgggtgcacgcggcttacgccggccggcgccgtgggtcccacgcgtcagccgcacccgagggcgcgggcggctgacggccgggccccacatggcagccgcgggacgcgcccgaaggcggccacgccggcacagccgacgggaggcggagcgcccgcgcccctctggtcgccggcggcggccataggcatggcggagcggcggccgagagaggggagggaagggggaagcgaaacggcggtccacggctcaccccgggtcgacggcgacgacgggaatggcgaccggagcggaggaaggcggcggcgcggctcgggttgacggggacggcggcgttccggtggtcggcgggcgaaacggaggggtggacgaggtcggcgaggtcgcggcgaacccgaaggaggcgatgccgaagcgggagaaggtccggagcgacgacggcggcggaccggagctcggcggcgacggcggagagagagagcgacggcgcgggctcgattccgacggggagagagagcggcgagtggcggaaacggtggagggaggcacggggagtgtttatatagggttgggagtgagagagggcggccggaggagaaggaaaccggcgcggcgctctcgggctccatcaatggcgccggcgagatttgcgggagcaaatccgcccgtttgaacgcgagagagagagagggaaaaatggggggaaagggagagggaatcacggggagtgatttccccctctttattgcgcgcggggacggcgggaggcggcgggattcgcggcggcggcggcgctagggcacgggcgaggcggcgggagcggcgcgaggtaggggatgacgggtgggccccacccgtcaacgagggtggcgggcgggcccgcccgtcagcggcgcgcgcgcgggggaaggccggatgggccgcgggggagaggagagagagggagggagctgggcctagccggcccacagggggaggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttcttctaagcataattttgaggatgtgttttagagtcgttttgggacgcgacaaacctacccccgttaaacggaatctcgaccccgagattcggaagaactggcgaagagatcgggatgggctgccttcagctcgtcttcacgctcccaggtagcttcttcctcggcgtggttgctccactggaccttgcaaaaacggattacccggttcctggtcctgcgttccatggtgtccaggattttcactggcttctccacgtaggtcaagtcttcgcgaacttcaatttgctctgagtcggcctgctcggatggcactcgaaggcatttcttgagttgcaacacatggaacacatcatgcacgttgcccaaggaggcgggcagctccaactggtaagcaacttctccgcgtcgagcaatgatacggaaaggacccacataccgaggtgcgagcttcccctttgtctgaaacctgtgtacaccgcgcaagggcgtgacccgaagatacacaaagtcatccactgcgaattccaggtcacggcgtcggttatctgcataacttttctgccgggactgtgccacctttagattatcccgaatggttctgaccttcgcttcagcttctctcaggatatcagtcccgaacacttggctttccccaacttgatcccacaatagcggtgtccggcatttgcgtccatacaacgcttcatagggtgccatttgtatgctggcttgatagctgttattgtaggagaactcggcataggggagactcttatcccaggtcttcccgaaatctaggacacatgcgcgaagcatatcttctaggatctgatttagacgctcggtctgtccatctgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgccacgcccgtgccctagcgccgccgccgccgcggattgcgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgatcgctctcgccgtcggtttcgtgcccgcgccgtgctcctctctctccgccgtcgccgccgaccttcggttcgccgccgacgtcgctccggtcctccgcccgactcggcgccacctccatcggcttcgccgagtggttgccgaccccgtccgccgctccgcttcgcccgccgaccgccggagcaccgtcgtcatcgtcattccgaaccgcgccgccgctttcctccgctccggccgccgttcttgtcgtcgtcgttgtcccggggtgagccgaagaccgccgttcgctttcccccttctctccgctctctcgggcgccgctccaccgcgccgatggtcgccggcggtgaccatcggggcgcgggcgcgccctcgcggctgccaggtgggcccggccgtcagccgcccgcgcccgcgggtgcggctgacgcgcgggacccacggcgccgaccgccgccagccgggtgcgcccggtccaccgtggaccgagcggctgacgcgtgggcccccacccccgtggacccggtccgcgcgtcccctccctcggctgacgcaataaatgggatttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagccttttcttttccgttggccgtgtagacgctgcagcttcggaagatccgctcttcgtggaagttgaagccggcgtttgggaaagcgagcaaggcaagtcacgtcacccttgagcatattgaatcccagtttataaaattattttgatttaaattattgcattatcgctttgtttaaattcccgcgttatcactgttttatttagccatgcctatttacctttgttatgaccttattattattgttattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatactgtgtagctctaggatcgtctttataaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccctccccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcagctttgcgaagaagaagatgtcgtcaattgtttgccgaagctccggaagactgcaggatccgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacatcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattcctcccgaggtgcacaacagttgacagagcatcttttagctaatggaggtagagtgtctggtagtgaagattcagatcaagtctcctcagatgatgaagatgcgaagtctccccaaggctttaaccagaataaaatagaacttaaggcatgctctcgttgtggagaaatcggtcatgttgccagctcgtgtgcctctacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaaggtcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacaggggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgttgtagatggaagaagttgtgtctctccccgacctactccaggcctagccaagggcaatcaacctccggagggcgataccaagcagaagaccgtcatccgctcaccagcaatcagaaggaagcttctcctgtgaatgatagcattatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatgtaatacataaatatattcatgtctataaacagtgagcttgctatgcttatggatgattcatattgagaatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacttagggtctcgtgtcagaggaactatattctaacctcgagttaatagccaacctgtggatggaaaagaaaaacaattaaactgtgttgggttaaaaagctaacgagacagtagttgaggataggagttcggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcagacaatgtatttccctgaaggtagtcagtgcagctttttgacgaccacatcaggtttcaccgaaaggcagcaagccaaaggacctcatcatccccagaagcgtccgcaatccacattcaa

SEQ ID NO: 70957 - DNA, 3095 bp, Oryza sativa
gatggacgatggtgcatcaccaggaaatctcacctatggtcctcgtggtggcatagacgccgccgggtggtggtggtgctccgtccaccacgcaggtggcggcgccgggatcacgcccggcggtggtggaatgacacctggcggaggtggcggcggcgacagcggtcgtgacgagggcggtggcgctggcggctccccgctgagctcgggcgcacctggagcagaaggtgctgtcatcgtcggaggattccatgggccgtactccaatgcgttccccgccggctggtgcgtccattccggtaccggccaagctgccgtggccggagtcgagaaaccgatcgccgatgagtccaggagcatccaccgccccgcgcgctccgccaccgattcttgacggcgcgaggaggaagccgcggagatgtcctcgccccgccgcagcggcaaggccgtcagctggttggcggcgaactccgccgcgcacgctctggcatcctcccgcgctctcccgctgctcgtttcgttgagcagtcggaggcgctccgtagtggtacaccgtgtgcttggcgaagaactcgtgccgggcttgagcgatgccaggcagagcagccgcggcggcggctggagaagtcgtcggagaagaagcagacgactcggaatccgaagccaatggagggatgcaccttcggggcgcagctcgcgccctcctgtgcgggtctggaggtggagagcggatgcgcatcacagcaggggttggcatcttcttggaacccggcttctttcgaccacccatggcgtcaggcgaggcggctcttggtttcttggcgctctgtccggcgagcagcggaggcggcgagtgggttcttggtttcttggctcaccggcgaggggagaacggagggaggagagaagttcgttggccaaggttacggctcggcgctctcggcggcaaggcgggtgcaatttgaagggagttcaacccttcgctgacaggtggggccgcagtcccatgtccgctgacaggtgggcccacatgctcgatgacgtcatcctcgcctcgcgacgagaacctgttgccgctgcctgctgcttgcacaggctcacggccggcgagagtcagccacggcgtccacggctgccagcatcgtcgtcccggctacgtctcgccggtgataggtagaagcagaacaagaggctaacaactcgcaagcatctgaacgaacacctcatgtgcgagtagagcagcactgaggcgttcggagccgaactcgtcctatcaccggccgcggaggcagcgaacaccagtgtggattggagggccaagtctaacgcgatttggtgaaacatccaacccaacatgcatcgactgtcgctcggcggcggcgtcagttgctgttgctctgtgtgtgtccaacgccgcgacggccggcggtggcatccgccatgtgctgtcgacggctacgtggcgacgattggagtggcaccgccggtgaggaaggtatcggcgtcgacggggacacaactccagatcagatcagctcaagtgctgaactgatttttgttcagtttctgctccgaagtctgaaactattgatctccacaagatatgggctgccttttgctttagaaaagaccgaaatcaaaacgtaaacatttcacttctccaaatgtatggatgatcagtcatatatcatactccatcatacagacagcaatccaaatgaccgagggcggcaaattacctggaatttttatattttggtccttattgaaaacttattttacaaataggtccctggaaaaacttaaaccgggaatgtcctttttggggcgccagagtggttgacgccgtcctccaacatggcgccaccagccacaatggcgccgcggccgtgccaccgtggcaccagagcctacgagggcttgctgactcggcagagcggggcgccaaggaccaaaatataaaaatttcagggcaaattacatttattccaagaaagaatacgatatacttgtcatgcctttggctcggcctggcacgagtgtacgacacgaacctattaggctgttcctagactgttggtatagcccatggacaggcacgacacggctcggcgtgttgattaggccgtgtttggtcgtgctcgggcccaatggcctatttgaccatctatacttacttgtcagcagcacaattgaatcaaactccatcggtctctattctctaaatataagggattttggttggatgcgacacatccaagtatagcgaatctggacggaagcatatccagattctttatactaggatgtgtcacatcttatcaaaaccccttatatttagggacgaagagaatacatattaaacaagaaaacaatagcaaatcagtttaccctcccgtttatcgaaaaggaaggtaagtggaacgtggttctaaaatatttttaatttattttctttatataaccgacgtgggcattagagagattcattatctcttgacatttcaggtagaattgttgcgtctcattaagtttttatgttttccttaccaagttattgtaattgaacgaaagcactatgtagacgtcacaccggatgaattcttggggacgtttcactagggccgagtttagttcgaaactttttcttcaaactttcaactttttcatcacattaaaacttttttacacgcaaactttcaacttttccatcacatcgtttcaatttcaatcaaacttctaattttagcgtgaactcaacacaccataggatatataaaatcgtcgtttaaaccatccagagagatataaatgtacatggtttcgatagttgagaaagccttcttaatttggttttatggttaagtggccaaaattagacctggactatcattgaaagaggcaaaatggactttgtttatcccacataggaccaacgcgttgccggaaggcgtccaacccgatacggaatccttcaacaatcaataaatccgatttaatctcagaatcagatagggagatcgtccctataaaagtgagttatatatactgcagccttatcacagacaggtgctaggcttactcgtgaactggga

SEQ ID NO: 70958 - DNA, 1206 bp, Oryza sativa
ggccccacttcccgtggacccggtccgcgcgccgctccctcggctgacgcaataaatgggatttttaattaaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcgtttgggaaagcgagcaaggcaagtcacatcatccttgagcatattgaatcccagtttataaaattaatttgatttaaattaatgcattatcgctttatttaaattcccgcgttatcactgttttatttagccatgcctatttacctttgttaggaccatactattattgttattgttattattaccttgttcaccctagaataaacaaaaccccaactagtggacactctatttatggttccactagtatgaatttaggtagatgcttcgccgattaataggacaacattaggtggttttataattttagactttgggaatattcatatcacctggacactatgaattgttggtttatggtggaattggacatacacctctcttcctctttcaaaacccctaaaacctattttcggtggggtttgggtgcatgccagttgtgggaagtagcaccccggccactataaggattaagctcgggcctctgttgcaaagcactaccgtacttccacatgtctagtgggtaaggcttagtttgtggctcaatctagtcataaacaaaagtacacggattggagatggatgaagtcgggggtcgatggacattctccagggcaaatgaaggctacacgagctgcggcccggtagtcgagatgtcatatggcagagggttggtgccctgctgctagggggctcagtcctgcctgcctgtcccgggtgtcccggccgtaggaggattgggtcggtactcttgattatggctaggatgggttgggaactatgtcacgtcttccgtccgtataccgtggtggtatgtggcacgtggttgcacgtgaggaagatgtgtcttgtgggtaaagatgtacacctctgatcagag

SEQ ID NO: 70959 - DNA, 3054 bp, Oryza sativa
  unsure (1)..(3054): unsure at all n locations
atagagatacactccctctgattacaaatatatagcgttttggtgactgtatcgctatttaaaatgttacttatttacatgtagagatagcacttgctattttcattaaatgataggttttgtagtactcactattcccactaaatgatacttatttacgatggccaagcaatacaccagggactgcaaatactacaccaataagcccaaacaaagatgactcaagacctaagagcaattactataaggctttaagtgcttcctctagaagtgttacatgggattaggtgatggtggagtagagaagtgagaagggagagaggacgagccacctctcatacaacgggcaatatctatgcaatctccaagaaaagtgtaaagagaaagtgtaatagtgtgaaagtgaaccaacaatataaaattatgggttaattggatccatgccactgtaattttgtcatattagataattccactactattcacgaaatctgctacgtgccattacaactttgtaaaattagatccatgccaccgccgtcacatttttcatccatcgccgtcacacttcagtgtgggattgggacccacatgtcagctccatcctcttcctccatcccctctctccttccttccccatctctcttcggcgagcatggccgacgaataccagcagcatgtggccggcaacagcagtagcagcagcagcagtagccggccgatggcggcagcgagggtcacgaacgccgtcgcgtcctccgtgcaccccacgttctgcacccacctgtgccgcaatgccgcacggggcactccatgcggaaggcccgtgtctccgttcgagctcgctccgatgcacccatggtgtgtgtgctcgatcatgttccatatgcagctagtgttcttcttcttcttcgcatggatgtttgtgttgagatgtcgatatggtgatgacgcagactnncagcgattgggtgtccatatgngcaggaagctattgggctacgaagcatgtgcgcaacgggaaaccccttgcccgcgtgcgtattaccggtgcaccgtggccgtcggctgcccggcggcggtggccaagtcgtcatccgccaatgccgcgaccacggagatgctcgagctcttgcgggatttcagtgactactcgagcttcaactcggatatctcaagtgagctcgagcggcttgcggcggcggtgacgcctagatctgacgcgccgcaggtggctgctgtggatctgaacggcggcagcagcagcagtagcaggctgacgacgacgacgccaccaccactgctgcaacttggatgccggcaagccctccccttcatagtccccaccggtagatgcgcttctctcgccgccgtcgtcgaggaaatcagcggccggcgtgcttctccgccatggatgtcggcagctggtgatgcgggtgagagagaggaaggggaaagagaggggagggaggtgggtcccatgcgcagttggattctaacatggatttttaacggaaaatgcgatggaatggcatggttccaatttcgccaaattccagtggcacgtagccgatatcgcgaatagtagtggcatttttccgaattgacatatttgcagtggcatggatccaattaacccttattataagggtatgtgtagtgaagagtagataacacggctaaaattagatgtagtatccacctctacataaaacttgctctaaaggctttttttcccttctaaagctataggttactactacattaatggactgaaagctagatttgagttgcttttcttggcttattatgtgaagtggagttaggaaactactcttgaccttgtgggttttaagctattggcttataaaccacaaaagtcaaaataccaacttaactactccctcaatgccagaaagttagctgttttaaggattaatgtacaaattaacaccaagtaaaaatgataccctcatattactcttatttgttagtcgcagtgataccctcatatgagaatcacgtcaccgaagtctctacttgcgtgaagcattcctcctctcacaccgatattgaccgtctcaggctaagtatcacaaccccgttccatgattatgacgttattaccctcattgataaaatcatcaatccgttattctggtgttaataatatatttaacccatatccatcaaaccaacatgtctcaaatgattataaaacatagagatgcgattaaaattagggggagcattaccatatttctcccaaggttcataatatcattcaagtgtcccatacagatggtggcacgatggctactttgattaacaaaagtactaacctcctgccaaattctgctagaactaagatgagtaggatcaccatatatatacaaaagattaaacatcgtgccactagggatatgaaacacctacagctactatataattggcacaactactcatcgcagtgaggtccacttcattattccacaaaagccacaaaccaccagaagcatggacaacaggaactatatagctattatctacatgaaaagcatcagtgagatcagaggaagtgaaagaatcattttttgtttcagaaataaatattacctgagcgagagtggagctgatcaaactacggaggtactgcatcttcctcctgccgaggtgtcctcccatacctcggcagttccagctcaagaaagtcatggtgcctgtggcaccttgtgggctggcgccaactgcccttgagaagtgagccgacctttctccaatcccaagtaatccccatgtgcaagaagctgatcttgaggctgagtttgcaaaagttttcctcgaggaacgctagccacatcatgcccagaaacagaacaacatcccccgatcgtagcaggagaaccataattcctagcagcttgagccccagccaaataagccatacctaaagtcaggtgcgacttgactctgtggagaaactgagacttgcttccttctgattgagctcgatcatccacttcttgataaaagagcttgtcatttcttccatag

SEQ ID NO: 70960 - DNA, 6770 bp, Oryza sativa
tacactacaaaacatctcaattacttctttaatttgaagacttcatcttgttaattggtcacatcacatcaaaagcttcgcccagctgcatgcgggagttagtgagtgctgatcgatgctcccagctagagccatgcatatgcattcagctacacatatgcatgcggacttagtgagttgctagctactgatatactcctgcatctgttaattatttatcgagagagagattgaggggggagggggggggggcggtttcgatcagaggatgaggggtggcaggctgcggatacatgtgagatacgtccggataggtatcccgtacgtatccctcttttttctctttttcagataattaaaataaacaccgatactcttccgatacggtgggatgcggacctgatacgggggagccctaaatcgcgtaggaacaaaaccgcatctctctccccctccacccgcgccgcccctcgctctcacaactcacactgcccctctctcctcactaccccaatccccatcgcagcgccgccgcctacaccgtcgctgcgttgccttgccgccgtctctgatccgtcctccgctgtccgcttcgaccggcgcccagtgccgttgtcttccttcgatcccagcctccgatgacattgaggacttgaggtaaatgaaaatcccctccaagtttgatctgcatcgtgcatagtgttccagttccctttttcttagtacaattgctgtcgtctttgatagattcaatggattttgatgcatcgagactgctagaactgtcacttgatgagcctgaccctgagagactgctagatcttggtgcattggacatataaggtgatgggccttcatccacttcggttccaatggatgaaatcaacaatcaatttatctagtcttgctatctagttattgagttgaatttgaagtcatggacaagttaattctaattagtttagcactgtggttatgttctactattggtttatctactatgtgaaaaatgttgtctaccatctatttgaagaactatgttattttcatgatttcatctactgtgtagtcttgcacttatttatgcatgcctcttcagtgaatggtgagatgctgtgaatatgtcgtactgagatatatatcatatatatgatgatcggtgcattggtggtttgatgctgttgtgctgcctaatttttcagtccatattccacacttaatttattttgtatttttaattatatatatatatatacacgcgtatccccgtatccatgttttttagaagacggtgtatcccggtatcgccgtatcgcgtatccgtatcagcctatcagggtaacgtaggtgtcaggccctccccggcaccccccgtggcttcgccactgaggccagacgatgtgagactgagcacatgttagccatttacctttccatttcttgaatcaacaagaagagcatcccgatcatctccaactactgccagaagtttcctatcagggctcacagatgtgtgctgcataggagtagtaaggaagtcaaacaaggatggctggacataaaagcgttgtgtggatattgaagagagatgacttacatttactggccagttataactgaagtggttcaagagctgaaatgtttccatgtcaaattcacgaacaccacaatcattgttggacacggtaacacgcaagcttccactacatggacaattttagggctttagatttctgtaatgataggtacatcttcagccaaagatttaagctggtatatttttaccttgcagatctgtgtatatctatcgcatttgtgatagcattgtcgcttaaagttgtccttgtgcagaacttaacatcacggtctcccacaacctgtacaaagataaaaaatattgagcacgtaaacctgatatttaaggtttgccttttctatttaaaaaaacaatattcatggttgcctcttttattaagaaaaggtaaaggatccccaaacctgtagcaagactggcaaatactgagcatgtaagcctgatgatactcatggcttgcttttttttcattaaagcaggtacttattataaagcaaaagtaggggaaacagcaccttaccttgcaaattagttctccctgaaaaccaccagcaaccaataaaccctcattcactgaaagtgtgctaacttgaaccccgctaaacccttccagtaaactgccagggtgtttctgtgtgacaacattaatttcagaataattttacataaaaaaacaagagtaattgaacttgggagaaacatcactaataaaaaaaagatctttagttcaaataaacacaagcaggaaatgaaaaagaagaaaacctgcgcaggagcaacatgcccggagaaatcaagaacctctgatagattgtgagacaatgatgaccagtggcctactgtggaatttgacatgaagtagacatcatgcttcgacgttgcccataacaaattcctaagctacagaagcagttcgtcagtactgagcagccttgggactcatatgacaagacaaattcagatagctgctataaagaagaatggacctcataataatgaagacatcaaggcaaaagtgtttaagtttgcatcattgattatatccagtcatagttcaaaattcgcttgtatgaagaactttaaacttaatttttcactggcaagattgtgtaagccatgatttcatgtgtttaacagttccatgaaaacatccaagtatttagccactacagcattccctttgaaatatcccaaaacctttttaccaacataactgaaccagaatcctgcaaaacaattgaactaattctatgctctggaacagtagttttcttgtttagaggccaatttcacaatttgttaaaggttccctttccctaatgatcatacaacattttttatctttgtagttcttattgacatggccacatacgtaagacaagtaaatgaggtgtaacaactccgatgatacacaactaatgctaacagctaagaaaaatagcttatcccgcattaatctagtggaggattgataaaaaggagtatttgtcagctaagaaagaatgcaactcacctgaaagtggaggattgatggcttcactaatctagtgttgtagtgaaattcataatacttgctgatcttatccacttgcttgcatatctgaaaaatgtaagatgcattttttttcaggaatttggaacatccatagagcaaaaaaaacaaacattgatagataaaatttcatgataatagagaccttatccatgagctctcctgattgagggaagttttcgtagtttttgtactgtaccaacctagcttttctgtaatcgctcctggttatttgtaacctctcccatggtataccttgtatatcctttcctgctcttgcttcagctgctgatgtatcagttatcctagtgagctgcacagaaaaaaaaacactttgtttcaacctatttttatttcatatgcacaagaccatttaatgaacaatcacatctgaataatcctaaagattgaagcaaactcatcatgcttctgttcggatttcacagtacagaaaagaccaaaggaaaacacaagaagtttgaacaaaacagataatctttatccttgacaagctgttgcatccgattctccagcatcctgtgatctggcaattagataggcatgttgacccacatgggcactatcagttatcacatatgccaaaagacgggcccagctgagtcggcaattaattgaataggtgaactgatctaactttgatcaacaagaacaagacatgagtcctatttcctggtagaaaaccatatttgatactcattggtcttagccaattcaaaaggcactgaaaaacaatgcatccacaacgccgggccaagatgggcatagaaaaactatgcactataccccttttatgaaaacgacctaacagagagaatggtatgccatgccattattggctgaagataagcacaacctaggtagcaatctagagctgcatgattgggcagaaaaaatctactccacaaacaccgttgacatgaagtctctagttaacgaaaagaattcagcaaccaaggactaaatgggaaaaattgtccaaatgcagatctgccctattaatcaactaaaattaattacacatacacttgtttagagtacatcactgcactaaggctccccgtgcaatcgatgtgtttttgactaagtaaattccccacttatcatatataataactgtttatagatgccaacttagccttttctactttgtcataacaaaacaatcaactgcttaattttttaacttatttcctatgtgtccttttccacacgatgcatcctagcagcagcactgcaaaacattagaaaactaaccctgtatacctatgatagcgatcagcagggacctgattcggagcagaaggctatcctgtgtccatgaacaaccctagatactaagctccgacgcttatcgcgacatgctacccaccaaacgtaacccaatctcgaaggttaaaaaaaatgaaaaaaaaaagaaggaatggaaccctcagacaaatcaaacgagaaccaagccagaacagtgacacggcggcggctcagattcgcggcacgaaaaccaccaaggcagccaccaccagcagcaaggaaggcgttaccgaccagcgcgtactcgtcgtcgccgtcgccgccgtccctcctgtcgccgtcgcgcgcctgcgactcctcgccgcccacctccacgtccatatcgccgtcttccgaagccgccccgtcagggtcatcctccgccatgtaccccgccaccgccgctccgtcccgcacggccgccgccatcgccgcctcgccccccctgcacacacgcaaaccaaaaccaaaccaaacccaactcagatcacacaaacacaaacacaacaaaccacaaccagccatcagaacccgggattactagacctctcggctgaagcagataagaagcctcaagaggtagggttccgcgagctctgctccgccccccgcgtgtcggcggctgctgctgctgccgctgccgctgccgccgctacggatcggaagaggaggagagcgaaacgtgtggatgggaggggaggcgcacgggcggcgcgttcgcctttgcttgcctttttgcgccgtgcggcgatggcgaggcgcgtaggagaaggaaggcaaagctcgatccggaaaggataataggaaggtgaggagaggaaggaggatgggatgacagtgacggtggtgcggaatgggtgattaggatgtgttcggcactctgatttcccaactctcctctttcattttgacgtgtatgttttttaaacagctaaacgatgttttttttcactaaatatttctatatgaaagttgctttaaaaaatagctaatactgattactctcttcgtcctaataaaactcaacctagaacttggatgaaattcgtgcatactagaacttgtccctagaacttggatgaaacataatctaataaaataaatctggatagagaaaattcgtgctaatagaccgtttcacttttcgtgtatactgatcatgttgggaaccggctgaaacgaaagtactccctccgtttcaaaatatttgataccgttgactttttagtacatgtttgaccattcgtcttattaaaaaatttaagtaattatttattcttttcatattatttgattcattgttaaatatactttcaagtacacatatagttttacatatttcacaattttttttaataagacgaacggtcaaatatatgctaaaaagtcaactgcgttaaacattttgaaatagaggggtagtacagtacattagataggggccaaggtaagccaccgcgtgagatgtgatggggtgaggaaggggattaggacgaaggagatggatggctgggatatatataacctgggtagtctctagaagaagtggatttttgctacgtgcacagcggttaggtttctgtgtatcggtcttatatcaaaaattacgaaaaaaaaattataaaaaataagtcacgcataaaatatttttcatattttatcatctaatatttttttattactgaaagcgcatccatctatccattcccctcatctacattacgatcatacgcgtaatgctcctttctaaagaaacagaagaaccgttttcccaataagcaacgtgccctaaagctatagattgctacctaggttgctcttttaaaattaaaaatattcatattttatcatctaataaacaaacaaaatactaatcatataaaaattttaaataaggtggacggtcaagcgtttgacaaagaaacctacttgatggaatgagtaattttcttagctgagaatatctaacgttgttttattgttcacttgatggttttattgttcttgaggtatttttatatggaatggatttgatcattatctataataaattttgagtcgtgggtttaacatcttatatataatttcaaatagtcctttggcgactgtaacagataccatatacacaaaaaaaacgtagcaaacaactaaagaagcttgtcatttcactatgtcggtgacatgggaccgggagtatcatgactcgaggcttgaggcagacacaatcgcccacgtggcctggcaccctcgggggacgtcgggcccgagggtgatgtgtgcgcccacctcttggtcttcccgagggggggggggggg

SEQ ID NO: 70961 - DNA, 4351 bp, Oryza sativa
tgctcggatagcaaaatcttgctcagatcctcaagacataattcatttatgggatgccataaccataggcagttttgccagatgcagtcaaatagctccattgttaagatcgtaaaacaaactttcattgttgtgttgtgtacatacatgttgaataagtaacaatgaagctacctacaaagagcaggctaagattgatgtgtctctgctaactggagttcttacaggttgttccatctttcttggaaaattacggagaacaaatatcaccattgtctgcttagtgttctgacaggttgttccatcttgcaaactgaagttctgacattgtctgcttagtgttagtgcctatatgttatctttagatcgcccgtcttttaagtcccgtaggtactgaacacgatgatcatcaattcctttgatgagaaaccatttaatcatggtagtgcaggttaccttgtctggtttgcatcgttgtaatttcattatatcaagaacatcccacatctccgccaagcaccccaccctcccaaacgcgtccaccaaacagttgaagaacacaatatccaacgttatgtcagaattctcaacgattctcaacactgtctttattttcttaacatccccagcccttccatatgctcgaaccaacgagcagagtgtaacacagttgggctttatacgctcagatttcatcaatctaaaaatatattccatctgttcaaggtccccagcccttccaaatgcatcaataactacattgtatgtgactattgtccaagaatagtaatacttctgcatgtattccatcacagctcccatcttctcatacattttagctttaccataggaatcaagtaaaatattgtaagtcttaatgtttggggagataccggaggcctggaacttctcataacagctttccatagtttcaatttgaccactgccaccgaaagctctgagagtagaattcattgtccatacatcaggcttgcaattttcagtcagcatctccagaagagttgattccatctcagcaaaccttaatcataaagcatcattagttcaatgaaatcgcatcaggagtaactacagatttggaaagaatcagaaatgcatttcaattacggtaatattcaaattctggctgttcttgaaattaagattctctgaagttctccgcataaagttaatcgcattttcaatagttatttgtatcaaatatgagaaaggcatgttcatattttaaagcatgaattttactatcaattaccttcctgctttcccataggcatcaattaatgtgttataagtcacgacattgggacggatacccgcccgcgccatatcttccatcaaatacttgacccgctcaaaatcataggcgtgcaagcatgacttgatgagaatggagtaggtctgcacatcaggtcggcaaccaggggtggccttcatctgctcgagcaaggagaaggccctgtcgaagcggccactcctgctgtacgcggagacgagggccgtgtaggactcgaggttgggagcgcagccttcgtccaccatggcctggaacagctcgtgcgccctctccggctgcttgcacttgcccagcatggtgatcagcttgacgtatatcccgacgtacggcctgtaccacacctggtcgcgcattagatcgaacacctggtcggcaatggacacggcgaggttagcgggagacacgggtataggctatgatgggatggaggcagtggtgagggtgaggaccttgagggcggagtcccagcggagggcggtgatgcgctcgtggagggcctcgagcacggtgcgggggagcaggcggcgggtgcccttgccgggcttgcgcttgtcgaggacggccttggtggcctcgcggcggaggatgacggagagcgccttccgggacgcgatcttacggttcacttcctcctttcgccgccgctccgcctcggcctcgacctcgccgccatcctcctcgcctcgccgcctcctcctctcccccgcggcgccagccaaggaggaggaggatcccctggtgcgagccggctcgcgccccgcggcggctggcggtgggagcagcgcgtcgtggcaccggcgcgcggcggtggaggccgcgatggtggtggaggaggaggaggaggagagcgccgggaatggggaggccaccggcgcggcggccattgcggcgcggctcggagtagccggaggcgagggcgagctcgcctcgctgcagttttgcgccggagagcggcgcgatttttcgtccgcgcggggaagaagaggatgaggctgtgcttagtgacgtggcaacgagagtagtcaagcgtaacaggacagggaggggcaccaagtgaccgttggatgagatagcgacgctccagatctctcctcttatggaagacaggcaaccagccagatttaacaccacaggtttagcagatttcacggacaattttgggtagatttggatttgatttatactaagggcccatttgaattgtaggattgaaaaaacggaggaataggaaaaacacgagattttggtaggattgcaagtgtaaaacagaggattacaaaacataggaaaaatataggaatgaccgtttgattagaccgcaggaaaaatgcaggaatcacatgagagatagactcaaggaaagttttccgaggttagagtggatgttaactttcctacgtttttgctctagaattgtaggaataggaaagtttcctacgtttttccttttctcgttcctacgaatcaaagacatgaatagtgtaggatttcaattcctttgtttttcctccatttttcctccaattcaaaggaggcctaactctttgtttttcgtcgagaagtaagagcccctttgaatcaaaggaattatgaaagaatttcatagaattgaaatcctacaggaaatttttctatgtaaccctttgatttaaaggattgaagttttccaaatcctacaaaattccgatggaatggcttgttgcatattgcatataggttttgaaggaaacttagcaagaggtccaacctcttggtaaaaatcctttgagtctatctctctcatccgattcctgtgttttcctgtggtccaatcaaacgatcattcctgtgtttttcctatgttttgcaattctctgttttacaaacacattcctgtcagaatcctatgtttttcctattcctcctttttcattcctacgattcaaagtagccctaaaattatactagtagttaacactctttgttttttgtcaagaagtaaaattatactagtagttaataacattattgatccatatttttcagacacaaaatactcttattcttctcagtcctctcttctcccctcttctcaaacacacttttaacacaattaaacagcgtacaacctttttttctctcccagcagttagcatgaaaaactataatccagatgatagaacttaaccgtaattaagtaataaaatagatttaggatttactacacttattatctcaactctcaagttgtcaaaagaacagtgcaattatcacgcatcagctcgaaattttcagcatctttggcgctcagttgggtagaacactagaaccaacaaccgaagatatagattacttctgcattattgcccagagagagtattggtccatacagtctatgatttactagctaactattcacaaggcaaggatcacgctgcacgcttgagcctttgactaaacatgcacttgaacaggcagatacattccctgaacacgcacatcagaatcgccaccgagatgggtggcctatcacatacagaaacaccacttttattccctctctacatgaacgagtcgaggtatccaaaggagtggaccattctgtagtgcagcaagctggcgtacacacggtcgcacactccgacgaacagtgactcgtcgtctgggctaagcgagatgccggagatctcgccgaagaaatctatctcctgcctcttcttgtagtccgcagcggcgctgtagacgtgcacgaagtcagcgggctccgagaagagcatgaactggccatccgaggagtagcggatgcaacggatagcgccaatgttgcccctaagtactgagagggaggttgacaggtttcgtacgtcccagacgcggcaggtcttgtcttggttaccggttgcgaaggtgcggccacagggtgccatgccgaagcaaacgaatagtccagatggccaactagggtagaggttacctgaagagaaggattcagcgttcaatgtcactatccagataaacaccagaacggaacaattctcaaataaagaaaatcaatct

SEQ ID NO: 70962 - DNA, 3159 bp, Oryza sativa
tattccggtgtgccccctccctctcgaatcgtcgcgacaagctccggtgaactcggccgccgtccgccgtccatctcggcctccccttcttcctcctcccgccggcccgcgtggctaccacgtaggcgccacgtcggagtcacctcggccgcgaccgggtcagcacgaccagcctgccgcctccccctccctcaaccggtgcgcgcggtccacggagagccctatggctgcgcgtgggcccgccgcatctcggtccatccggcgcaccgcccgtgcgccatcttcaccaaaccctagcgccgcccccgcgtgaacccattcctccatgaacccagccgccgacaggtgggcccgtcccgggacccgcatggtggaccgcggtccacccggtcggtctcctccccctcccacgccccattgggccgccctcctcgcggccgtgccggcccattaggctcgcccgagctgcacaagtccctcgggccgcgccaatgccacccgagacaagtctgattgacatccctccatccttttctttttccagggatttaataaatcctttttcccttgtcccataaatcaattccttattccaaaattccataaaccatttcctttggtcccgcatgacagtgactgttaataatattcttgggaatattatttctacaaaccccataaaccatttctcgtattccagaaaattccgataaatcatttccttgaccagaaaatccaaattaaacttccaaaattcatatcttcccaaccgctcttccgtttgactccgttcaacttccagtaattccgtaaaatcgagatctatttaatggcactaataattagtctaaataggatctttcttttggtcttttgtttaggttttcaattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcatgccaaatcgacggacctacccagtagtcgcactaatttccgtaggtcatactaccctgattccttgtcgctccacccttgtggtacctcggtattcgtgctctctgagcgcgtatacaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggtactgtcccgtattcgcatataaggaccgattcctgtgggaaactcatcgaacataatcaaagtgcaaccacaaggtggaatgggacaccctggttaagtaactagacggttcagggaaacctcgcatgccaatagttgggaacgccggggcggggtcggacaaaccgggttcctggtaaggcaaggacgagaagcttgctcacttaccgatcaaggtggttggaatttgatttgtgcacgcctaaaatggcctatgtttatgtgaggatttgatccttccatgtggcatgaggtaaccctgggtcggctggggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagttgttgaaaaacatctcttaaagtcgaatcgagacgcaagcctcttttcggcccaaacatagaaagaaataaatcacttagtgatttcaaaatgatttcaaacaaaagatttgcaaaacaaccttgcctctcttccaagctagcattaaacacctaaattcccgtgacttgctgagtacgaaagtactcacccttgctctatataaatatatataaatagttcctccgccctgaagagaagataaagtgaagtgaagattagggtttcgtcctggttcccagccgtcgcctgtggtgttgggtgttagaccgttggtttccgctgctgctgctgctgttggtgtttcctcgtccgcgtcgtcggttgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtatgacatcaagtcacagtctcacagatttacaatcagttcaaatcaattcatcaaatgcatacatcaagtcatctactattttccatcaagtccatcttagaattacaaacctcagaaagttagaatataaaaggggtttatataagctgtgattgtgcaatggctgcctcattaaaaacctttctaggtaaaaactcacacctcgtgagaaaaccctagaaaggaaaagagtacagcccatagctaaaatgttcatatcaattacaatcatccagttcaagggtttacatcaatttcatcatcaagatacatattctcataagcattttgaagctccacattctcagtagtatgctggcgttttgcatctgctagctcccagtccttgatcacggccagaatttcccccagcgtagggtttagacgcagcggacggtcctcgatgatcatgccagttaagctaaaagt

SEQ ID NO: 70963 - DNA, 5646 bp, Oryza sativa
ggtgcatccccagttggctcccaacctgcctcatacatctacacgggtattgaggatgatgaactttctcgttcgttccttgtcatgttgcgcgtctccttgtatgttccacctgcacgagattcttctatggtctgcaggggaatggttacttcatggcagttgtacaaatgatatcccgcatttggcaacggaatttcgtttgtacaaccagggaaaaagtaaatcaaagatccatctgctacatgtttcacaatatgcccttgcactagataagtctcatcaacacacggacgagcggctgagataaaagcaatttggtcgccaatgacccctagcccttttgctatctgagtaatcagagaagtgcactcaacaggagcagagaactttatactttctaaccattgccttgtcatacatttcactggagcaattttgatctttctaaccatggcaaacatgataatcaattcatctcctctaatgggtctcagatcacctctaggaaacaaagtcatagcaatccatttgtgcttgagcctaagtgtagtattatggatatcattcgtcctaggtttcttgcaaattggagcaccagaaatatcttcccaaatcctattttctcgaacccagaaattcctttctggagatcgattttacaggaatcgtgaaaacccaagaagtgtacttaagcctttccatgtaagtgtaaacacttcacagaaaaagcgaaaggaaattccatcctctatttctttcaaagtgcacaaaaattgcaaagtaagcaaacgagaaccaggctcatctaccacagcaaatctctgccaaccaacagcttctcaaatagtacgaaattcagcatctatacctatcttttttagcaactccgatgagtattctcgcgtgtgagtatactcctagtcgctcagaatgcagtaggcccgtactttatcctgatcatggagcattgttccatcctcggttgaaactcaaacttctcttccttcccattgatgtggaaacagataatccccattcccacgtcaatgttggctcctgcggtgctaaggaaggtgcgccccaggatgagcggcgtctctttccccgtatccatgtccagcatcacgaagtcaaccaggatgaagaaatcacgtatcttgactggcacatcctccgctatccctgccgagtaatagactgacgaatcagccagttgaaggcgcattggtgttggtgccaacaccgtgaagttgagcttgtcgaagacgtcttttggcatgacgctgacactggctccaaggtcgcacaaggccgggtcaaactgttgtgccccgatcgagcaggtatcgtaggacaccccggatctttcttcttctccgggagcttgtggagtattacgttgctgcattgttccatcagcttgaccacctccattgttgggagctgtctcttattgttgagtatgttcttgagataacaggcgtatgttggcacttgtatagcatccaacaacggcacgttgatgtggattttctggatttcttcaataaaacgagcaaaatgcttgtctactgacgatttcctaatccgttgaggaaatggcagcaaccgcgtgtcgcagtactcttgcggcactgtcttttctggctgaacatccttgtcagccgagtctttagatggcgcttcttttgatatcccattaattcctgtagggttaggatatggcggatcacgagtggacttacctcccctcgtcgtgattgccttaacattttcaatggaggagtcgggttgccccggaatcctcctagtttcatttgtaaggactaaggatgccaactgagttaactgggtttctatcattttattaaagctcagcttattttgaaaagcagaagcaaagccatctaatttgatatttatgttttctagaaccttgtcattggttgcaagctttttgcttagcgcatcggtggttttagcttgcgcaaaaacgagatccttcaaggagggctggttagaaaagttaccgttgttgttacctccttgataatatgggcgtggttggttccaccccagacctccttgtggaaggtacccgttgttgttgttgcccatgtacatcgcctcctcatgggtttccgggcagtcattcccagaatgacccgtgttgccgcagacctcacatgtgacgtgggagtccaaggccttgacggtgccttgtggccatttctcatggtcgtccaatcgcttcatgaggagatccagcttggcagcaagtaactccgtctccttgacggtgtgcatgcctcgctaacgggtctggagtcgttcctcgctccaacccatattggagaccatcttctctattagatcaacggctccttgaaccgttttagagaagaatgctcctccagctgccgcgtccaggtgatctcgggacatcggggtgagtccgttataaaagttctgcaggatcagccagtcatccatccaatgatgaggacaggcggccacatactcctacagtcgttcccatgcttccagaatagactcgtccctcatctgctggaaacttgaaatccttccacgaagggcattggttttgcccatcgggaagaatttcgagaggaatgtcgtagagcatttgtcccaggtattgacagcagcacggttggcatagaaccactacttcgctctcccgagaagggagaacggaaacagtcgcagcctgacgacgtcgggactgacgcccttgatggtgtacgtgctatagatctctaagaactgttgcagatgagcattggcatcctcattaggcttgccacagaacgggttagcctgcgccatcgtgatgaggctggacttcaagtcgaaatccatgtctcctatattgacctgcagcctaatggccacattgtcagcagagggagcagcgaactctcggagagtcttgttagccatagtcttgaaggtcggtggccctggtacggccggtttatctgtcggtagagttttctgcggagcagcgacttgcggcctgacgctccggaagaaagcttctagatattctttgaagttttccggcaagttgaaaccagtcatgcactaccctgttttcacaacaaaagtgaaaacaaccaaggttaacctacaaaggaaaatgattatacagaagcaaatataaaatattagtccaagtaatctctattatgaatctttcctggcaacggcgctagaaatgtttgttggtatttctcaacgacattactataaatataattcccagcaatggcgcagaaatacttctgatatatattatggttatagagttcatccgcaagcgcacggatataccattgtaccatttcacctgagagtattctaggggtatcgtatttattttatcccgtgggaagatcatgtagagagaacttaactaataatctatatattgcttgtgacagtcatattctaagtaggggttaagataatccaagagtagaatgacacacaagcattaactactgtcacaccctgaaaattcaaaatatataaattgttgtttaaatggaatttttagaatttattttaaaagcctaaaagagaagatctagtttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaaccgctctctctctcctcggcccagtccggcccagtccgccgctgcgcgcgcgcgcgtccgcccgctgacaggtggggcccacctgtcagggtcgtcgtctacctccggccgccgccgcccgaaaccctagcgcgccgccgccgccgtttccttccaaatctggccgctcctttccgtctccgaccgaattgatagaggggaaacaatcctcgagatctcctctaccttttctcctttggaaacatcggctaaatcggtttggaaatcgatggattcgagttcgaatcggatcggcttttctctctccgagctcgagctttccatctcgtcgccggtcgccgtgggccttcgccgttgcctcctagcccctttaaaaggacccccggtgtctcccctacccgccgccaccttcgccttcgcctctcgtcgtccgtagcgccctagcgccgtgtgccctagcgccgccgtcgccgccgtcgctccagccgtgcgccaccaccgttccagacgtcgccgtcgctcgggaagaccgccgtcgtggtcgccaagtcgtcgccgtcctcgtccgccgcttcgccaccgtcggagaccgccggagcatcgtcgccgtcgtaaaaccgaagaccgccgccgtttcaacctcgtcgccgtcgccgtccgttggtcttccgccgtcgctttggtcgccggtgagtttgccgtgccgtccgctacccgttggtgccctccgttcgtgccgaagcgccgccgttcgccggcgagcttgcgccgtccgagctgtcgagccgccgagccgccaccgccggtggtgacgtcatcgctgacgtcatcgtccccgtcccccgtgaaccggtcgtggaccgatcgatctcggccgtctgttttggatggattgatcttggccgtccgttctcgtgaaccgccgccgtgcgcccggtccaccgaaaccctagcccgctgacgcaataatccttctttttccttttcaaaaataattcattattgcgtcataattcaattaaaatcaatttaactgttttaatccgatttaatcttcaaaaattcataactaattcatcttagctccgatttagttggttcaagtctctaaatttttctaaaattgagatctacatgttaaaaatatccacatgtactgttcaagcttgtttatgtgttgttttggtgtttttgctcttttctgtttagattccgtcgttttcggagagtccgttttcgccggagaagagtttgaagagttccaaggccagcaaggcaagtcacatagatcccaaacaacccttttgagcatattgatcccgtttaaagctactgtttctattcaactattgcatttattttcgaatgtcattgggtggaattaacctattgtttgttatagcccttttgttcttgattaccttattccttgataccttgggttattacaatttgactagttgagctttatttatattggttcaactagatattagatataattgcttagccctgcttagaaacattagcacactattgggataacttatgaatcactataatttaatgatggcttaatgatagttcacgatggtcaatcatgattggttaattaattaatgtgccaactaaaacctggtaatggtgggttgtgagcacatggttttgatggtcatgctcatgacaattaagaaccggttcacgagtttcggttgtgaaacattaaccgtgccaaccacaagccagcgtgggcaacggctttatcttttgtaaagcaaggttcattgcggggcaacagactgagaagtggcggaaataa

SEQ ID NO: 70964 - DNA, 1355 bp, Oryza sativa
  unsure (1)..(1355): unsure at all n locations
ttctcttttatttaaccaaactaatggcacatgcacttcataatctcttttaatggttctcattcaanatttattccagtgttattagtactgtacatctattactgtactaatggctcatttatcagcaaaagttttacaatattgttttatttaatcttgctgcaataaaataaatttagcatgttgattttataactttcttttatctcttttgaaacctgttattcaaaagttcaaaactggtgaccttgtttccaactgtttcaacttatcttgcaagcttggtttactttatttacttacctttttactttgattttctaactctattcaaattaatccaaaaacttatgctattaattggataaatgtcttaactccctcctttcacttgtctttagatgccgcgctacaagcctgagtacttgtttggggttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgttatagtgatcagttggccacactgagtatcgctaccatcctcgccaaccccagggaagtgaccgtggcagttaccttgagactgaaggaattgagaatgatgctaccacaaggcatttggttgagatgctgtgggctatggatgaaagccgtgcggagattgtgttagcggctcaagatcgtgaagaccggaatcgtggtaagatttgcaagttagaagacaaggtggatcgtttggagaaggaattagccgcgttgaagggagaagcaccgccgcagaaggccaggattcgtcttaccgcaaggaagagagctttatttgtccctcgctaattaaatacacagatatagatagatagatagatagatagatagatagagagatagataggattacagacattattgtgaccgaatcagtaaaaatccacacaaagaaatattgcattggagtccggccagaggagatgctccatgacatggcttcaccaaggcatgctctgtgcgattacttgtgccagccattgggatcttctttttttttttttaaggaacacgacggcagaagctgtgccggaatttaattagaaggagagaaaagtgcttacagtccagagaaaaacattaacaaaccctcaagggggcctaaaaaccgatctacagagatccaggtcttgctttacaa

SEQ ID NO: 70965 - DNA, 16209 bp, Oryza sativa
tggtgggcaagtgtgaagcgtgaaatcgcagaatacgtaccagtatgtgatgttcgtcagcgagtcaaggcagaacatcagaaacccgccggtttgttgcagcctttgaagattcctgaatggaagtgggaagaaatcggtatggattttatcactggtttacccagaacgtcatcaggccatgactctatttgggtgatagtcgacagacttacaaaagtagctcatttcattccggtaaagacaacctattccggaagtcggttagcggaattgtatatggcaaggatcgtgtgtttgcatggcgtccctaaaaaaatagtgtctgatcgaggcagtcagtttacttcaaatttttggaagaaactttaggaagagatgggttctaagctgaactttagcactgcttatcatccgcagacagacggacaaaccgaaagggtgaatcaaattttggaagacatgttgagagcttgtgctttagatttcggtggaagttgggataagaatctaccttatgcagaattttcgtacaacaacagttatcaagctagtctacagatggctccgtacgaagcactgtatggtcggaagtgtcgcactccgtacgaggttgcctatcagttagagttacctcaatctttggcaggagtccataatgtgttccatgtgtcgcaattgaagaagtgtttaagggtacctaccgaagaagctaatcttgaacagatagaagtccaagaggatctgacctatgttgaaaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcgccagttcttccgaatctcgaggacaagattctgtttaaggggggtaggtttgtcacaccctgaaaattcaaaatatataaattgttgtttaaatggaatttttagaattaattttaaaagcctagaagagaagatctaattttaattaataaattccaatataaaatggggctagataaaatttcattaaatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaatctctcttctctctctcctcggcccagccggcccagtccgccgagcgcgcgcgcgcgtccgcccgctgacaggtggggcccacctgtcagggccatcgtctacctccggccgccgccgccgaaaccctagtttcgcgccgtcgccgtttccttccaaatccggccgctcctttccttctccggccgaattgtttgaggggaaacaatctccgggatcttctctaccttttctcctttagaatctttggctaaatcgttttggaaagagttggattcgagttcgtctcggattcgttcttcccaatctttccttcctcgtcgccggccgccgtgggcctttgccgccgcctccgagcccctttaaatggacccccggtgtctcctctacccgccgccacccttgccttcgcctctcgtcgtcggaagagctctagcgccgtgtgccctagcttcgccgtcgccgccgccgctccagccgtgcgccgccgtcgtttcagccgtcgccgtcgctcgggaagaccgtcgtcgtggtcgccaagtcgtcgccgtcctcgtccgccccttcgccgtcgccggagatcgccggagcctcgtcgccgtcgtcaacccgaaagtttccgccgtttcctcctcgtcgccgtcgccgtccgttgatcttccgccgccgttttggtcaccggtgagttcgccgcgtcgtcctctacgtcttggtgccctccgtttgcgtcctagcgccgccgttcgccggcgagcgtgcgccgcccgagccgtccgctccgccgagccgccgccgctgtcggtgacgtcaccgctgacgtcatcggggtcgtccgccgtgagccggtcgtggaccgttcgatctcggccgtccgttttggattggatcgatctcggccgtccgttcgcgtgaaccgtcgccgtgcgcccggtccaccaaaaccctagcccgctgatgcaataaaccttcttttccttttcaaaaataattcattattgcgtcataattcaattttaaccgatttaagtgttttaatccgatttaatcttcaaaaattcataactaattcatcttagctccgatttagttggttcaagtctctaaatttttctaaaattgagatctacacattaaaaatatccacatgtactgttcatacttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattatttctattcaactattgcatttattttcgaatgtcattgggtggaattaacctattctttgttatagcccttttgttcttgattactttattccttgataccttgggttataataatttgactggttgaactttatttatattggttcaactagatattagatataattgcttagccctgcttagaaacattagcacactattgggataactataattcacttttatttcatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcgtttgtatagcatagttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgagtctaacaatgtcttttgtgattagtcccacacttctcaccctaatagaagatgctataattggtaataatttgattagctcctggtttggaatggtacattcctggtttggagatagatctgtacagccgggatggttgttcagaatggttgggcctatacaacagggtacgttgtatagtgttggattaatattgtttaattattacttaactgttttattaaattctcaaatgtttgctaaatgctgcttttgcaaatggaaccctattatgccatcctttgttatcctgtgcacttgcatatttgatgcgtggcttgctgagtatgtcatatactcaccttgcaatcattcatcagaggaagagttctacaatgatgctgatggtgtgaaggattaggtgtagccttggtcaagctgcctgtggagtggagtcgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgaaagcgtttggaattttggatagaaattccgggcgtgacagaaaacaatgcataagttgaaataaatcaatagctttaaacaggttcagcatgctcaaagggttgtttgggatctgtgtgacttgccttgctggccttggaactcttcaaattcttctcctgcgaaaacagactctccggaaacgtcggaatctaaacaaaaaggagcaaaatcaccaaaatagcacataaacaagcatgaacagtacatgtggatatttttaacatgtagatctcaattttagaaaaatttagagacttgaaccaactaaatccgagctaagatgaattagttatgaatttttgaagattaaatcagattaaaacacttatatggattttaattgaattatgacgcaataatgaattatttttgaaaaggaaaagggatttattgcgtcagcggctagggtttgcggtggaccgggcacacggcaacggttcacgggaacgaacggccaagatcgatccatccaaaacggacggccgagatcgatcgggtctacggcggctcacgagagacgacgacgatgacgtcagcggtgacgtcacctccggcggcggctcggcgactcggcagctcgggcgcacacgctcgccggcgaacgacggcgcggcggcgcgaacggagggcacccacgggtagcggactgcacgacgaactcaccggcgaccaaagcaacggtggaaaatcaacggacggcgacggcgtcgaggaagaagcggcggcgaccttcggcttgacgacggcgacggtgctccggcggtcaacagcgacggcggaggggcggacgagaacggcggtgacttggcgaccacgatggcgacctccccgagcgacggcgacggctggagcgacggcgaagcacggctggaccgacggcgacgacggcggctcgaggttacacggcgctagggctcttccgatggcgagaggcgaaagcaaaggtggcgacgggtagaggagacaccggggatccttttataggggttgaaagacgacggcgaaggcccacggcgaccggcgacgcgaaggaaacctcgggctcggagagagagaccgatccgaatcgacctcgaatcaaacactttccaagcgattttagccgatgattccaaaagagaaaaggtagaggagatcccgaagattgtttcccctcaattgatttcaccggagaaggaaagatgcaaccaaatttggaaggagacgacggcgcggctcggctagggtttcgggcggcggccgctggaggttgacgacgaccccgacaggcgggacccacctgtcagcgaccagacgcgcgcgcgaggcggctgcggactggactgggccgacttgggccggggagagagagagagagggttttgggccgactttcggcccaaagccaaaagagactttttaaaaacattttttaatttaaattattcctgaaatgcaattccatttattaaaaatacttccttagctcaaataaatcctagaaaaatctaggaattatagaattaagcaaagtatttaataaaattttatctggccccattttatattggaatttattaattaaaattagatcttctcttctaggcttttaaaataaattctaataattccaattaaacaacaatttatatatttttggatttttaggatgtgacagcggtcctcggctcaccctaggtcgacggcgacgacgaaaaaggctgtcggagcggaggaaggcggcggcgcggctcgggtcgtcggggtcgacggcggtccggcggtccgcgggctcagcgaggggttggacggggtcgacggcagtgcggcgaagccggaggaggcgacgccggggcgggagacggtccggcgagcggagaaggccggccggaggtcgtaggcgacggaggagagagagagcgacggcgcgagctcgattccggcagggagacggtgcggcaagggcggaaacgggcgagggaggcgcggggagggtttatatagggttggaagggggagagggcggccggaggggaaggaaaccggcgcggcgctctcgggctccatcaatggcgccggcgggattaggggagggtttccaaacgaatccaagggagagagggggggaaaattggggggaaagggagagggaatcacggggaataattcccccttattgattgcacgcggggaggacgggatgcggcggattcggcggcggcggcggcggcggcgcttggcgcgggcggagaggcgggagcggcgggaggaaggggatgacgggtgggccccacccgtcagcgagggtggtgggcgggcccgcccgtcagcggcgcgcgcgcaggaagaggctggatgggccgcgggggagaggagaaagggggagggagatgggccggattcggcccaagagagggaagagggatttttagggtttttcttttttaaaaccttttcaactttgtttatttcttaataattattatttgtgctctgaaaattccactaaaatttatttacgcattttaagcttttaggaaatttacaaaaatcctctaagccttatttggcttttaactttgcacattttaattgttggtggggttgggttggtactcttgtttatggctaggatgggttggaaactatgtcatgtcttccgtccggataccgtggtggtatgtggccgcgccctcggttatgggcaagccgagcaatgtacccaagttagtgtttttaattcttaacacctgcttaacaactaaaatgtggaatggttggcctgggttggcttgggacgagctgggacccagggtcgggttgccagttcggtctgaatcatcgtaggccttgggttaaggcaggttcgtgtgagttcacggccttgattaataatcttgtatagctctaggaccgtgtttacaaaatagctttgagcaactaagtgtcttttagtgctgtttactgcaaaccctaacccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcgccgcccatgtaataaagtaaccatttacgcctccgcttgataaactctgaaatgtatcaacttttggtgtaccttgcctcctgggacaaggaataatacacacatgtaaggaacgcccgttgggttatttccggtcgtgacatatttctccgtatttagccccggttgtatggttatgacgggctgtcgtaaagaactcggcagtcaggggtggctcctcgaagtaccaggagggcatcggaaagagggtattagctagtatgttggttaactagaatgtatgtatactatgtatattagaagtatagtaatagattatctttctattttcttcctacctagcttagataatatattataagaatgagtagcttatgcttgtgtgttactctacccttggattatcttaacccatgcttagaatatgattatcacaaataatatataaattgttagtcaagttctctctatatgatcttcccacgggataaaataaatacaatacccttggaatactctcgggtgaaatgctacaatggtatatccgtgcgcttgcggatgaactctgtaaccataatataccagaagtatttgtgtgccattggtgggaattatatttctagtaatgtcgttaagaaataccaacagaggggagaattatacccgaacgagtaagctctccgcagccgcgcaccctacgccgaactcattatgctcggtgatgggactagggccaccagatggcgaaataatctggcagaccccttcaacaaagggaccgatctccggtcgggaggtgaagtcggcagagacaaactggggcgcggtgagtgtcatatcagacactgtcatttagatcgccactgcctggccctctcgctggcgactcgccgaaggcaatgtcacagccccaccagcgccagaggctttcgccgtcgccagttgcaatgcctggtccgaagcaacagcgttggccgaagtgctgcccccggttggcgcgtcggcatcactagcaggcagtggagacaggagcctcttttgtggaggtgggtgtcgtggcgccgacgaagttggcatcccatccgaagatgtttcgctgtccgagaagccaccggccacctgcaccacccctttcttcttcctttgggcggcggcaccggccttcgacgacgagccagtgatggttagcaacgcattagcactagcgatgttttgaggacgcgtgggcgaagcgctagagccggccccagccttcgcccgaacagggcttggggtatagccgtgtgacccagcatcgtcgtccgacccgtcttccctctcatcgtcgttgtcgtcgtctgcgttggtctccacggcgtccttggccactcgccgagttcaaacctggcttctcttggccacgtcgcgcttccacttttttgacgtcccaacgtcgtgatcgactctcgcagggttcgcccggctggctagcgtgccgtcgtagacgcgattcgcctgtccattggactgttactgaagcaggcgagcgtactcggcggtaattaaacccccgatcattttcgccgactcagctttggcatcctccagcaaacgaactaattaaaaaggggaaagatgacaaaaattatataagcccaaacaagccccaagatgtgagatatcgaaggaggggagggaagcttatgattgatgccaggaggaagcacgaggcgggaaagaccgagcacttcttcaccctctgcggtagtaatcccccaatctcgcgcgaggggagaaatctgtagcatgcaaaatttttcgcagaggtcgcgggtgctcaaccgatgcgcaaccttgcgaagaaggatgagccgtgcctcaagcacgccatcaacatccacgttcggcttgatgatcatggcgatagaaagacgccggaagcgaagccacttcgccttgtcatcttcggcggaatcgtctttggagaagtaggggttgtcgatgtagaaccatttttgcatcgaattgcggtcccactttgccatcgacacaaggacaggccatgcatccgagcgctttggccgaagcatgaagtttacactgccaaaaacagtcttctttggccccgccagagtgttgtcgtccttggtcgccacgcacaccatgaacagggtggcgaagagctccgcggtaggagtaaatccacacgtccggcacatccagacgaacacgaccaagttgagaaatgccgatgggctgagctaggggagcttgatttcgtacaactccagcactgatggcagaaagttgtcacatggaaggcggagcccggcggtgaaaaaggcggcgaacaccaccgttcgcccgtccccggtcgaagggacaacgtcttcgcccgcacaggacacctggcgctccgcaaggacgctggagaggacaagctcggccaggtcggcctccttgacaagaaacttgccaaggtagcacgaccaaccatcgctgaggctgccagggtcttcgccagacgatccggccttagtaggcttgcgaggagccatcgaatccgcgatgaaagaggtggcgaagacaggaggcgaaaagctagagcaggaatgatagggctgaaggcacgagagtctgacagcggtaaaaacgagaagtggggaggagtgatagcgacctgggatgagggttgtatagcccgatcgcacgacggttcgactcccacccaaccacagcctgacacatgtcaaatggtagacggaacggtaaattcccatcgagccgggccacacagtggcaggctagaaccaaggaaaaccaagaggcccacggagcccgatactgttcactttcaatttcaaaccacctaaccatttcgccataacttgggcgaaataagaaaagattactaacacaggaactaagctctttgtaggtgcaaaaggataggtttcagtaggaacatcggccgaaagggggcgcctcatgccataccacacaatttgcatttgcacggtatcggccgaagctccctacttacccttgcccgtgaggggcttgttggaggtataccacgagggccttcggccagacctgccgaaaccgttgtcacaccctgattttcgtcttaggatttataaatcatttaataaattattaatagaatttatattaaatgttcattaatttacaagtgaagttaattgtgggaaataaaatttcctaaatataaagcatggatggatttaattttttattaaattctccatggttaattatactctctggaattttctcggattttttcggagctcaattcctaaatgatacaaagaacagttcagtaattatttgatcaataatgatctaattataattgttaagtgcttttcttgcttaaaatccttaaattataaattgttgtttaaaaggaattattagaaatgattttaaaagcttaaaagagaagatctaattttaatttggtaaatctcaatataaaattgggttagataaaattttattaaatactttgcttgttcctctattttctagaattttctgggaattgtttgagcaagggaagtatttttaataaatgaaacatcatttcacgaattattttaattggaaaagtttttaaatcctcccctaagtcgttgggccgatttcggcccaactcttctcttccccgcgcggccgaatcggcccaagccggcccagccgacgccgaccgcccctcctcctcgggtcaccgacatgtggggcccacatgtcggacccatcttcctcctccagccggccggctgcaagccgagcccaagccgtcgcccgagccgccaccttgcgccctcaaatccgcatccaatccggccctttttcttccgtttgtttgaggggtttttatccccacatcctcttctatctttcccctcaagaatcggagcaaatcgttgggtattttgcccgaatcaaactcgttttcgagtttatccccaaaaaccgagtttagattttcccggagcgatttcttgcgggtggagtccgatctcttcaatccaaggctataaataggaccacctcgtcgccctctttcgtttgccccctctcccgtggtctcccgtgcatcgtagctcgccgtcgacgtcgcttagtccgccgccgccgccggccgggttgcagccgcgccgccgcgtcgctttcgccgttgccgccgcttgccgtcgccgcccgtaggtgcgccaaggggtggagaagcctggccgcccgtcccccttcgccgccggccaccggagagccgtcgccgccgttcaaccgagccgccgccgcctcttgcgtcgtcgccggccgtcgtcggttgtcgtgggacgttttggtgagtaccatcgggttcgtctcgtcgtcctcttcgcgtaggtgcccttggataggccggccgacctctctatcgccggcgaggtcgtctcccgtgtcatgccggcgatgatgacgtcagcatgacgtcatgattccttttttccagttttttctaatagattaaatcttctgaaaatcatatctaaataaccgtagctccgtttcaggtggttcaagttactaaatttttctaaaataaagatctacatattaaaattgtccataaattgaattaaatttatttaattctttttaaatgggctttaattagatttaatcttgtaaaatttataataaattcacttggagtcagaataaggccgttcaagtctcataattcatctaaaatcatgatctacatgtttgtttactttatatgtattgtttatttggtttttattagccttttacttcgttttgcgtgttagcttgtcgtttccgtcgttgcgaaggtttgtgagtgcgtcggaagtgatcaagaagattaattgaagatcgattattgcaaggcaagtcacagatcctaaacacaatcctttgagcatgttgatcctatatttaaattctctatttatttcaactgtgcatttattttcgaatgtcaccgggtggtgtgaacctattcctttgttatggccaatttgcattgaatgctctattccttgataccttgggtaataaattgattagcttgaaccttgtatattagattggttcagctaaatgctatatgtaagtttgcttagctatgcttagaaacattagctaactaaaggggttaattataaactatgttatattattattattaattatggttacattaaatggtagctcacgatggttaatcgtgtgatgttaattaattgataattaaaatctggttaaggtgggttgtgagcatatggttttgatggttgtgctcatgacaattaaggaccggttcgcgagctactgttgtgaaacatttatcgtgccaaccacaagccaccgtgggcaacagctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccatttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttaatatctggtaataatttgcttagctcctggtttggagttagatctgtacagccgggtatggttgttcaggatggttgggcctgtgcagcatgggtgtgctgttcagtgttgattaaaattaatgattaattactctactgttttacttatcttaaatctttgctaaatgctgcttttgcaaatgagcctatattatgccatcctttggaatccttgtgcacttgcatacttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattatgatggatttgtatattaaattgtcagtttgtgtacctcgactgattcctggacgaggattttatgcacaaattagttcggaaattactagtgaatttccgggcgtaacaaccgtccacccaatgaaggatcaagccagaggcgtcaacttcgacaaaggcgaaggcacacggcgaaggctatgcggcgaagcatgtgggcgaagatcaagggcctggctccgagcttcgcagttcgaaagaccacatgggcaaagggtatatggcgaagggcatttagcgaagcatatggacatcacccaagacgggccctgggcggagaaggcccaatgggccactatgcgcccgggggccctttcgccatggctaggccaagcttgttggcccgttaagagcccatatatgtaaaggacacagtatgccctcaataatgtccctatcataagggcaaccatgtaaaatcccctataatcataaaccctagaagaacagagcctataatagggttataaatagccccctaaggccatgtaatggggggatccccaaaaaatttctaatcaaccaatacagtcgtctttatttccaacctgttgagagagccacgtcgttcgacgtgacgcagttatcgttcgacaacaaaaactaagcaaggaaatagaaagtggtactctatgatctgttctgtctctcaattgcctaaggtggtgacaagcgtgtattccacaaatgttagtcgtaagggtaagcctccgtgcatatttaattaacatgagagagagtactcaaactgtgcgcttgtacattttagatatacaccattgtagcaactcctgattaacaaccaagtttttgtttccctttcgtcctttactcgggacgagcaaaggttcaagcttggggggttttgttgacggtcgttacagacaaatttcgaccgtcaatataactaaaataatggagaattagctatgcttacaatgcattttgtttccaaatagtatatatatttccacttgtacatggaaataacatgttacaggaatttatcaaataaaataaagagaaagcggagaaaacctcactcctaagcaatcaaatggataaggagggcccacatgtctggtgtaaccgccagaaaccgctttaactgccataaccacctaaaggacccacctgtcagtgccctgcccgaagctagaggcctgctgggccggcctaagttcggctgaactgccgaaccctaatggcgacggctcagcttggccctccacgtgcacgctccaaatcgcatactaatgacggttacaggggcaaaatggacaattcgcatagctacaaccgtcataaatacccaataaaaggaggagctcattcactctctcaacacactcaagcaagctcaaattcttcttcatactttagtattagtagtatagtgctaagcggagtagagtagattagtattcggagtcctcgaggtctccgaaagagttttggtatggctctagcagctcttgtattctcttctgaatactttccgaattaatgaaatactcatttttatacatcttcggtattttgttcagtctgagtactggtcttacattatatctgtgttatattaattatgtgggtagcctaccagagaggtgtaatggtgcgggtttaatgtttggtttaccagttgctctatgtcgtgtgcgcgggtatagagtagtatttagtaatgtaagtgtggtacttagattattaaatatcattaattgggcatatatgtgcgggacagtagaggtgggccgctgatggtgatagctcagtactggtattcctccacgttagtatatattcctaagacaaattcctggggagggactcctccgtattttaggccccggctggacggccatgataggttgtcgtaagaactggccaacccggggtggtctctcgatgttaccaggaggacactgtgggggggtattggccatatgattgtatattagcagatgtaaactaggaattgagtgtatgttagaagtatagtaattgagtgctttctattttttcttccacttagttagaattattttattatgaggagttaaatagctttgcttcgtgtcactctacccctatattaaaattaacctctgcttagattttgataaatacaaataatgtatgtataaagagtattagcatagtctactcatattatcttcccttggaattaaaaatacgataccttggaatacttccgggtgaaatgctacaatagtatatccgtgtgcttgcggataacttccgtaaccataaatataccaggacaatttctgcgccattgctgaacagtgactactgtgacgacatgggtatcaagctctgcttcacctcacccgcccaccccaagagcaacgttcaagcggagcgtgccaacacggaaatcctcaatggcctcaagacgaaaacttacaacgtcctcaagaagctcggggactcatcgatcttggagctgccggcagtgctctaggccgagccgcgcaataggagaaactccatgtttcctcgtgcacggggctgaggcggtcctcccatccaagctgaccctggggtcaccctgggcatcactgtataacgaaaatgatcaagatcagcttcgacacgacgacctcaactaccataaagagcgaaggcaacgtgcagccttcgggctacccgttaccaacaaagcctgcggcgctaccatcagtgcaacgtccgggcctggtcactgcaagtcaaagaactcgtcttgtccacgtcccaacgcgtgcaagattgagcaaactctcacccatttgggatgatgttgagggtcgttagcgatcaatttcgaccat

SEQ ID NO: 70966 - DNA, 518 bp, Oryza sativa
acctttgagcatgttgatcctatatttaaattctctatttatttcaactatgaatttattttcgaatgtcaccgggtgagtgtgaacctgttcctttgttatggccaatttgcattgattatcctatttcttgattacctcgggttataatttgactagttggatttatatattggttcaactagatatattagataaattgcttagccatgcttagaaacattagtacacgattgggataactaatgtttcactactacttaatgatggacatgataatggtagctcacgatgtctaatcatgattggttaattaattaatgtgccaactaaaacttgataatggtgggttgtgagcacatggttttgatggtcgtgctcatgacaattaaggaccggttcacgagtttcggttgtgaaacattaaccgtgctaaccacaaaccagaatgggcaacagctggacactttgtatagcaaggctcattgtggtgtgccagactgagatgtggcggagac

SEQ ID NO: 70967 - DNA, 7413 bp, Oryza sativa
cagtgcagccaagaatccatggctaatgacacttaggttcagggcttccaactgttgattaagttctggtggaatgccgcggacgcaaagagaactgcaatagcctttttgactcagcgcgtcggccaccacgttggccttaccagggtgataatggattcccacatcataatctttgatgagctctaaccatcttctctgctgaagattcagatccgactgggtgaagatgtatttcaaactcttatgattggtgtatatttcgcagcgatttccaaagagataatgccgccagatcttcagagaatggaccatagcggccaattccaagtcatgggaaggatagttgccttcatggggtcgtagctggagtgaagcataagctaccacatgaccttcttgcattaacacacaccccaatccttggcccgaagcgtcatagtacaccaggaaatccttgcgattatcaggtaagattaacactggcgaggaaaccaacttttccttgagagtttgaaatgctctctcacactgcggactccacacaaatttttcttccttctttagcaactacgtcatgggcctggcaattttggagaaattctcgatgaacctctgatagtacctaccaaacccaagaaactgcggacctgggtgaccgtcttgggttgcttccaattggttatggctgttactgtttcgggatccacagtaactcctttagcagatatcacatgccctaagaacttgacttcggacaatcagaattcacacttgctgagcttggcatacaactgatgttcccggagctttcccaacaccagacggagatgctgcttatgttcttcctctgactgtgagtacaccagtatgtcgtcaataaagaccacaacgaacttttccaaatactccatgaacaccttgttcattaaattcatgaagaaggtaggagcgttggtcagaccgaacgacatcaccgtgaattcatacagcccgtactgcatggtgaatgcggtcttagggatatcttctgcacagatacgcaactggtgatatccggaacgaagatcaatcttggaaaagacagtggcaccttcaagctgatcgaacaaatcatcaatccggggaagagggtacttgtttttgatagtgacttcattaagagctcggtagtcaacgcacatcctctttgtcttgtctttcttttctacaaaaatcatgggagcacctcagggggaagtgctcggccatatataccccttctctttcaactcttccaactgcttcttgactgcggccaattcatttgttgccacacggtagggtcgcttgtacatgggagcggttcctagagcaagatctatcctgaactcaatctcccgctttgggcggcataccgggttgctcttccggaaacacatcaccgaactcgttggctacgggtatttctgatagtcctagctaatgaagtactgagttgccggtgggagttgggtgcgcaaagaagacagccggttgatcaggcttccggtacacagtgacagtacgtcttgtgcaatccactactacttggaattgggtcaaccaattgatcccgaggatcacatccaagtccttggtgtcaagaaggatcagatccgaggggaaaggaattccctggatctctatagatacggccggactataatactttgttgtcatagcccctccaggggtggtgatgagcagagagctcctaagctttgctacccccagttgatttctccccatgaattgcacagatataaatgagtgggaagctccagagtcaaacaaaatgatagtggggatggaatgaatgaagaacgtaccggcgatgacatctggagttgtcagcacatcttctgtagtaatgtggttcacacgaccccgagtggcatcctttccatcattgttggggtggggaggcgcttggccttgctgacgcctcggcttcgggcatttatccgtgaagtgcctaggctcaaaacagtagaagcacagacgcggctgaccttgaacatccctgcgtccttgactaggctgcacggccggtgcagggggacggggtggaaggttccctttctagttctgctgctgctgcggctgtgggacgcaaaccacaaattaaggtcgtggcgcggggcgaggctgctgttgctgctgctgctgtgaggaggatccccctggatagggattggtgtagcggatcctttggttagccccatgttgattacggaaattcgccaagcgacgcttgtgtgactccagttccttgtgcttggtctccaggcggatgctcttgtccaccaggcgctggaaatcagtgtaatccccggtgaccagacgcaccgaaaagttcagggtccattcctaccagaaacttctcctgcttttcttcatcttcacgaacatcctcctgggcgtaccgggccaggttattgaactcatgcaaatactccgtaacagaacggttgccttgcttcaactcccgaaattccctcttcttgagggccatgactccagctggcacgtgggtcctccggaaagcggcggtgaagcaggcctaggtgattggctgcccttctggttgtgtagcctggaagtggtcccaccatagtgatgcgggcccctgcaactgatgggttgcgaagataactttctcctcatcattgcactggacggtgtccaactttttccccacggcatgcaaccaatccaaggcatccacggggttattggagctagacaaggtaggcgggcggatgcggaggaactcggcaagcttggagtgctgtgggggtggtggtggtggtggagcattgtgttgcagcggattctggatgtggtggaggaaagcagccatcatgttggcctgctgggcaaggatttgggtgaggatggggttggtgtcagttggcggtggtggcggcagagggggaggtggaggtgggctgccatggttgttgtggttgctgctttcggggtgacagccctcaccggtagcagcgcttctcctggttgtcaccatctaaagattccacatagaaccagaaaacagaaagagttgacgattaaaactaaccacccacgactaccataattcttgaatttatttctgctattaaattggttcattaaggttcaagtcgcttatgcgaaataaataaagacaggctccgacacagttataccacacaccggtataaccatgccccacacgactctgcaagaagacaaacgaaaagaacacacgcgcgggcctactagctgctcgtctacttctgcgacgggccggggcggaaggtgagcaacagcacatcctctgtgctgccaacgccaaaggctccctcctcctgaggaaccaagggtgcgggctcggcgcaaggagtctccacgaagcaggtccacgccaaggactgacgaacaagctcaggcctggaggtactcttgcgggcggtgatcttctgactgcaacagacacggcggtgcttggggtggcagacctgtccttaagcaatcttaagctgacacagctgcgcttccacggcgtccaactccttcttcagctagaaattctcctgacgcagctccaggatcttcatgttgttctcgaccaaaccacggcgcaccatatcgatggaaatcgatacgggccgtgtcatacgcctccactatgcacgccaaatgcatgatggtagcgtcatcctccgcgctagcatccctgaaggcggcgtagtcgcgggttcctccatgacgagggtggtagtggtagggcgagtgctgcaactcgtccggatagactggtgaagagtgccgatggcgaggagcacggcgttctgccaagcggcggggaaggagtctccacccgcggtgactgccagcgaattgctctcgggggagctggtgaggatcacagtagtgacctcccaagcggcacggggctgtgcatcgtcaccatcctgctgtgaaagcttcttgccctggtagtccactccatgcggatatccctggacaacgcacatgccccgcagctccaaagcgaagccagtcagatcaagaccacaccggttgaggttgttggccatctataaacaaaggcaaaagaaaaattttagagatcagcttttgatgagaaataaagcagcaagacagagaaagactaaaggattttcgcaaataaggggtggttttttatttcaaaatacgaataaggcttggggtctaaggctcgtcctagggtcaaggaggctctgataccaacttgcacgatcagaattaacccaacaggcattccatacatgcgggtattatccttgtcccaggaggcaaggtacaccaaaagttgatacaattcagagtttaacaagcggaagcgtaaatagttaatttattacatgggcgacgaaggcctagcacacatgaagagaaacgaaaaacaatggaagactagggcgacgaccacaggcacttcacggtaggcacgagctagacaccaaagccttcatcctccaggaactcctcttctggattggggaaaaaaatgagcaagattgagtacaaccaccgtactcaacaagacacccacgaatgcagaataaatgcaaaggagtacaagggggttataataaaggggttagggtttgcagtaaacagcattaacaagacttttagttgcttagggtcattttgtaaagacgatcctagagctacacagtgttattaatcaaggccatgaacacgcacgaatctgccttaacccacggcctacgatgattcagaccgaactggcaacccgacctgggtcccaactcgtcctaggccaacccaggccaaccattccacatttttgttgttaagcaagttttaagaattaaaccactaacatgggtacgttgctaggcttgcccataaccgagggcgcggctattcgaatagattatactctaatcagaggtgtacatctatacccacaagacacgtcttcctcatatgtaaccacgcgccacataccaccacggcatacggacggaagacgtgacatagttcctaacccatcctagccattaacaagagtaccaacccaaccctagctacggctgggattcccgagacaggtaaccaaggttgagaccctagcagtaagacaccggccatgtgccatgacatctcgactacctgggcgcggctcgtgtagccttcatttgtcctagagatgtccatcgagccccgacttcaaccatccctatccgtgtacttttgcccatgacaagactgagacacaaactaagccttacccactagacatgtggaagtacggtagtgctttgcaatagaggcccgaagaccggtccttatagtggccgaggtgctactatcaaaacaatacacctcgagcccagcctaaaaccatttttggggttttgaatggaggagaaggggtgtgtccatttccacataagccaaccattccatattgtccaaatgatatgtgcatttcaaaagtctaaagtaataaaaccacctaatgttgcctaatttatcagcgaagcatctacctaaattcatactagtggaaccatgaatagagtacctattagttggggttttgtttatcctagggtgaacaaggtaataataacattagcaataatgaggaggtcataacaaaggtaaataggcatggctaaataaacagtgataacgcgggaatttaaataaagcaataatgcaataatttaaacctaaataattttataaactgggattcaatatgctcaaggatgatgtgacttgccttgctcgctttcccaaaagtcggcttcaacctccacgtagagcggatcttctgaagctgcagcgtctacacgaccaatgaaatggaaaaaggcttttactctaataaactccatataacaaacaaaaacaaagcacaaaaatgggtccttgacttcttaaggaaaaattagagacttgaacagtccaattccgagtacaaacgaccaagttatggccacttgaagtttattgctctttaagtcaatatttgtgaatttcttcatttaattttttagttaaaacgatttattgcgtcagccgaggggagggggcgcgcaggctgggttcacaggagtggtgggccccacgcggcagcccctcggttcacggtgaaccgggtgcacccgcgggctcaccagccggcgccgtgggccccacgcgtcagccgcacccgagggcacgggcggctgacggcggggccccacgcagtagccacacggcgtgcagggaggcggcgcccgcgtccctatggtcgccggcggcagccataggcatggcggagcggcggccgagagagaggaagggaagggtgaaaggaggcagcggtccacggctcaccccgggcgacgacagcgacggaggaggcgatcggagtggagggagacggtggcgcggctcgggttcgcggggacggcggcgttccggcggtcggcgagctcggcgaggcgatggacggggttggtggtggtgcggcgaagctggaggagatgacgccgaggcgggggacggtcccgggaagcgactaggcccggccgaaagtcgaaggcgacggcggagagagaggacaacggcgcgggcgcgaatccgacaaggaggaggggcggcaaacggcggaaatggacgagggaggtacgaggagggtttatatagggttgggagtgaaagagggcgaccggaggggaaggaaaccggcgcgggggttatggtcggcatcaatggcgccggtgtgatttgcaggagcaaatccggccgtttgaatgtgggagggggaggggaaaatagggggaaagggagagggaatcacggggaacatttcccccctcttaattgcacgccagaacagtcgggggcggcggatttggtggcggcggcgctaggcgcgggcggaaagagcggcgggagcggcgggaggagggggatgacgggtgggccccactcatcagtgagggtggcgggcgggcccgtccgtcagcggcgcgcttgtggggaggaggctttttagggttttctttttataaaaccttttcgactttgtttatttcttgataattattatttgtgctctgaaaattccactaaaatttatttacaccttttcggcttttaggaaatatacaaaaatcctccaagccttatttgacttttaagtttgcacattttaattttggaggctttcacttggattttaattattctaggcataattttaaggatatagttttagcgtcgttttgggacgtgacagccatgcccatgggtgagaagttctgggaaagaggaaagatttgattttgatatcaccatggctgataagattttcgatttaaagctaagaaa

SEQ ID NO: 70968 - DNA, 23787 bp, Oryza sativa
  unsure (1)..(23787): unsure at all n locations
tgcttcagcgaatttgtgatgatggacaccaggcgttgcggaaggtggatcacatggcatggaaccatggatggatagttcgtcccttatcctgtctctttttttttttttctggaaaacagaggatagtactggatttgagtatgaacataaatagtgagggaatatgaattcatatatggaggaaatatatgtcaagctaaaagggaattgccctggtctcccggcaaaaaaaatagagaacatcactgatcacgaatacttattagtgtgatatactatcacgcaagtaattatcatatgactattcgagcgatatgtccatatgaaatcagattagcaacttaacaagcacatttagccgtgtatatgatatgtactgagatttttcttaaaaaaggaaaataggccactagagcgcaggggtttccagcacaccttaaacaggagaccacaacttagtacgaaactaacactaaggcctggtttagtttccataacaaaaagctaacaaacactaaacgaatcttttaagactaattacgctatgatctgacaatgtggtgctacattaaacatttactaatgatggattaattagacttaataaattcgtctcgcaatttcctggcagaatctataatttatttattttgttattaaactacgtttaatactttaaatatgtgtccgtatatcccatgttaactaaggttgtgtttagttcagcgcaaagtttggattttggttgaaattggagatgatgtgactgaaaagttgtgtatgtatgacaggttgatgtgatggaaaatgactgaagtttggatccaaactttggatctaaacacagcctaaacccaaaatttcccagatttgagtgctgaaaagatgtactccctccgtcccaaaaaaaagacaaaccctggtttccgtgtccaacgtttgaccgtccgtcttatttgaaaaaaattatgaaaaaaattaaaaaaataagtcacgcataaagcattaatcatgttttatcatctaacaacaatgaaaatactaattataaaaaattttcatataagacggacagtcaaatgttgtcacgaaaacccactgtttgtctttttttttgattgagggagtatctactgacagagaagctaggcttggtaggcgacgagattcaacatggtatgttctgctgcaagcagtaacctttgtcaattcttggaacgcatcactctccagtcttacacgttttgcccttaattagtccatcatatcacttcactacacatatgttctgactgcagctgtgcattctatctactctctccgtcctagaatgtagctatttttaggattcaaacttgtcccaaaagaagctatttctaggtagatgagaggctgttatacctgttttacccctgcaccccacagcactgacacaccacatatccccagtctatggaggagacgaggagataggcaccagacttctttggtttgaattttaaaagttagtcccattttttattctggatatgcaggtgttaggggaataggagctgtggaaggaatgctgcgtgtccttgtgccagcatattcatgattccgtcaaagaagggcactatggtcataacacccaaaaccttaatccatccaaacaacctagaaatagctacattcttgattctgagacggaggtagtaggatgttttatgaacgtacggttgagttggcatgttaaatttgttgttatcttctaggtgcacgaatattggtaggagatgaatcattcgggaatcggatgtatctcttgtgcaaattctggactaatctaatcgtgtagagtatactcttgtgtgccttcttagccaatggatgtcagggatgaattagcagaacacacaacatgagtacatcagatcgatcaaaataatgattcataaatttctgcactaatctaattgtttaaaatatatacttgattgtggtggcaatcaaattccggttcagctattagaaaggttaaacaatgaaaagctatgattttaaaatgggtggtgatagtagcacaacaatttcaatatttgaaaccgaacaattgggttctcgacatacatgtgcattagacccaccactatttatacatagaaaaatatttgtacataaattttaattggacataactacacagctagtgctaccactccatctataagaggcaccatccacctatacttcaaatacatttttttcttaaactactcatccgatctatgatccgattacaccgttgtgttcgtaacaattaaatctttacaacaagatctcacatgattatattttgatgaaaaatcacaaaatacttttataatatgtctaaattacttttagattttacttagttacttcttagatatataaaagtaaattcagtaaaacctaaaagtaatttacatatattatagaagtaacttagaacaaaaaggtaactttagcatgtcatttgaagtaaatccgtagtagagataaaaatatgactctatctagaaattaaattaaccagcacaaattatggaattaactaaaataataataaaagtaatcaccccagagcattatgaatgtataggaagtattttaatcaaatctaaaagtaacttttaactcgccgacgacattctgccctttccaccggagggtttctgctccatcaaaaaactgcagaactaaatcttcttgctcacaaatccaaaagaaacttctgctcactccttttgtgtcctacatcaccgtctacttaaatagagtctctgtagcaacctccacactaactactctcctggtcgcacggccttgcatgcatgcggatcaacaagccatgcatggagaaaattcaaatgcctcaccaagcagaacacgcagcgcagtaatccgaattttcaaaaaaatgaagaataatcaagtttctgcagcggtggattagtggatcttttctcaccatccgttagtgagttgaaccccgaaaccttgatgtgagatggacaggtgtccggtggttacaataggagtagctactcctgggagtagtatataggcttcctatatatatatgtatatgtacatacatatatatatatatgataatttgttcaatgaaaaaaggcattaattaaagttactttctttttgttataataatatatgtaaattacttttaggctttactgaatttacttttatatgtgtaagaagtaacttagtgaaatctaaaagtaatttagacatatcataaaagtaatttttgatttttcatcaaaatataataatgtgatatcttgttgtaaagatttaattattacgaacacaatggtgtaatcggattgtaaatcggatgagtaatttaagagaaaattttatttaaagtatagatgataggaatatttcccctacatgctcaatggattaatagcaaccaaaactcctaaagtactagcacgtgggtgtctccggttaagactaattggagaggcctctccaattaaaattaaatttaccgtatgtcatttttttatttttcataggacactgaaaataattcattctgaacagaaaaggagctagttgcggtactctgaagataagttcagcccaaagaacagagcatgacagtaaaatgatgaaactgattccagaatagcaggagacgctattgtttatctattgtccctttatgccgaagacatttgcaaaataaaatcccatgcaaattatttttctcaatcatatgtcattcacatgaagaacgaagtagttaccagaagattccaatttttctaataattccatgtgaactagacagctcttggttaagttcatctgttcatatgctgacttgtcaaaaaagggtgacaactgaatgacaatcctgctgcttaacaaaattaagtaagcaaacatgcttgtagagtatcttgttaaactttgtagattagtactgctagttgaaacaactagatgatgttcatggagaagcagaagtggaaagcttgcaaagcagttgagatgggttaacgtttctcaggtccgttgaggatgaatgtatctttttctctctcacactctcctctacaacccttctcgctgatggtgcctgagaggccaccgtgtttcttagttgtttggacagtttgctgggcagctactttgtaggtctagcggtgtctggtcacacgcacagtggtgttgtcagcatgtggtggtgtgtttgtttttcttttcattcctaattacagattcacagtattataggcttatattttttttctactatattaatatgagataggagtatcacactgtccgataccgtttgtttcgaaaaagaagagcttgcaaagagaggaggtaaacaacatgttgcaaagctaatgtgataggatgctaattaaggtgagagaacggaaaccggtggacagaccacctgatgatcttttttctatatgcttgtgtatttagtctgctcctagttttccaagggtttatggctctttagtaggaaaaggttggtttttttcttctatgttaatgcctaaatataaaagtaggcctttttatgttgcaaaaatcgtgtttttgtaagatggaaatcctagcggatcggtgtggtatatgaatgtgggtactctttttgtttggctttcttccaaaagctaggtcattatgcaatataatgatcttacttttaaaaaagttgaaacaactaaggatggaagtatcccagatagaccgagtatcttctctagcatagttagtactaatgtattatgaaaaccaattataccaaattgccaaccaaggttctcttttgagaacaaccagagacctgcattattgtcattatcttccttcctagaacatggcattgtgctacatggttagtagattgcacatggcggcaatgccatttgccgccattgaaggtccacagcaagataaggttactatcttttcagaaatagtttttcactaacactaataaatgggtcaacagctcccaacatcttctgagaacatggaaagactattgattttaaaattgtcccaaccatttccatatatgatgagattaatgggtacaaatgcatacataattaacttaaaagacaaccgaaagcaatggcggattcagtatggaggctggggaaaaggaaaccacccagtggatctccaatgagaacagggaaggacagctagaggaagaaggcaatgagtcccctcctacctcaagcttcatccctcagtgaaaatcgtaaatgcatttccaattaacctgacattccaaaccttcttttaaaatatatattttagcaggatactagatgccaaaattaaagagaaaaggaaaaatctatatctatgcctaataattaaaagataagtaaggtttccgggttttttcgtacgttgtttagttttccatgtcctacgtgcgtgtaaaaataagtaaggattgtgtttttcttttcatctgtcgtatgcacgtgtattatgtcgtccgactcttctctagatcagtttcctaatttgcacagctaggtccagttgcccaacatcagacacaaataaacacaataatcagttttggcccaatgtgtgaaatggtcggcctgtgtgctacaatttgcattgaacactgtatgccgtcatccggcaaaactttctatgctttctactaaaagcaaaacctttgtgcctttcgtaaaaaaagaaaagaaaaaagaaaggcaattagtccactcgaagtctcgaacccccaagctacatttgccagtaaatcatatatacatttccaattaagtcaacattcaaaaccaattttttttgaaaaatataaatctttttaagcagtgtccaacatgccaaaattaaagagaaaagaaaaggaataagataaaaaaaaatcatagagagagatatgggtctctaatcgttggatctctttgtaccacaacgttgtgcacatagcaattaatccaatgcacagaatcaaactgccaaatcgtgaaactgactgagatctcgccgcagagctgggagaaacgccaaaagaacatgaagagaagcaaaagcaaaactgctgccagaacagcacgacgagtctctttttatgatcttaataatactccctaagtttctcaatataagtcattttagcattttccatattcatattgatgttaataaatctagaaatatgaatgtggaaaatactagaatgacttaaattgtgaaacggaggaagtaattagtaatagtccctagtctctagtcatagttaaaggtttgcctagttaaagcgatgcaaagctttaagcagcagtagctctcactctataggaatataggatccagcagatcattcgatcgagtgaattcgctagtcgctacggttcaaatgttcaatgaaataaaataacgcaaaataaaaggcactgtgttatgttttatttttcgcttggatcgtgtcactacttcagttaaatataaaagcagtgacatgtcatctttgaaaaataatcatagtaggcaattttatttggataataatatccacgacacagaagtacagaactcacactgccaacgacacttaggctcagttcggcaccccacccaaacatcagtacgaaaacggaacaatctattagcacatgattaattaagtattagattttttttaaaaaatagattaatttgattttttaaagcaactttcgtatagaaattttttgaaaaaaaacacatcgtttagcagtttgaaaagcgtgcgcgcggaaaacgaatgagaggggttaggaacattaggtgccaaagacacccttacacatatccaaaatatttagtctgactcagattggataatatgtattcccttcgtaaaaaaaccaattgagtgctaggctgcaacaaaagacatactctatgtctagattcattatactagaatatgttatatcgtagtacttgattgccttttttttttggacctgcttcgttccaatataagcttagttttaggggtaagaggagaaattaagagcgaggaaaaattacctaggtgtcccctaataaataaaagatgataggaagtgagtaggtagttacgggtagaatgaagagaaatttaaggtagatgtgattgatgagataaatagtactttctcgatttcatattataagtcatttgaatttttactaagattaaataaaaaattagcaacatctaaaatatcaaattagttttgttaaatctaacattgaatatattttaagaatatatttgtttcggggttaaaaatactaatctatttttctataaatttgatcaaacttaaaaaaattcaactagaaaaaaaaacaacttataatataaagcaaatatagtagtgtaagattgtacttattctgggacagaattttgagcctaaaaatgtaccccctccatccaaaaatataaatatatagtactggatgtgacgtttcatagtatgtcaagatacattatactagaaaatgtatgatccagtcctaaatttttatatttttgggacggaaggagggagtatttattttaacaataatccgctcattaaacgaaaaccgagagattgtattatctgcgtatgctgtaggacatgcgcgttcacagctcacaagacgcccaaattgtgtgaacaaacaaacagcggaactcatctgccacctatacttcctgcttgttctagccgcctatttcctgcttgttttatccaacttgtttgggtttgaataaaaaaagtgcgtctacatcaaactggcaaagtacacgctacctcgttgaattttgctttgaccgaagccagcttaagctgaataaaatagaaaatatgcaacgtgtcccaaatttgtaccaaggccgacaaacttggtttctatgcctcataatgggtttgtggcgtgacaacttaaaaaaaaaacaaagaaaagtttgacaacatcacaaacattctataattagcatgtcggtattatctcatttatatgtatataagttagctaaaaattggtgaacaaatactaagtttagaatttaaacccatatatagagagcgaagtacataatcatgtggctgccatctatctagtgcttattagtttttaacttatagactcgatcttaatcaagctatttacttgacgattaactttaccacaactcaaaataccaatgtgtgatatgccatataaaataaagaattgttagtcacaagtgaaatactttggctaaatatatagtagcatctccaacagcttctccaaacgcctctctaagctaaattttagccactctagtaaaaaaaactccaacagcctctccaactggatggccaagccatctggccggccaaaatactccctcccctagcaaaatttggccagccaaagtcactggctaatggtgggccccacgaaaacacgcactgcgaggggagatggatcgcggcgacggcgagggaggggcgaaaaaggccggagaggagcgaggcggctcgatggcgaggacgcgaaggctcacggtgagggcgcgacggcttgacggtgaggtggatctacgatgagggcgtgacggcgagggaggagagaggaaggccggcgaggagtagatcctgtcattgcccgtcgtcgtctggcgggatggtggcggcagtgatggccccgagctccgccgctgtccccccccccaagccgttgacgccttctgccttcctgcgctgcctccgctgattacggactccattgcgtcgccttcctgcctccccgcacccgcctgcgcccaatgtcgacgggaaggaaggaaaggggaagaaggaaagagaaggaagagggggaaagagaggaagaagaggagaggagaggctgacatgttggtctgttgttattttggagaggattaatagagagtttgttggagtgagtatctcgtttggctaggcaaatcagataaagagttagctatatggatatttagagagtacaatttagagagactattaaagatgctctaagggaatgacatgtagggcaatatgctacaaagtacgattgcctcaatcttctcatctcaacaggataacatcattttttacactgccacgtcactacccacccgacacttaattttttatcccaaccagctcaacaatatatccatcccacggttaaaaacttttttctgtgctaatcccatggctaaaattggctaattatccacacattatccacaaatccagtgcaacaaaaaccccaaaaaccgcacgcacaagacccgggggtgcgtgtagctcctcaaccatataaaactccacgcatccaacgacctcgatcccctgattactctctcctctgttctgctctgctgttcgtcgcccagcctagattagggatgatcagggattagattagtgacagaggcccgattaaacaagtgatcaaactcactgttaatttgtttaatcactgctgattgatgctgctgctgctgctgtgatttttttagggctaaagagtccaagacgagaggtatctttcttgaacaattggttctgttgactcgcactgcactctctctctctctgtactcttcttatagctgttgctttctttctctcttttttcagagattcagagttgtcgtgtgtgtataaacagatttggagttgttgcgaaatttcttggggaggagaggaggaagagtgtgactctgaatctctgtctctgaaactcagagagggagagagagagagagagagagagagagagagagagagagagagagagagaagatggcaggagggttcggcggcggcggcggcgaggcgatcgccgggagggcggagcagtacgaggggaagatcaccggatacttcatcctcgcctgcatcgtcggctccttcggcgggtcactcttcggctacgatcttggagtctccagttgagtatcctgcatcttagttcttgtgtgttcttgctagtgatgttcatctgttcagttcttggaatttacattttcttttcgtgtccatgaaagatctgttctgaggttctgaggtttttgtctctgaattttctgaactttctttccaaaagtttggtccattatcactgaacatctatcgaaagaatcatttccaaatttgaaaaaggaaaattaggagcctggattattctgttcgaggttttgttaattgtctcgatcgagggtaaatgatgactgaaaaagaattcgttgtcgatgcaaaaaggagtgtgttaatgatggcgtctccatcttgattctccgtgaaaatgtttattttggggacgcaattatttgacacggctgcagagctgtccggggtaattaggaagctattgttagccacttaacgtgcagtgtctgtcctctcattttcagtagagatatcttctctcatgaaaagcatttaaaccccaagaacactctaaaacgtttttatacaacaccataagaaaaacatttctttttggtgaaataacaatgtaaaagccaacgccaattctgcaaaatctttatagtttgcaactatcggaacaatctttgcaaaatatgcattccatgatgcttctcaattatcaaacgaacaatctttgcagaagtgcaatctttgttctttgaagttactgaacaatctttgcaaaaatgcagtcttgatgctttacagttattgagcaatctctgcaaaggcgcaaactttatgctttgcaattgcagaacaatctttggaaaatgcaaacttgatgcttttcaattatcgaccgaacagtcttcacttctttacataagtgcagtcatctgctttgaatttgttgaaccgtcttgccaaaaatgcagtcttgatgcttcatagtacaatctttgcagaagcgcactttgcaaaaattacagtcttttcaagaacgcaaaccttgatgctttccaatatttgaacaatccttgcaaaactgcaatgctatccaatcgatctctctttctcaaaaaaaaaaaaaatcaaaaatcaaaatgtgcaggtggtgtaacagccatggacgacttcctgatcaaattctttaatctttcatttctgtccaacaatctttttcaagaacgcaaaccttgatgttttccaatctttgtacaacacttgcaaaactgcaatgttatcgaagaagaaatcaacaagaaaactaaccaatctctctctctctctctctttcttaaaaaaaatcaaaatattctggtggtgtgacggccatggacgacttcctgatcaagttctttatgcttttttttttaacatgcaaaaggattgcatggcagtataatctgatcaagttctttatgcttccaactctttctaacaatattttcaagaatgcaaaccttgattctttacaatatttgaacaactgcgatctttttgctctgcaagactgcaactgcaatgttatcgaagaagaaatcagcaagaaaaaaaaaaccaatcgatctctctctctctcaatgtgcaggtggtgtgacggccatggacgatttcttgatcaagttcttcccggaggtgtacgcgcggaagagcgcgcacctgcacgagacggactactgcaagtacgacaaccaggtgctgaccctcttcacctcctccctctacttcgccggcctcgtctccaccttcgccgcctcccacctcaccaggcgccgcggccgccgcgccaccatcatggtcggcgccgtcagcttcttcctcggcggcgccgtcaacgccgccgccgccaacgtcgccatgctcatcgccggccgcctcctcctcggcgtcggcatcggcttcggcaaccaggccgtccccctctacctctccgagatcgccccctacaacatccgcggcgccgtcaaccagctcttccagctcaccacctgcctcggcatcctcgtcgccgacgtcatcaactacttcaccgacaagatccacccgtgggggtggaggctgtcgctggggctcgccatgggccccgccaccgcgatcttcgtcggcgcgctgttcttgccggagacgcccaacagcctcgtcgagatggggcggctggaggaggcgaggcgggtgctggagaaggtgagggggacgaggaaggtggacgccgagttcgaggatttgagggaggcgagcgaggcggcgagggcggtgcgcggcacgttcaggagcctgctcgccgcgcgcaaccggccgcagctcatcattggggcgctcgggatcccggcgttccagcagctgtccgggatgaactccatactcttctactcgccggtcatcttccagagcctcggcttcggcaactccgccgcgctctactcctccatcatcacgggatccatgctcgtcgtcggcgcgctcgtctccatggtcgtcgtcgaccgcctcggccgcagattcctcttcatcgaggccggcatccagatgatctcctccatggtcagtacactacacagacgtttcttgatttttctttgacggtgctcggaggactgacgccggcaaggtgtttgtggaaatgcttaggtggtggtggcggtgatcctggcgctcaagttcgggcacggcgaggagctatcgaagggcgtgggcacggtgctggtggtggcgatctgcctgttcgtggtggcctacgggtggtcgtgggggccgctggggtggctggtgccgagcgagctgttcccgctggagatgaggtcggcggggcagagcgtggtggtgtgcgtcaacctgttctggacggcggcggtggcgcagtgcttcctcgccgccatgtgccacctccggtggggggtgttcatcctcttcgccgcgctcatcgtcgtcatgtccatcttcgtcatcctcctcctgccggagaccaagcaggtgcccatcgaggagatctggatgctcttcgacaagcactggtattggaagcgcatcgtcaggaaggaccccaagtatcagggccaccaccaccaccagatggccgccatgccaaccgccgccgccaagtccggctcgtcggaggtttagatgatgatgataatgaattgatgatggtttaataaggttttagtgggtggtgattaagacttgatcttgaattgttcatgtggcagtagcttttttgatcttcgattgatgcaaaagaagaggtcagagggttaatgcatgtgtgtgctcgtgtgtctatagttttagtttcatgttcttcagaattcgattcagtgtagtggtgggctgattaatggatcttgatgatgcacaaggaatgcagtgttctgaattcttgaaattattctcaatataacttgtagatttgtgtagagttctggttttgctagttggctagagctaagtactacctctgttttaggttataagactttttaacattgcttacattcatatagatgttaatgaatctagacacacatatatgtctaatttattaacatatatgctatgaaacgganaaaggagncactttctccgtatcgtggcatatatgttaataaatctaggcagtgtctctgcccccagctgaaagcctgaaacactgcctatgtggctttcgataaaaagccgggtgttgaccttttctctaaaaaacctgtagatttgctttgatgtttttgcaaggtgtgttgcagataattcttcattttgcaggaacgatttgcttctaaaacgattatagtgtgacagagaccatcgtggcaccaatatttctcttgtaattaacagttttacctaggtcatttgtgactgatgcgatgctgacaccacagttgagctagatcagtggataaagtagatattatctgaacatcatttgtgcctgatgcaatgctgacactatagttgagctacacctcaccagcagaactaaattaaaatgataaatgctatctgagcatcaacaaaaaattaaagattagcagtcgctttcatccgtcaaatggtcatgggacgatttaaataggacaggccggaaactctgaacatttcagagtcaaacgatcacatgcatatgtctgactcatcagttcttcatccataccatagttggagtcaacagtcagtgcagcttatctctaggctctagcgatcttgccatgctcattgcttctccttataaaattctgaaacatcgcaatccccaattctcgccgttctttgcgcctttcaggaaactgaaaattcagagttggcatcagcgtcatacctctggtggaatttgaagtgtacgtgaagattttcctgctactatctgtagctctctgtcatcattttgggctgaccttttgcactatttttaagttttgtgtttataaagatttgtactctgtccgtttcaaaatatgaaaatttttaggatacaaaatttgtaccacaatataaatatttatgggaacaatttaattccaatacacagaaatctattaattttcaacaaatgggattcttaggaagggaatataaataattcaaaatgtacaatttgaccaccaaagtcacaagggagaatcttttccctctactttaattagtttatgtacttcggaacggataggctatctgtcatcaagaaatgtatgtgtttcggtttgaccttttctaagtgatcacatagtttagtcagtgctacttatctgttgctaattatttatcttgccattgcttgaagtaatacgatacactagtaaaatatactacagtatccaagagttcacctgtttctgaaaagcctattgtctacagactggaagcatcagacttttctcatgaaacagacgtgaagacttgcgtagcatcagcgacttgaaatcaccattttataattccagaactgaacaagatcacacagtgctgcaactgaaactgactgccctgaacaatggtaaattggtaatttctcatgcacataagtactctctccattccaaaatacagtacttctatcgacttagctatttttctacctacttctttatctcaatcaattgttcgtctaacatttaatttctcaatcgctttttcatttcaacacatcacaatttagcctctctacttaattctcgtgaaaaactttaaaagtgcttatattttaggacagaaaaggtacatgaataaattacagaaacaccagtaaccgacaatacaaacatttcagtaccttaaatcgtattttctggcgtagtactacttttcaacatgtattcatgtttcacacaaaattaaagactgtcacatcagagtttgaacgactgaacatcgagtgctagactctggtgttgatgaatgcatctgaattgcaaatggtgaagcatttgataaaatgaacttacaaggtccaagcctgaagatcctgaggcatccagggttttcattatcctgcagattatatatatactgggtgctattagggataaagcggtcgaaaactatatcattttttattatttttgaggagcggtattggtacggttaggaattttctgtgtttgtgaatttaactattctttgatgacttcaaaaaaaatgcaaataaaaaatagaaaacctaaattttacatatacctataaacagaagcaatcagaaacaatatcattttttattactgtttatggaaactgtatgggtaggaatttccatatggtttgcacccttaggtgccatgccagttcactttgtggcactctgctgaacagcctgctcgtataaaactgcaattgaatatgttccacgatgtatgcagttgctggaatcttataaggattaaggattaacatattaggggctggaaatggattaaatttagtcaagtggaaacatcttgtggtcatgggggtgacaggggtgtgcattgggtacccctgagactgactctaggggtgtgtattgggtacccctaagactaactctacaacacaatttaagctaaaagtacatgatggtatctaatgggaaatcaatatatgtttcgattattaatttgtgatgaacaatgatatatgagataactggttttgatatttatgatatgagtaaattgcacagtagtataagaacttgccaggtgggtgcaatttagtgcaaaaacttaaaaaatatgcaaactggtacatgaacttggcaatcaagtgcattttggtcaaaacgctgttacatacatatgattcaacctattttgtttgttctattataagcataactactagattattggtcctgagtataattgaatatgtttgactagtagaatcgctcggaaatcatgttacaacaatttttttgcccctagtgtaacaacttgaaaaatgatcatgaatacaattaacgatcattatatttttggtttcaaatcgacaggttatttattattgtaagcaagcaaatacaatacatctagaccattattatttgacaatcattatacttattagattattggcaacgacgactgctcttttttttactacgtggcttaaaaaaggtgtggtgtctaatattgattctttaaccaaaatgcacgtactagccaagttgttgcacctaaatgatcatttttcaagttgttacactagatcgtacctacctaccaaatttatataccatggacacaatttactcttatgatatttagcgaagtggtgctagctatgtgggaccaaattgactaggccagtcagaccagccaacccgaaagcctgatggactctgtgttggtgtagctgtcaggttgtttatttggatactcgtggttatgaatcctagatgatttatatacgtgtatcggtgatttatatacggtgtatgctaatgttgagtcaagttgctgccccctgcccccccaaccatcaccaatgcatgcaaaaataagggtctgttcagattatagccaaaataaactttactaaattttggcaatgccaaaattttagcaagataataatattgccaaaactttgataagattttttatgtatttatcaaatttgacaacaaactaaacgtagacattttttttggcaattttttttaaaaaaattgtatcgttcgttgaaaatggtatcaaagtgaataagccctaaatctagctaagttggcaactaagaaccacagcaacaaaaaacataactgtcaaagatagttcactttcacacttacgattgccaagttccaaacatcatttgacatttcagtttaaacatcgttgcgcttacatgattccagtacatttcaaccaagcatcattcatactcaaatgtaacacaaatatgtcatttcttgggcaagtcacattgttcagattgcagaacggtattcaggagtaaggtgggcagaagccagccacagagcaccagcaaacacacacctttacttacaccttggaaaatgcaccctgtcgacatagcctcccgacatcgccgtctgaacattcctccggaacttttgtgggtcatctcggaggacagccgcagcatcatggttcaagggatcctcgtcattgggttgctgcaggtaatgtagcaaagataattgttacatgagaaaacacagtgcaaatggtgagttctatcccacaaagacaacaatttcacgtgagatttaaaatagtaatatggcaagtagcagactagtttagacatatctgcatgtaaaggttcaatctggtttaatcatgtgccacttcatatttacaataggaaataaactactaagccattattgctgatagaaaataaaagattgatcagttcctaaaacaaatacttacaatgaaaagaaggttcaaaccatatacaatggtattgatattcaagacaggcttccagtcttcacgcaggatattcaggcagacatttccgtccaagtcaatattagggtgataaacctacaaggtcaaatgatcaatatattaccgataaagcccttcccttggcataagccggtctggctgattgcgttgtgtaacaaaaattcattttcttctaatatattgatgtgcaattcttttgcgcgttcgcgaaaaaaaaaaccgataaagaaaggagtaggctacagttaatagaatctatgttaccttagtcgtgcacttgaccttgggcggctcgtgagggtaagtaggaggaacttgtaaagtgaaaacaaaagctccacccctatgaacgaaaagacattggatgttagaatacttcaatttgaaataatctgaaaaaagtaacaccttgtgtatattgaaaacacacaaatgatttatttccaattaccatcacttctgttttttagggcaaatatgtcatccatattgttcataatgtttttacagcaaaggagagggaacaaaaagaaacatctaatgaaaaaatgaaagcaatctacaacagattattattagctacttttatttgtatttgaaaattttaaaagaatggaacaaccctttgtcccttctacatcaagagaaatcgtcaggtgtgatgtaaaatatgagctaatcctcctaaaccatatttatcaacaaacatgtctccaagtacatcaaaagttaaatgcgtgcgatttaaagatgtcaagaagcatccaatgcctcgtaacactctacatgtggcaactttcaacagtaaaaagttttatagtagtttaaatgttcagtcaaaattgaagtacagaaaaactaaattgatataagagcatgtgtaatagaacagctaagagatttaatgggcttaaaagaaacatctagaatatacttacacatagtatccttcgtcaggccgaagagtaatctcaatgttcatcagatcatcctttccattaggaaaagtaatgttggttttctttggaagattaagctcagcaatgtctgtaagatacaatatcaatagtcagcgagatccatatttggaaaaactatactaacgaaaaaggaactatttccatcacataaaaagatccaaagacagtgagagtcatgcctattatgttaatatttaaataggagcctggacaaaaagataggtttctagcaatagtgtaatcaacatatctaaacatcattatggaattatttcagaagcgaattatatgtgtgccacatgttcaatttgagttgaaataacgttaattagattttagttgaaaatgcagatttagtaaaaattaaaattggacatttggatctttctctttattaacacatactaagtagaagtcatgatgttgtcatggttgtcacatgtagcagcatgttcttgtgtgggccagcaagatactatcagcccactcacccacagcccaccctttgtctcaagcccaccaacatcctgtttagtactggctagtgcccactactcccaagtcacaccacgctgcatgtcctatccctaaccgcctcattcgccccctccaactccccacaaggtccatatttctatagaagagcggccaataaagctaagtacacgctcaaccaatatggtgacaaaagtacaacatagtttgtacattcacggacatttcatatatagataatagttagcatttagatccttgtttaatgcatgttcatttgtatgacacagttctagagatgtaaatacataaattagcaagaaagagaagttcaatctagcactaatcagcacacattgaatagtataatatcagaaagctagaaaccaaataacacaagtaatacaataaaaaaaaacttctgcaaaaacaaacctttatggagacgtaattctcctggactttgcttcttagcaggaggtctcccatttgtatttgccgcctcttccttcttctgtccctttatcttaaagaggttcaacatcttctgtgaaacaagagagaaaagcttatagaatgaagtattaaaaagaatgtgtctttttgacaatataaacaacactaacatatatatattaacagaagaaaagcatccacttgaaataaaggatcattttacatgcaaataagtacaaattaatgatgaaccagagagcaactgttcagtcagttatctcagtttctttaatcattgtaatagggaaacctgccaacctcttcaggcctgaatgcctttagcagccatcaggcatcccacatcaatttctcttacccaatatattaaatcagtaagtgggccataattcattccttgaccctattaataggcagaatctcttaaagacagtcaaaatttttgtaaattatgtgagacacaatcatatcatcgtaccgttgaacagtaaaaagcaccatgataaactccatgatagaaaaaaaaagagaaacacctaccaccacaggacataacatatactatacattgacaacctgaatttctttctttttttttaaaaaaaaaggcaatgcacagcttcattctgttgaataatcgatagcaagtactaagtactacccctaaaatcatgagttaatacactgaattcgcagtatacaaatttcaacaaatatactaatccatagaggtgtcgatacattacacaatgagatgaagggtttggataaacaatggccattggttcaaaagggtacatgtattaaaaaaaaccacaaataggctaaacatatgaaaatttccggaggttttggtaccacctcctagacacatgataaaaaagagaggggataagagaagaaacatgaggcttatagtgacttctcttataaacatatagtacaacttagctaaatctatagttggctagggaaatcaatactttgtaaacaaattaacttattatgtcaaaaccttcttaaaagcttacctaaactaatagatcatacacaaaatttattaaacaatcaaaagtcatgcaaagcgcgactatgtgggtagttacagagtgaattataaaatctatgcactaaaaaaggttttccttaagcctccatcgtttccaagaggatgctcgtttttaccaacaaggtgacaaaaacacaacaaaagtaacagcaaggactaaccctaacaagatactagttaaactcccgactccagccaaaaaagctgcggcataaaaaaaaggtttttcaaaatcaagaatcagcctatcatcagcaaaggaatttaactttggataatcggctaaaattccaccaaacgatcagcattactacaattctcctacatccccaactattcatatgcccaattcccagtgcgccccccaaacctgaaaacctagatttccacggaaacacccagcagatgaatccagcgaccacaacggaaaacgaaagcttcatcgaaattgaacccaaaaaaaaaacaactagaacaagaacaatagcagattaaaattaaccctcctcccctcatggtttctttacccatgatcaaccggcaaaataaaaatataagggaagaatctttccgcaagaaaggagacgcaccgtacgaagcgccggtcgccggtggacgacgacgaggaggagggaagagcccgccggagtgattcgtcggcggcggcggtggcggcggaacacccgagcagagcaaagctgctgcctttttgtgctgtttgcgggagagagagagagtttgggccttttgggctgtatacaggaaaactatataaaaagatagataaatcaaaaggagaagaattcggaatattacgccgactcgcttttgatttcaagatgcgacctaatttcgcacgtcttttcagtttttcacctaatcacggacacgacacgacgttactatttcgcgatgtgattaaagagatttaatttaaaggtgtgatttttacgtctctatgatatattcggcttctgttcttgatcgtccgtataattggagatggactcggaactcatgttcggactatggcttggaagtctattacatttcgaatcaaagtatgttggtgatttattactgatcggtggtaatacgcgagatgtgtttaaaatttgagatgtgtttaattttcgtaccatttgcacctttgcgggcccaactaatgcacgcatgcccctgtcttgctaacgcaacttagattatagtatgcatttattatacaaatttcacgtggaactgcttaattttatgatataatagtatagaattacttggtgagcacattttgttgtactgtgtgtatataaagaaacggatcaatcgaggactttttttgtctgtatttaacccaatatggcgaaatcttgaacataaagccatggtttaggttgtttagtatcttggtccacccttgtgtatacgctagcattttcttctagacatatttaatttattttttaaaaccgcaaacctctcgatctttctaaggaaaaaagtctgataatacttttatgcaatgggagacccgatcaaatacccttagctcacactacacaccaccaactgccctaattctttaacgttctgatgcatatgtcctcctcctctacgattccattttccctactgatatgttttagtgtctcaccctctatgatctcttactcctccctctctgtagaaacatgcgaccgtcaaattctccaaacacttttgttaatctttcagcgatgtttagggacatataagagaagggacaattgcattcttaccttgttttcaactccaatacgatgattttaccccttcttttccaaccttgtgatttgccataatttcttttaaaagataaagcttgcattttcccctcattctattaagagaacttttctcaggccttttgtgattttgccactattttcacatcaagaattcttacttgaatttcacatatttagttaaaaatatgggcaagaaaaaacttggcatgagatacgggtagattagactaagatcctgctcctaatttgttagatttagttttcacatggaaataaacataattgcccaacgaacatctggcattcatgtaacatcctagaatgagcggctgcgatcaaaccaagagagtggtgaagtaaagagttaagggcaacgtgtaaaagactaaggtgatgtgctcgaagtactgctagagcttatgctccagcgcacacaacaagcatgcttgcagatcatgccatgctgaatcctgtcgcctaccaagcctagcttatcgatgagacgatgaacagatatattaggactcgacatttttttcagtactcaattttagtactttccattgtgtgttgtaatatcctgcaatgcttggtagctaccttgaaccatcctacgtctaatatccagttcagggaatgcatgctttgctcagttaaagtgatctctagtcctgcctcctgcatctattaagtaggctcttataattgtcaaagatattgcctttaaacctattcttatttgggtgattttttccttttgcaatttcgtagtattactatacagatatacttacaatgtacttgttgtaggattgaacactagcaaccaagtctaccagaagaggaggggagtgtgggtgaatggtaggaacaccaaaaaccaaaatatttagcggaaataaaagttacccacaaattcgatcgagatccggtcagactaacatgttcacaccggtctgactacacctttgctgccggtttaaccggtgttgtctagccgatttgaccagtacattggtcgctgtcgcaacctcttgatgccgccggtctgaccgctgc

SEQ ID NO: 70969 - DNA, 1254 bp, Oryza sativa
tccaattaataattgcatttattaattagggattcaactctaggttaattagaacaatttctccggacgatttacttaacaaatttttaaagcaaggaaaaggttgaaactttagggcgtgacactctgtctctcaagggccgccccgccctccttccccttggcccaactcccctcccctccccctcccgggccgcctccgcccatccgcccggcccaagccaggccgagtccctcccgcgcacgtgcgctgtgtgcgctgaccgcgtgctagcaggaggggcccacgcgctggcaggaggggcccacgcgcggtagtcttcctcctctagccggccgttccgctctgtccctctcccgaaccatagccacctccccatcaccttcctctctctcctgtgctgacggtcaactccggccgcccctgccgcagtgcctgtgcgccggccggccgcgccgtgttctcgctcggcctcacaggtgcatcatcttccctggcgccgcctccgattcgtggggaaatcgccggagacgcgtccccgccggcttgcagtggcattgccgctactataccatctccaaccatccctgccacctcgcctgagtgcaggccgacgtcgctgccacctctgtcggtgctgcagcgccatcctcttctccggcccggctgcggcgtcgcccgaagttcgctgaaacgccgccgccgcgccaaccgcccgttcctccttgccggctcgtcgccccgctgcaccaccaccttctccaacatcgcaatggcgtgttccacgccgtcccctactccggcattgcagcggtgatgtcgtcctcggcatcgcctccccttcggccgaacccgccggcgtttgtcgtcgcctcctcaccggttcccaccgtcgtcctctcgtcgttcccggtcgtcgtggtgttcgtccctctgtcaagccattctcgttcgtcatcctcgctccatcaagtgccacagccccgtcgtcatcttcgtcctcgcctccgcgtcgtcaagcattgcaccggccgcgtcttgccttcgtgcaaggatcgccgccgaagtcgttccctcgctgttcgcctccgtcgtccctgagccgtctccgccgtgcccgttcgtcatcatcgtgccacacctcgtcgcatggtggtaagggtctctcctctcgctgccccgccctcgtcctttcgatgtcgcccctgcccgttgtgcgggtgtcgatcccgctacccgtgtaccggtgtcgg

SEQ ID NO: 70970 - DNA, 4300 bp, Oryza sativa
acaaaggggaaatggaggaattatcaaagattgaattcttaggggaaataattcttatgtgattgttttgaataaaagaatgactctgaaaagcatcttcagaattcctacggaatgggccatttgatggaattttttttttgaggaaaactaacatgaagtcttacctcgtggtttctcttacaaaaacgccacacttaggtttttagcctttggattagaatacaagagctgatagtggtcgagtgcatgagtacaccaagataggtgtgtgcataggataagttgcctagatctcaccccaaaattttaaactctgtcatatcgaacgtttaaacacatgcgtggagtattaaatataggctaaagaaatagctaatagcacatattgcgactaatttgcgagacggatcttttaagcctaattgctccatgatttgacaatatggtgttacaataaacatgtgctaatgacagattaattatgcttataataaattcgtctcgtggtttactaacggatactgtaattagttcttttattagtgcctgaacaccccatgcgacaccctatataatacctgatgtgacacgccaaaactttacacccctgtatctaaacacctcctagtatgcaaacttcatcacataataagtggcaacctattcacattttttctgtttcaaccacttttgatttaaattaattccttcccattttatcattcatcatttaaattacatgccatcccactctcaatcccatccgggcatttaggtaattcgtttgtcctactaatttggtttttaattaaattctacaactgcacttaatataagatggagagtactcttgtacttttttttcctgtctagatttacatagtagtgtaagttacatttagttatagactgctatattctaggatgagagagtatataaaaaataagcaaaataaactaaatttatacaaagtcacatcgaagtttgcctctcagccgctaccaaaattaaaaattgtgaagcagaattttagtttctttattggctaagaataaaacgaccaccgcgccgcgcggatggccggccagccgacctcaccacctggtgtcgccgccggcgacaagcatcgccttcccgctgctcgctgcggccaacaggtggccggtcttgcctatgatttatcgacaggcagcattgctagctaactagctggctacctagaaaacgtagctgcttataagctattttatctgtttgttattagggaattggtttttagctggagcagtccggaggcaggcaccatcctcagcgttccactaagttgacatcagataatcatgttatgtattttccacggtcaagattttcttttcactacaagtgaaacataatccaccacacggacgcttgctaagagcatgcctagcagctcatctatcatgttctccattgaaaaaatggcatatggagggaaaaaagcgactctagcatatatgctatccaggcctccaaaaatggtgcatacgctatcccacagagagaaacaccaaatttatatttggcgtttctctctcctcacgccatattgcaaccgactcctccagatcaagctcccgcccccattcggatcaactacccctgcccctacgcctgcagcacctccaattgcgacaacttcggcggccctgtgcgacccgcgctatcacctgcgccgctcacgccctcccctaggaggctctagcggcccacagtctgtgaccagtgcacctctcgtgctgagccgctgacccaactccgatggccctgcaccacccgtgcccatctgcgtcgctagctcccactgtcgcccctctactcggttgtcctagtccacccttcccctcttcctcttctctggatcgagcacccgggatgaacctgtcatagagaaaagatgaagagaaatatacttttaccagttaggagttgaaagatattaataaaatataaaaaggtgtggtttattgaagatgtaatatgaatgatttgttggagtgaaaagagatatagagatggatttttttatgaccattcaaatggtaatatggtagatcaggtttggatgagctaggacatgctctaacatgttagaggtagcgggagttctaaaggttgccaaagacgaactgcgcgctaattacaagtcaggaacttttccaaaatgtaactacaagttccccgtcaaatgccaaaaaaaaagctgatttctatactcttacctactattggttcacaaatggaagagttttatcccttcaataccccttacctaccaaccaacccaccaatactactttcatattaatgagatatgccaattttccctatatcaaatccctattacttatgtacggttttattcgagaataagtagaggcaacgcgacgagcaagggacaagacgagcaggtcgccaacggcatacggtgcagatcggcaaatggcgtagcttgggtagttgggcgagtagtttgtcaatttacttgtcaaatgaaaaagaaatactgcatgctctcaaaatatagcaagtgttaagctataaatctgaacacatatttgtccatattcataaccaaaagttggttatatgcatggtagaaaacaggaccaaatctaacaaagggcaatcagttaagaatctattacctccatccttcataaaatatagctacagctagaaatagccatattttgataactataaagtgaggtataatagaaggggataaatctcataagcaggcctcttgatcactaacaatagaaagataatgacatggcggatagctcggccgagacaatttaatgattgactacacagaagccatcatttgttgaacttaaaatcccacatccctaatcaaactgctacgtactatatgtatgtattgccaaatgccaatcagcaggcttgtgcaaccagcaagaatctacgagatctcatggagtatcaaaacttcagttaaaatatatgatgccccgctagcaagtcctaaagcaaatctagtttagtgactgatggacctacctttcaaagtattgctgcgtgggaaacaatcaggtaacctattctatgttgtatcgttgcgaacaccaaagcaaaaaatctgctgttctcccgttccaactgcagcacttatttcttttcagggttgatgagcaatagggtaaagaaaaaactaatccatggtagctgtttccggaccaaaagtattctccagatggattcacttctgtggaggtgacggagatggaggcggaggtggcgtcggcgttggttgggacttgcatgccttgcaatcaatttgtggtgatggtgtcgtgttgtctggaattgttaccctaattgtttggtgtttcccatcgtcagtaggaacatcaaggatagcatccattaatagtatttcccagtcactgcgttgcaggaatgaaaaccaagactcatctgcaagaataagaatgacatgggattagaaataggctcctacaacatggatcaagacttgtagagactcaaaaaatatcaaaatcagttgtctaacaaaaatttcttcagttaaccggtacttcagttctgtatcaacatgatttttcaaagatagcatgccaaagggaaaaatggaaacaagatttcattggaggaaaaatctggaagtgatgaatttaagaactaacaggtcccagatgaacgcaatatcagtagcaacacgatagaatgtgctctgggcctcaatatgaagaaaaccatcaactgagcaatcaaaaacaccaatgggaccaaaagttacaaactactccctccatcccataatacaagggattttgagtttttgtttgccctgtttgaccactcgtcttattcaaaaaaattttagaattattttttttgacttactttattacccaaagtactttaagcacaacattttattttttatatttgtacaaattttttgaataatagttacaatagttattttaggctcacatcgaattggatacgggcgacgtaccaaaattccggcggaaacatcttcaatttttataatagtagagatatttgaaatggcttgaactgttattttgtaaatggcaatcagacaataggttttgttgtgcttactttgtttgcattgttgtgcatctctgggatagggtcccaactctgacaattttggcctgcctgcttgtgctcgtttgttgttagactgatttgggtggtaaactcaagtgagttactgtatgcagagagtta

SEQ ID NO: 70971 - DNA, 15037 bp, Oryza sativa
  unsure (1)..(15037): unsure at all n locations
tcgatgaaactcttgaaagtatatctaatttgttctatcaagttgagttctctcttaactagaattaaaagctcgaagaaaaccctaacttttgtgtcccaaaaaaatcgttatacccaatatgtctctagccacaacccttctactatttatacctaaaacattcatgcccctaaccatgaatcctactagaactggaactgctaatcacataggaaacccaacaaacgagggaaacaacttaacatccccatacaacttcacatttcaatcttttcaaacttggactcaaatccaaatttgacttcactttctatttgcacacaacaccacatgtataccatatggaaagattcacctccacgtgcattgttgtctagcctgagcatccccgcgtgatatttttgactctttggacctcaacttctcctaagcctagtcccgatccatcaccggctataatctcatggtctcaagcaacaccagcacacgaataacaaagaaactccatattcaagtacaatatcgcaccaacttgactcaatcaacacacaatagtatcacatacgaatagaaatcatctaaaagtcataaacatgaagcaatctagaaattccacgaaatcaacccgaaaccagctccctcctagagtctgccggtcttaccggcgacacccgcccagtctaaccgaccaccagagctaacaaccgaaaacactattcattgtattttcacaaacacttacatttgaaaattgtttatcacatagaataaattatccctgttcagaccgttgagccacctggtcagaccggccacatatacctatagtctgactggccacccagagccaacaacttctgaaaacactatttaccgtattttcaaccaacacttacatttgacaaatgttcatcacttcgaattaaatcatcacatgattttgcacttgctactatatttaaagttgaaaacatacatgtagtatgtttaaattcacaggatattatttatatcactatcctctcctagtgacatgacgttgtgtaggtgcgtgagtatattaaagcacaatgcttacacgctagcacgaaaaacatttgcgttttccattacacgctagcacataactgctggttccttgtgtatcggtagtgattggtaatcactgctatttcattggctgtagctcttgagcagagaccgaaatgtttcattccattatctaaaaaaaatcactgttatttcagaatggtttccggcccaaacaatgttgtaaatcggcagtgatgttgtcgtgttgagcatcagtaccgattaaaaaacccacagcaaggccgtcttatgagtggtgctaaattatatactactagatctacatgttatagacacatgaggacccacatgtcatagaaaacgagtggcgacacatcttaaaagtggcaagaagtgaaatgtccctcaattttgcgatctttttttttactttttttaccttttttcatttttaatttttagaaataaattggaataattttttttagaaataaaccctttcaaaatctaaacctttcagtcacaccacctgggctagtgtggcaaaacaacaatgtcataccagtctgaatagcatggcaactttatttgcccatgtcaatctgctggcgttgcaaccttcgttgtgggtgaggtgacagtattattttgtgacggggtgacgtcgctaaaagattcagattttaaaaataagttttagaatggtttaaataaaacaatcaaaaagtaaaaaattaataatggtttaaatgaaacaatcaaaaagtccaaaattaataaaaattcaattttgtatgtctttataccacacaaatctcacatataaaatgatgcgcgtcgtacattttggtgattccactgttctgacaaatgttctggaaatggttagcttttgatgttctcaaaatattttgtgaactagttgtcactttatcagtgttaacgattttttttaaaaaaagacaaataactcaatcttgcagcggctctttaccgccgccaaacaacattacaatcatgtgctcttactaaccatgtagcgcaataataatgcagcttttgttgttctcaaaagagaaccttgttggcacttgttaatttggtaccctaggcttccataggaatatgacaaatcattatctaaaaaaaagaaaatgacaaatcagcagatgagcagatgagcttctccaagagctgtgtagttgacatagtattattataaattctggcatattctgagaactactttgttcttcgggtagatgacatatgaatgacaaaatgatttgcatgggatttaatctattttgcagatgtcatctgcataaaagggcaagagatggccatagcatatcctgctattctggaagcagtttcgttattttatcttcatgccctgttcattgggctgaacaacttgctagctccttttatgttgggaaggaattattttgtgaacccctgtcaaataaaaatagtatgccggttgtgtaaactactggattagagctatctttacttgagataaaacttagagcaattttacggtccttgaggaggtaccatgaggtaccattttttctattataaatttggtacctcttaaaaaaaaagtacctagtactacgagataccagattttacactaaatttttggtacctcatggcacctcctcaagaaccgtagaattgcttattgctctaaaacttagtagtactcaggacaacctcgatgtacgttccgcgacaactatcatgtcactatcagcaagagcaccttgccggcatggtttaatctcacacctgccgcagctgtggggatgaggatgacccaccatgacgaacatcatcttggctttgctaaaactgaatgaaagaaacatttgcactagaaaataggcccaatcttcagcgggttcatatcatttgctgtgtaatagatcaagtattttcagctcaatcagtcacagctgttcataacttctcataggcattcggcaatttagtagcaagcttgctgagcaggttctcgatgtctcctaggcttatactccctccgtttcaaaatgttttgacaccgttgactttttagcatatgtttgactgttcatcttatttaaattttttttatgaaatatgtaaaactatatgtgtacatgaaagtatatttaacaatgaatcaaatgatatgaaaagaataaataattacttaaatttttttgaataagacgaatggtcaaacacgtacttaaaaagtcaacggtgtcaaatattttgaaacggagggagtaatagatagagtaggctgtgttgaccatgtctaagctagtcctagctcttgccatacttcttcctactaatatctttccattcaatttgaaaaattaatctcattaacttattaacacacagattctcctataatgtagttctcctcttttaccaatgttcgtgcacaaggacgataatgcgaggaggttagatccactgtgcatgtaacatcctagaatgcggctgtgactagaacgaatgtgtggtgaattgatggactaagggctgtgattagaatgaatgcgtgatgccctcaaagagttagtactcagtatcttaactccgttttatatcagcattgcatttttcgtcaaggccaacacacactcttattcccatctacaacaagtttaactccttgctctgtgcaacaaactatctatcatatggttattacttgagataagagtgtacttagtagtacacaggataacctcgatacgttccacgatagctatcatgccactgtcagcaacagcaccttgctggtatggtttaatctcacacctgccgcagctgcgggatgaggacgatccacaacgacgaacatcatctcggctttactaaaacagaggaaaagacacttgggactagaaaataggcccaatcttcagcaggttcatatcaacttccatgcagcatatgaagtacttcctgctcaatcagtcacagttgttcataacttcatacaggcattcggcagtttagtactagcaagcttactgagcaggttctggatgtctcctaggcctatcatagatagagtaggctgttttgaccatgtctaattaagtcctggctcttgccatacttcccatttactccttattactccctccattactaattgatctacattttacctgtgtgcaccaaggccaagaaaatacaataattctctcatgctacatttactttagcaataaacttgatgcatgcacaatctccactattttctagccaatagcaaatcaaagcacttgtatgcatggatgcatgtatcaatgctcatttacccaatgcacaaataacgaatagacataataaatgaacacaaatatgaagatcatttaggaatattttttaaaaaatgatatgtagatcaattaggaatggagggagtaacacacaccgattctcctataatgtagttctcttttaccaattttcgtgcacatgggcgataatgcgaggaggttaggtcaattattcatgtaacatcctagaatgcaaggctgtgattattacgaatgtgtggtaaattgatgatctaaggccatcgtgtcaaagagtggcgtgatgccctcaaagagttgctggagctcctactctagaacacgtaggggaaatgctagcagagcatgccatgttgaatcctgtcgcctaccaagcctaacttctctacgaggaaatacattaggattttagtttttttagcaatcgatctcagtattggcttttttttagcaaggctcgctagctataagctccgggaatgcaagctttagtcatttaaacaatttaatctctagtcccacgccaccatcctgcagctattcagtaggctctcataattgttgatgatgttgccttcatagctatatatattatatgtttttttaccgtccaacactgtacagtggtaccaactctcaaccgttggtataaccggatccaacgactagcggaggtatcacgataccacttgatctttgagatggtaccgcataactgaagaaaagtggaagggtaagaatatattttcgtgttggatggatggattggctgtatgaatggatgatgtgttcttactttctcattggttcacatacattattccccaacagggttatccggctagggcagatttatgctgagcgcaatagcttgcagggtgacaccgtacaccgccgatgacacatcactggacctggcagggtgttgtgcgcttcgtcccctcctttggtcactcgatctccgccacacactaccgagctgctgcaggaggatgccccatcgagggagataggggatgctgccaccactatctgacagggtcaccaggcttgtgtcgccgttgtcctttgagagctcaccctgctgccactggctttgaggtggagggaagggtagcggcgttaccgccgattagggacgaggttagcaataccaaagcgaaatccgggagcagggtgcttcgcctatttcatcgctgatttcgaggggaaagtcggtagctcattattcagtcagcatggtttgtttatagtccacaagcaaatagaacctcaggaacttccggggggggggggggggggggggaagannaccnngncnnnnntccccnctataaaagaaattatttgctaaaatttgaactacccaaatcttgaatcattgtcccataaagtgaacgcctataactaaaatcagccagcatttgttggactaggagataatccgtgaaaaagatcaaaactagcgcactcatataacatcctagaatacacagctgccgtgacaacagatgtgtgatgaagtggtgtactaagagcatcgtgaaaaaatagcatgatgcaggcacagagttgatggagctcatgctccatgatgtaggattgaacacaagaacctggcctaccagaggaggacaaatgatagtaacaacaaaaaccaaaacttttagtagaaataaaaattaccctcaaatttgacaaagttctcagcgtagccggtctgaccgccatgtccacaccggtttgaccacaacctcaatacgttctgtgacaactaccatgtcactgtcctacaacaccttgccagcacggtttaatcctacacctgccgcagctgcggtaaaggacgtccacaacgaacatcttcttggctttactaaaaatgaatgaaaaagacatttgggactataaaataggaccaatcttgttcacaataggtccataaacttactataaagatatctctgtcaaaactgaaacaggagaattcaacttttttctcaaaactgaagaactttccctcaacattgaaccctcccatgcttcaacctcttgagcctgttcacgcaactgttgtgcctcgggtgtgttcttttcatgaagttgggaacttcttccttccacacgcaaaacggggtggttcattagcatatgattaataaaattattagttaaaaacttaaaatatagattactacgattatttaaaacatctttcatacaaattttttttttcaaaaaaacatactccctccattacaaaatataaggcacaaccacccttaacccaaaggccaaaaaacaattattatcatcgtgtagtttgaatcatcctaataaatataatgcatgcgtccaatagagttagagaatgtgagaatgaaggatttaaaaaagtagtaatttaatggagaatatctcatagttaatggtatgcatgcatgtatgccttatattatggaacatgtaaaaaaagtggttgtgtcttatattatggaatggagggagtaccatttagcagtctaggaaatgtgcatgcagaaaacgagggagtagcactcggaaaggctgatggacgggtgatcgctcccccacccgcccaccctctcccctatactactagatgtactcctctctcttctcccccttcctcctccccttctcctctttctactacagtagaccacacaattttttaaaaaaaacaaaaattagaaaaatttatgtatagaaatactatatataaaaaatttgaattcaaattcaaatttgaataggatatgtaaacttttgacttataaactttgggtctataaactttaggtgtataaactttagatgtatagaaatactatatatagaaaatatttgaattcaaattcaaatttaaatcagatataattcaaattcaaatttgaatcgggtctataaactttaggtctataaactttagatgtatagaaatactatatatgaaaaatatttcaattcaaattcaaatttgaatcggatatttgaattcaaattcaaattttaaacgggtatataaacttttgacttataaactttaggtctataaactttaggtgtataaactttagatgtacagaaatactatatataaaaaaatatttgaattcaaattcaaatttgaatcggatatataaacttttgacttataaacttttggtcagatgtgtaaactttaggtgtatgaatttactaaaatagaaaaagtaatgcggtgccaaaaaagaaaaccaggtggagggagggaggggggaggtggggagcgaatctaatagctaccccatccccacggcgatcgatggcctattaggcgtacccagtagcacttagcaaagtggggggaagaacatagccgaagtattgttagctaaatcaatcgcagctgttcataccttgatctccggtactttgtactgctagtattatattagcaatattaccgatatgaggagttggtttatatgatcatattactactttaataactttatgattagggtaattttaccatttagccttttttttttccttgcgttactcaggtccatcggtcgatgacaggacagcgaattcttccgccgctgccgtccgttcgatcgttccccgtcgcctcctcatctccattcgttatcgtcagaatcgtttaatttgtcgatggtttcgtcgtcatgcgaggtccacaagcgccctctgcttggtgccgattgcggcggtggcgaccactccggcagccacgccgacgatgggctttggtccggccgcacacatcgttttcgcactaatgcagcaatctatgaaaaatcacagatgttaaacgcaatttgtaatgtcacaagtatgtccgtttcactgccagaagaatcaaaagattgggctagctaatcaaagcaccataacagaattcgggggatctcagtaagctcattttgttctgctcctttgcaagctgaagtctggggacaaagatcaggtacgagaaggcatcggcgtcttgtagagagggactgaattggcgctgtagtcgtccggaggagaggcgcatgagacggctgcggcgatcggggtagtgtggatgatggaggttgcgccttgaccagaacgccataacggcccagaagtgctagggattccaataatcggcaaaactattcagttttaccattccatgctgatatttttatggacgattatatccctttttgtttctactaccattaattaagatggtagcataaagctatctggcccattcgagggaaatagatctatggtttagattaatttctattaccagtagatcagagcaccgtagagaaactttcataatttagtagcaagcatactgagcaggttctggatgtctcctaggcctataatagatagagtaggctatattgaccatatctaagtctgggctctttccatacttccttatattaacgtgaacttttgctctggctatttaaatcaatttgtggatcaagtaattgttcaccacatgatcataactgcaatgagagagcactttgtatctgtctgcaatttgtatatttttgtttaccttttagaaggatttctgcacatgttctcaaatggattcagcaccgcaccaggaaacatttaaataggattagaacatttgggccgtgacaaatgtatgaagcatgagtttgtcgtagatggaaacaggaagcagcctctccctgggttgtcctcgggcgggcagctcggcggaaaaccctatccacttccgctgcccaccctttccggctctctctgtctcgccgccgccagacaaccgtgcagggagccaggatggtggcagcggggctaaaacacagcgacacgcagtctctggtgcgagggaggagggcagagtacgtgttagaataaatgggctaggcccaatttatttctattaaaatctcaagggcccataataaatgttaaagataataataccaccttgggaattaaaagcgtagtatctcaacttaaaaggcagttatcggaggctccccgttgaccggttaaagtgggggtcggatagccacacgcgcgcgcgccgagccgagccgaggctgtggcccggctctctctcgatccttttgcaacggttaaaaattcactccacgagattacttctgtaacgggcgagcgattcaatactgattgatcgtgtcgttacagaagcgaatcctcctcgtgcgctattaggacgagacagagaccgacgatcagcctctccacgaattctccattgtttgttctgatcgcttgcatgtacaagtgattgggacgagcagggcctccagaaccacaccctctcctgagatctgcacgggtaggcgggtgatcaggtttttggggagtgcttccgcacgactgctcgcttcttcgtcgtcgttcggttctatctgcattgcgcaatgtctactggtggtggcacacctggagcagcaggtgcggcaggaggtggtgcgctaggagcaggaggtggtgcgccgatcgacaacaccaacggaggcaattctgcctcacattccagcggagggactttcacagggtataacatccttctgttacctttcattttgttaaaactgtcagtcgcaatattattgcgttgcctcaatgttgatgcttattttaccttaagcatgctgatagttatatttagttttatcactagatcgcttcacattgtgcatgtcatgtttattgtcttaacattttggattaaaatatgccgatttatggccatatttccaacagtacggtgagctggtagcctcatgggcgcttgctgatgagcgacggttggggtccgacaccgctatggccgaattcagtgctcctacggttggatcgggccgcgcagtccagcgggctgcagcaggaggccggctctgcgagctgcaacaggaggccgacgagggcgcggcatgactggcggtagctggaggccgacgagggctgggcaatggccagatctgatcggtgcggtcagatccgtcccctcccagccactaagcatggcaggagctaggagcccgttgacggtgtgtgtgtgtgcgatgtttcacgtggaggcatgcagaggctggccggtgggggtcatcggtacaatattgtccaggccggccatcctccgtcagcacatgtgtaaacctagcccgacgctttagtcatcgttttccctcctgggggtgttatcgagtcatctctctccctctggtagggccgcctggcgaaaaccatgtgttggttctcccaagggcctcgacagacggcagcggtagtgctcaccattgctcttctccttagagacgtcgtcttggaggccctcttgctaaaacttttcttaggcagctagtgcgagctctctcttgaagttttatcctctcggggcaacactctagctaatgcaagttgatcatattggtgggcctagcggggcagagcggatccattcttctatttcaccctctccccctcaatcccaaaggagagttgagttcagtgctcggttgccagggcttggtttcaagcggtttccgttgtagcttccttgttgtctagcggcggccggtcacgcttagcggtggctgattcggtgcgagccttctcattggctctatgttggagctatcggtgtgttgtggttagagttttgtttttttttctttgtaatttttcctactttattgatggaataatcgtgtgctaatagttcaaaaaagagtttgccttcgatcagtttttcggataccaacaaaaaaaacatgtaatttggtccgagcctttgtacctcttacttatgaacgttgctcaacatgttttcacaatattatgtccaatggaaggcattgttcatgcaaagcactgattccaacaataactcgatcttgtgaaatacgagttcttcggccggctcatgatacacatgaaaatccttacggcagacaaactacagattcagggatgggataacaacgagatttgccccgtctatagtttagaacctgagacttctcatgacctcctcatggagtgttcctttgcaaatgtggaacaaacttagacgtactccacatgtcttccccctcccttttctcaggaaacatgttaggttggtgggaaacttgcagaaaagaaatgataaaggaccaaaggagcaatttcgatggcctcttcatctacacggcttggggcatctggctacaaaggaatggtagaatctttaatgggaagtacagtactgtgtctcaggtttttgattccatcatagacatgtgcaaagagttcgatgaagcccatgtttatttgatgagtctacaacgcattatgctgttagttgctttgcatttcctaaaactcttgtgcctttattagaggtagtcttcccctttcctttgtcctaaagaagaattaggacctctccgttcttcctagaggtccttctaagggaccgttcaaagccttgaggccatatgctgtaaaaattgtgttttctccccctacttaactgaaattggcagagctcctgcccttttcccacaaagaaaaaagggtgaatagccaaagtggtcctccaagtttcatctgagactcagtttagtcattgatgtttcaatctatccatattagtccttcaagtttttattttagttcaaacttatccttgaaccaacaactctcttcataaatgacacttatacccctcatcattcacatatacaagagaaaaattgcatgcttgattttttttatagataatacatagtatattttgtaaaacgaaaaaaaattatgtactaacaagtgtatacgatagcaattgcttaagttttatgtgcacatattgaaataatgggaagtacatctgtaatgttgtttattcatgttggctttctcttttctagtatatagatgtatacaaattaagggcaaaaaggatattttctaatagaaatattgactagaaatagccatatggcatattaagtggacctaaggatgatttcaagccaaaacaaatatttgaaggacctatgtggacaaaatgaaacatgaaggaccaaattgagccttcgctaaaacttgagggactaaattagctattcacccaagaaaaaaaagaggaaaaatgtaaaattctagaacagagttgttacgtggcacaaagaaacatgagcaaaacactagctagattgtcaatgatttagtgtagcatgaatgagaaaggaaaaaagaggaggaaaagagaaacaggtcgatcattcctaacatgtacatatacattatacaatagtaaactttttttatgaaggggaaattttttcttcatctcagaaaatttactgtaagaccacttctgacctcttcatagctaggatgcgaacatcctataattattaaggccctgtatattccctggtacaattttacaccctatcatatcgaatgtttggacgcatatatagagtattaaatatagacgaaaaaaagctaattacacagattgcgtgtaaattgcgatacaaatcttttaacctaattgcgccataatttgacaatgtagtgctaaagtaatgtcacgtcctgataaattcatgctgaaataaaaatcattctctaaaaggaataatagaattaattaaaattcgaaaagaaattgacaaacactaaaatacgtacaagaaaaattcgaatgtggcccagagaatttttgttaaattctccttggtctaaaaggagctctcaaactttacttgaattttcatagcaatggaattatttattaagcaacaacaacaattcagaaagtttattaaaaagaaaactaaaaataatcctcctccctcttttgggccgagtccagcccaaagtccttctctcgtccctctcttttccctttttctcccgggctgcccctcccctcggcccagctccctcctcttctcctcctgggccgcctcggcttcgcacggcccaagccgagccgagcggtgccctcctgccgtgccgcgcacgtgcgcgcgcgctgatcgcgcgcccgaccggtgggtcccacccacccagtcgtctccttcctcccgttcggcatcctctctctcttctctcccgtgaaaacctagtcattccctctctcaaatccgcgcgattcaaaccttggattccaaaatttattgggggaaattaatcccctttccctcctctctctttccccttgattcccccttgattcgtgcttttaatcaccgagaacggacgcatcttccctggccgctttccatggccgccagccgccattcccgcctccgttccgccctctcccgtggccagatccctccccgcgcctatacaatggaatccccatccttcgttctcccgttttagcctcctcccgcgtctccccgtggccaccccgcctctccccgccttctccttctctcactccggcgccggccgacctccagccgcacctcccgccacgaccgtgcgctgtccggttgcggcgtcgccaccctcagcgtcgaaggtgcatcctcttccccagcgtcgcctccgtttcgcggggaaaccaccggagacgcgtcctcgcgggtaaacagtgatgttgccgccactgcaccacctccggcagccccttcccctgtgcccgagcaccgacctacgtcgccgtctcctccgtcgacgtcgctgcatcgtcctctcctccggctgctcctctgtttcgcccggaaaccgctgcaagctgccgcacgtcgcctccacgccatccacgccggagtcccttcggccacccctttctcctcgcctgtgcgacggtcggccgcacctccaccaccttcggcatcacagcggcaaggtcgtccttggcctcgcctcccctcgtcgcctccctgccggtctttgtcatcgtcctctcgtcgttcccagttgcgctcgtcgtcggccctcccttcgtcaagccgtcctcgttcgttgtccgcgtccatcaagtgagccactgcagccccatcatcgtccttgtcctcggctctgcgtcgtcaagccctgcgccggtcgtgtctcgcctccgtctaaggatcgccgccgaagtcgtcccctcgccgttcgtctccgtcaccgccgagctgcctccgccgtgcccgttcgtcgtcgtcgttcccacgcctcgtcgcgtggtggtaaggatccgtcctctcgctgcccccgtcctcgtccttttggtgtcgcccgtgcctgttgtgcggttatcgaccccggtaccgtgtaccggtgtcggtagtcgttcgtgtgtgcgtgtggtgaccgtgttagtgtgcccgcccggtagccgcgtggtttccacgtgtgcagctcccgtggtgtttagtggagtccgtttgtcgaacacttgcctgggttttgacacacgggatccgcttccgtcgatccgtggaccgtctctgtgtactcgatctaccgtggccctttaggttgacatgtggggtccgcatgtcaacggcgcagccttcctgtcttttccaggctagcgcttacacatgttttataattgcaaaacctaattataataatccgtaaatctccatata

SEQ ID NO: 70972 - DNA, 689 bp, Oryza sativa
  unsure (1)..(689): unsure at all n locations
aataaggtagtattggtaatttccagcctaatggtgtcctcgtaaggaaatatccaaaaagcatattgtgacgccgaaagataattcgaacccgggtggggttgtgattgaaggttagacaaacaacatgcctgaaatatgtaaatctaactagtgaaatagcttttatactattatatagatatagacttccgaaggcctgatggctttgtcttcaatcaccaaaaaggggtatatagaaagtacaggtcataatactttggttttgatgatgcctgataaattcaattatgtgagcctattttggatatgaaagtcctaggcaaagccctgtcagttttcaaggtcaaaaaaatgtgnatatgaaagtggagtgtgtagatctacttcagaaacttcaagaagttaagttaagatagaaacgttcattggtaacgcacataacttccaaggatgaaatccttggagataaatcttacaacaatctctctctctccaggtacatattgatatgtccaaagagaagattacgatgtgcacatcattattcacatgaccctaatgtgttgtaggagcattttcggcacgtttagtctcttcaccctgaaaacatggagattgtgaaggtaaacattcctttagcgcggtaggtttgatagatgcgtcctattcctgtatgtcttacgccg

SEQ ID NO: 70973 - DNA, 4384 bp, Oryza sativa
cccatggttcggggttcggccaaaacccacctggcgctgttgaatgcagggtttcttttgaacggcgtggatcactccccaatgacagttggagggcaattccgaccattccaactgccacaaccgtcattggcagcctatttaaggagctcctcttctctcttcacacacacacctcgagcaagagctctctcatattctctcaagttagtttagtagtcttaagctagtggagtaggaatagagtagaaatcggagtccggaagccttcggaagagttcgggtatggctctagtagctcttctcttctcttttgtaagctttgtacttttattaaaacactcttctttatacatttatggtattgaaatactttccgagtacatgaatgctaactttatattatgttcatgttatactgattatattgttagcttatctgggagatgcatcggtacgggtatagtgtttggttatgcaattactctatgtcatgacgatgatactagagtagtttctggtagtttaggcgtggtgtctagatttggggatatcattattttgggttatatgctgcagatgagacgtgggccgctgatggtgacggctcagtatgggtattcctccgcgcgtgtatatagtcctaagttaatttcctggggagggtactccttcatatttagccccggttgtatggtcatgatgggctgtcgtaaggaacttggcagttaggggtggcttctcgaagtactaggagggcatcggttcgagggtattagctagtatgtcagataactagaatgtatgtatactatgtatactagaagtataggaatagatttcctttctcttttttttcacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagttgccagaaaacttcaaagaaaatccagaagctttcttctggagcgtcaggccgcgagtcgctgctcgacagaaaactctaccaacagagaaaccagccgtaccagcgtcaccgaccttcaagactatgactaacaagactctccgtgaattcgctgctccctctgctgacaatgtgaccattgggccacaaattaacctgggagacgtggattttgatttgaagtctagcctcatcacgatgcgcaggctagccctttctgtggcaaccaaatgagaatgccaatgctcatttacagtagttcctagagatttgcagcacatacaccatgaagggtgtcagtccaaacaacgttaggctacgactgtttccgttttctctccttgggaaagcgaagaagtagttttatgctaaccatgctacgatcaatacctgggatagatgcttcacgacattcctctcaaagttctttccgatgggcaaaaccagcgcccttcgcggaagaatttcaagtttctaggagacaagggacgagtccattcctgaggcacgggaacgacttcaagaatatgtggccgcctgtcctcatcatgggatggatgactggctgatcttgcaaaatttctataatggactcactcccatgtcccatgaccacctagacacggcagctggatgagatttcttctcaaagacggttcgaggagccatcgatttgatagagaagatggtctctaatatgggttggagcgaggaacgactccaaacccgtcagcgaggcatgcacaccgtcaaggagatggaaatgctcgctgccaagatggacctcctcatgaaatgattggacgaccatgacaaaaggccacaaggcatcgtcaaagccttggactcacacgttacatgtgaagtctgcggcagcacgggtcattctgggaatgattgcccggaaacccatgaattggcgatgtacatgggcaacaacaacaatgggtatcgtccacaaggaggtcaggggtggaatcagccatgcccatattatcaaggagctaacaacaacggtaacttttctaaccaaccctccttgaaagatctcgtttttgtgcaagctaagaccactgatgctttaagcaaaaagctagctgccaattacaagatcttagaaaacattaatgttaagctagatagcttcgcttctgctttccaaaaccagctgagctttaacaaaatgatagaaacttagttagctcaattagctgccttagtacctgcaaatgagtctgggaggattccggggcagcggactcctccattgaaaatgttaaggtgatcaccacgaggggaggtaagtccacttgtgatctgccatatcctaaccctgtaggaactaacaaggaagcgccatctggtacttcagctgacaaaaagattcagctagagaaggttgtgccacaagcatactatgacacgcaattgctgccatttcctcaaaggaacaggaaaccgtcagtggacgagcagtttgctcgttttgttgaagtgatctagaagattcacatcaatatgccgtagttggatgctatataagtgctaacatacgcacgttacctcaaggatatcctcaacaacaagagaccgctcccaacaatggaggtggtcaagctgatggagcagtgcaacaatgccatactccacaagttcccggaaaagaagaaagatccggggtgtcctacgatcacctgctcgatcggggcacaacagttcaaccaagccttttgtgatattggagcaagtgtcagcgtcatgcccatggacgtctttgaaaagctcaacttcacgatgttggcaccaacgccaatgcacctgcagctggccgactcattagtccgttacccaacagggatagcagaggatgtgccggtcaagatacgggattctttcatcccagatggtttcgtggtgctggacatggaaacaggaaaggaaacactgctcatcttggtgcatccattccttaaaactgcaggagccaacattgatgtgggaacgggaagtatccgtttccgtattaacgggaaggaagagaaatttgagtttcagccaaggactaaacactgctccatggtcagaatcaagtacgggccaaacctacaaaatatcctggtgaagttcatgcaaaatttcctggaaaaggaaaccacgtttcccaggaaccgttattggaacacactggtaaaacctagtgttccggccaagaagctagagcagccggcttagaagaagttgtctcccgcaccaaagccaaagaaggtgtggaagaaaaagccaaaggcgcccgctccatgacctctagagataggttgaaaatccgcgaactgaactgaaaggaggtacgatcttgcacatcggacctaaaatgacgcgaccttcgccacaggtaaattggtatgtatctgcacatttattttcatcaacttgaatttttgcattaacacatgtttggatttcaaaaaaaaaatcgcatttaggatttttgaatttttgagcaaaccaaaataaaattttcaacgaaaatttattgtgccacgaccacattgaccgttgaaacccaacggccaaaagtgcggccggttgggcccacaggggttcggccgaaccggccaggcaacggttacatgccacttttggcagggtaacggctagtgggtcccacatgtcatttctaaccattgtaggtgtccaatataagccagccagccaagagagggaattccatcccatttcaacacattttcattccctctctaaagttttctctcaagttcattcaagctttgatagttttccttaaattcaaatacttagttgcatacatacaagttgctttggtgaaactaaccagcgggtgaaattcttgctattctaaccctcgccgagttagtccgttcttgctccattgtgtagaatgaggaggcgattgtctcgtttgttcaaggggtccgactcttcatcaagtcatcatgactagtctatagctcgttcatcagccgatgtctcga

SEQ ID NO: 70974 - DNA, 5273 bp, Oryza sativa
  unsure (1)..(5273): unsure at all n locations
cttcttgctatggctcaaggtggggatcaaatccctggtagcagtgaaacgcttgccagtcagcttgctgttgttgcatcatggtgttaaagtttgcgagctgtgcaccaacagactgctgccgttcccgtgactgtaccacatgatcctccaaggtgtgttgctcattccctgcctgcagttctaagtgtatccatcctccggatgagttctcccagatcccctcgagaggagactgagcaatgcatcaagaggatggaggtagaccacttgaactgaaggagcccgagtatccctagtgcagctcctgtggctcatgcctcctgctgtcgctggcactctgccaggacgaacctccggtgtcatgttgcaggaattgggtccaaccacgggcatgcacggtcgggccccaactgtttccatacatctgcactggtggttatgaggaagacgcctccagaggtacttctctcgccattcgtcatgttaccctgcgtgggacttctcgaggcaactccgcttggaaagaaatggttagttctcggcagttatacaaatgaaactccgggttaggtaacgtaatctcatttgcatagccgggaaacaaaaatataagataatcatttggaccatgtttgagtatgtggcattgaaccaaataggcctcatcaacataagagcgggtaataggaatatttgcatataaagcagagtcccaactcttcatgctaaatgagtcaccaaagaaatacactcaacaggactagacaacttcacattttctaaccattgcttgatcctgggttgaacgggtgaaactttgattttttttttaaccatggcatacaagaggactagttcgcactatccggatattagctctaggaaacaacgtgaaacaagaaacttatgcaacagccttaaggtaggattatggatgtcattagttctaggctttctacaggatgagagacccgaaatactttgtcaaaacatacgcttgttaaaatcaggaaatgcgttcctgaaattaactttgcatgttttgtcaaagactagaagcaagctaagttctttccaagaaaggtgatattccttgcggaataaccggaaagtaacgccatcgcctacctctagcaaggcacataaaaactgcatggtaagcaaacgggaacccggctcttctacacatgcaaatttatcccatcctacagcacgccaaatagtatgaaactcagcatccatacctatccttttcagaaggtcgagtcgtatggtcaggtctgagcacacgtttggtctttcaacatatgataggcttgcatttcccggtggcccacaaggtcgagatcagagttgtcgtacagccttggtggaacgtacgcctcctccatggatgcatccgcggaagaaggtgcactcggcttatcgtgtcggcttgtccgtgagcttgatcgtctcttgaatatgcccgaaagtcgtttcttcatagctacagcaaagagcaagaatacaagactactcggacgggggttaagcaagtacccgccgattatccttgcaccgaactaaagcaaacttgtatatgcaaggtgtctaaactaaatgcagtgaattgtgtgaatttgaggtaagcctgcaaaactttgaatgaattttgcagcaaggttttgagagggagtgaaaatgagttaaagtggtgtgacctccctctcccagttgagctgcatatatagtgcatggataacggctagtaatggcatgtgggccccactagccactaccctgcagaaatttgcaaccagccggtaccaggccaattcgaccgaaccaaggggttcggccgaaccactggtggacccaatcggccccacatttagccattgggctccaacgactagtgtgaaggtggctgtgcaaaattttgccaaaaattgcattttattttgctcacaaaaaatcatttgaagaaattgcctcaaattcaaatctaaatgtgcatttgaaaattcaaacatgctttgatgcaatggaaaataaatatgagattactaccaatttacctgttggcaagggcgacgtcgtttcaggtccgatgagcacgaccatacctccaacgaattttgctcgatgaggcacccagttccggaggtacaggaacgggtgtcttctccttaacccgccacaccttcctgatcataggtgcgggcagcggcctcttcgaaactgggaatgcaggttgaccggcctgtatttccagtttcttggatgccggcttaaggtactgacggttcctcgtttcttcccgctccaggaagttcatcatgaaagtgttgaagttatccgtccttcggggttttactttgacctccttgtgtgtcgatatgttcttgatctaccccatggagcaatgctccatccttggtccccttgtggacgattcccgttgttgttcatgagcttgacgttctcacaggttttccgacaatccgtgccagagtgaccagtattgccatcgacctcacatgtcttgtgagagtccatggccttaacggtaccctgctcggcgtccttctcattgttgtccagtctcctcataaggagatccaactgagcggctagcatttccgtccacttgacggtgtacatgtcgcattgacgggtttggagtcgttccttgctccaccccttatttgagagcatcttctcaatcggttggcatataactgttcttgagaagaatgtccctccagcagcagcatccaggtgatcccaggacgagggggttaatccgttgaagaaactctgcaggatgagccactcggccatctcatgatgaggacgggtggtgacgtattcctgcagcctttcccaagctttaagaatggtttcatccctcatcagctgcaaactgggtattcttcgacgaggagcgttggtcttgcccatcgggaagaatcttgagaggaatgccgttgagcgcttattccgggtattcaccgttgcacggttgatgtagaaccactgttctgctctcccgaggagagagaacggcaacaggtggagtctgactcttctgacggtatacgtgctacagctttccaggaattcctgcaattgagcacttgaatcctccttaggcttaccacagaatgggcaagcctgcaccatcgttaatttagctggtcttcaaatcaaagtcaccgtttcccctgctgacttgggttccaactggcatgttaccagcagagggagcagcgaacttgcaaagggtcttctcatccatatcgtgcaattctggtggcacggaattggctggtctagttgccaatagagtgaccttgaggatgaatgacacggggtcggcttcatttcacccgtgactccagataaaaaattggtcggcagatcagaaccagtcctgtactactctgttttcacataaaagagaaaacaaacaaggtttgcctacaaaggacagtgacttatatagaggtaaatataaaattattagcaagtagtaaactcttaatcgtttatcttacccggcaacgtcactagaaatgcttgttggtatttcttagcaacacaactggaaatatagttcccagcaatggcactataaataatcctgctatattctggttacagacgtgatccgcaagcgcacggatatataccattgtagcatttcaccagggagtattccaaggtatcatatttattttatcccaagggaagatatgataagaaagtaccatgctaatagtttatatattacttatatacatcaaagtctacgcaggggttaattcagttcaaagggtagggtgacacacagaagaaagaactaagaactactctcactaaaatatagtctaagctaagtggagaaagaataagaaaagtatcattcctgtacttctagtatatatacatctttagtctatacttgctattatacagtcatgcaaccaataccccgtacccagtgtcctcctggtgttttgagaagccacccctgactgccgagttccttacgacagccagtcatgaccatacaactggggctaaatacggaggaataccctccccagggaattaacttaggattacattccagcgcggaggaatacccatactgagctgtcaccaccagcggcccacctctcatccgcaatatataaccccaattaatggtatctaataatctaagcaccgcgcttacattactaaatactactctacatccttgcaacggacatagagtaaccgaataatcggacactaaacccacaccaatacacctatctggaaagctagttacacgactatattgattcaattgtaaagtaaagtcggcactcaagtaatatgaattgaataaaataccgaacttgtataaagaagaatattctgctagttacacaactatattgattcaattataaagtaaagttggcactcaagtaatatgaatggaataaaataccgaacttgtatgaagtagaatattctattaattcagtaagtcttacaaaagaagagagaaaagctattaaaaccatacccggaatctcttgaagactcgaggactatgaagactattctcttgatcttcttcttgatcctaggagcatctttgctctccttaggacaagtagcaagatgaagtatccaaagagcatctttcaccgccttgtgccatgtgtccatgcttatgacggtttctaccggtagaattgctcctaaccgtcataggatacctgtagataactgcaggtggaaaatgggctggattaggccagctggtggttcggccnnnncncccnctcttcaccttcctttccttctcttcccatctcttcccctttttaataccctttttactttcctgttttaaccaatcacttctaacgtaacgaatgttcctggaacgaatccctcctatgctaccgtgctatggatcattttatcacctggactttttttcggtcttgcttgacatacgtcggtatctctagcgttctactggcttacctgaatattttaaacatcaggatagctcctctctggtacttaaacgattcttaccatagggagtatctataattcaagtctctcgtttggaagttacatctttgatgcgtatgcttacgcaatctttggttctcctagtgctacttcctctatatttggcaccctcgcttttctatcctaccctctctttctctaacgtttagtaatggtatctcttttcctttgctttgacg

SEQ ID NO: 70975 - DNA, 10951 bp, Oryza sativa
caagctcatggatataacattgtagcatttcatccgagagtattccaagggtatcgtatttattttatcacgtggaaagatcatgtggagataacttgactaatagtttatatattacttgtgataatcatattctatgcaggggttaaggtaatccaagggtagagtgacacacaagcattagctactcattctcataatatattatctaagctaagtggaaagaaaagagaaagataatataatcctatacttctaatatacatagtatatatatattctagttaaccgatatactatctaataccctctatccgatgccctcctggtacttcgagaagccaccccttactgccgagttccttatgacagcctgtcacgaccatacaaccggggctaaatacggaggaataccctccccagggaattaacttaggattatatacaagcgcggaggaatacctgtactgagctgtcaccattagcggcccacctctcatccgcaacatataaccccaaataatgatatcccgtaatctagacaccacgtctaaactaccagatactactctaatatcatcatcatgacatagagtaattgcttaagcaaacattatacccacaccacagcttctcccagataagctagctgtatattcagtataacatgaacataatgtaaagtaggtactcatatactcggaaagtatttcaataccataaatgtatatagaatagtattctaataaaagtacagagcttacaaaagaggaaaggaaagctactagagccatacccgaactcttccgaaggcttcaggactcctgatttctactctattcctattccaccagctagatactactaaactaaacttgagagaaatgagagagctcttgcttgaggtatgtgtgtgaagtgagaagaggagctccttttatagctaaactacgacgattgtgacggttggaatggtcggtaataccctccaactgtcattggggcttcatctcaaccgtccagccaaaacctggatccaacggaggagagggaggttcggccgaaccagggcccgccccaactagcccacctttcggctggcggcctcctctatttctcctttatgcaactagcccacctttcggctggcggcctcctctatttctcctttatgtagatttgtgaattttggcccagtttgacgtgtcaattctgagttcttggcccattcatgcataagtttgattgtcgacatcgtccgatggacttatcttctatgttgatgtcgattctcctccactttattgtcattctctgcaaaatgttagtagacctaattctagtagaatattattattctgacatatttatgcattgcaagcatcactagttctcctctattttggtaatattgacggtcgaaactgatcgataacgactgtcaacacctgtaccggtggcgcggtgggaagtcggaggtgggcatgatctgggagggcggtgtagaaccagtcgttcttccggtcgtcccactttttgcgcagcatgcagttgatgtagcggtgcagcgtgtgggcgtgtggctggaagaagctgccgcaaacctccatcgctggggacaccagctacaaggtgaagaaccagcggaagaggcccaatgaacatctcgcacagatgtgcgaagatggccagtatcatcatggtgttgggggtgtggtgcgccatctggataccatagaaatccaggacgtcgtagaaggaggagaagggcaggatcagccccgccatggcgaatgagaggaagaagactgactttccggggtagcacagagccgggcgcgccgcaccaaggatcaccgcctcccgcctgggcagtgttggcatggatttccgcggcagccccacctgcctctcgctgacgatgcgggagggaggcagtacgctgtcgtccagtggtgtggaaccacgcgccatcgcactggcggagcagggacaaagcgagcgagtgtgcgcggcgagagaaaggcgaagaaccgagaaggctagggcacggtaagcgtggaagattgaagtggcgaaaggaagggaaggaaatccttccgcggcgccctgttgtactcccctcacccacgcctggctccttgtttctcacggccactaactccaccctctcatttcccgcgcctgcttctgacacacgcgtggtaggcgtgcggtcgttgcggtcaagacggggcgagccacgcccgccttaattgcgcgcggttaccaaaagaatctgtcacatacctgaaattctcggacttaaaaatttctcgtcaaaatagtttgaaattaacttttccaattttgacagccaaaaattttcgttttaacttaggtaataaccgacctaaaccattgcatgattaaaatttgagaacaaattaaaacctttttcatctctaacctagggcatagatgcaaacgtaagagcaagcatgcatactcgcataagacatgttttgacttgagtcttcttagtgcatttggattttggttggcattgcatattaggactcatgaacataattaagggaaataatttcactaagcaaaacaaaagttattcatgaggtataattttaaaagataagataaggaagtcaaaataatgccatcacaagtgaaagaagtttaatgtactttacataaaaatctttagatgcatttataaagtgggacatatatatagaaagatcctgctaattatttaaaataaaatatgcaaggtaaaatcatgggaaaatttatgtagtctctatttaacacatacaacttactgtaattttggtacaacttaataactaagtttggtgcctcaaataaattagtcaaaacagtcacatagtagactaattataatcctttattggctaaaaccatacctcacccaaaaagtgaattaaaatgcataaaagtgtatactttaaataatttatttaaatactagattatttatcataactaaatataatttttctagaatttttatcctctttttagacctcctaaaaattcaaactagtttccaaatagcccatattcctcaattttctgtgagcaacctatccataatttttaagtgcaaccaaagaaaatggaaactaggtacattcatccacctgcaataaaatccacatgaacacatctgcaacacaaattaatatatgaattaacaaaaaaggggaagagaaataaatcctggaaaatcgtccaaaatcaagtctacctttgtttctacccttccctttctccctaaccttggtgtcatcgatttgggcccacttatcagtggctgtggctcgtcctcaccctgtgcaatcctccaaccgaccagcaggcaagagagaacgtgagagaggaaagatcggcgccaacaactctcaggtgcgttcgatgcgtggcctcgacgtggcaacgtcgagcctcgtcttcacttcctgccagctgcatcgcctcctccccattacgacttctgatccgggcaaatcgagggaacgagctccggctgctcctttcttcctcatctccatcgtcggccaccaagaagacgaaggtcgccaacgaaatagagcagcggccgtttcatcttcttttgcgttccttaatctagtctcgatgccggttccatcccctctaatctcagcccctatcatgcagtggttttatgggaacgcggacctcgccatcgttgctccgggttcacgtcgtcgttccaaccgaactgaaccaccacaagccgaacccttgcgccaccagggtcgcctcgacgtccccttcaagattcctcaagaaccacatggatcggtgaatcgaggagggagatcggcgtcatcttctccaactccggccgccggcatcgatcttcgattcctgccacttcggtgagccattgttcgattcctcgcgcacaaaccatccctgtaacctcactaccctcgtgcatgctgttctcttgcagctcatcgtcccgttcgagctgtcgtcgttcacccgcggaaggacgccgtcgccaagcggttccgcaagtcgccgctgctgccaagacctcgacaaccctcgttagactcacagtgagcatcctggagacctattagttacatgcatgcactccattcacctagatctgacctctaaatcaacctgcatcgtcaccccgaggactgccgccgctcgcgccgccattgccatcgattctgaccactgcagctcgcaaaaaggataccgtcgggttcgcatttatgtaggctaccttttctcttttggatgcacaccgacatgggccgccgttcatcgccggcgccggcgagaaactcgccgagccgccgctgctctgtccgccggccaccgtctcactgacgagcgggccccatgtcattaggcactgagaacctcatttagagaaagtttaaatcttgtaaggtttaaaatgtaaaatatgttagacttacatgtgggacaacggactaattagtaatgaattaaaagaatctgaggactcttaatgaatttggttcatcgcacattttggactgcagattgattccttgaaacctcaagggccttcctgcatattagtctctcactgacttgtggacccaactatttaaaaactggaaaaaggataaaagaaatacacaaactaataatttgatatcaagaaaacacctaaacttgtaaaatccatataaaattaaatatagctcattttgagatgattcaaacttctgtagattcataaagttattaaatttaatatagaaatttataaaatgcatataaaattcatctcaacttagttttgaacaaacttaagttccacagattcatcaacttacactctctgattaggagaaataaaagtatataattacttcttttccaaatgcctttaaaactattatctttaaaataataagttttagataagttaaactttagaagttcatataaaattcatcttaactcctctttgagtaaactcaagttctgtagagtcaccaaaacatgtatttccaagttgtaaaataaaaatataaactttctgtataataaaaacatctaaatatttatataaggaaataaccaacttggggtagcctttaatttgtacaacttatagaaaattcatccttagtccagaaagagtgaaccaagtttctatggagtcagaaaaagagtgaacttaaatttagtaaagtaaaatgtggcactttttgtacaaattatagctctgaaccttaattggataaaattggtgctaatcatatagtgttgattaagcaaaacataggtatgtatatatatagatgtagtctagctctaattaaacctaactaaaatttgttagaccagaaaagctataaattcatcctcattcactaaaacctagatgaacatagcttgtgtaacaaaactctaggttaatatgtaaagtcattaacatagaacattccctaagttacaaaatgtgtagtagagtaatatcaactcaaagtttgtgaactaaaatttgattagtagactaaatcattcattttaaacatcactagcaagatgaaacaagttctggacctaaacctctaaagccatgaacctatataacactatacagctataaaaagttgtaacttctaaaatacattagaaattcatagaaactctaaaaattgtgaaaccaaatgttctagtcttagaaaactcatctcttcacctctgtgaagtcaaatttaattaaaatcaatttatagaaacattttataacactgcctaattaaacactactacataccgacataacttctaaaattcataactctcaaatggaatgagacaaaatggaaattctttcacctaagttcattttagatcagtacctacttattatgcacaaatcatacattttagagcattttagatttttgactatttcggtgtttaattgcataacgtgtattttatttagataattgcataagcggtgaaggaatggattaggtgcaaacatttctcaatatcaaggcaagttctcctcccatcctttgaacacattgaatcccatgatttgaggaatgaaaatatttgtttgcaaagttgcatatgaacttaaactataccgatatttaaaattgggataaggtagttatgacctatctgctgcataccctaccttcaataattgtgatccttgctgcttaaacccctagaaatggttagagtacactctttgtgctcaaataggtttatatatgctctatgtccaactacttgcttagccatgcttagaaacatgcaaatgctcattccatctataattaaaatatgattttgacgcatgaacctttgctggaataaaatgaatatgataggtatttgtgaactaaaataagtaaaatgtgattttagacttgggcggcaagtggtgtgcatatgatgttagttgcataccgatagggggagtgtttgcccgagtccgtaaggactgaacttgtgtcaccaacttaaagttattcgtacatccacatgtgctagtatgggatggactaagctgattaatctatttagaactagccttgcattctggtaggccggtgtgtatgagttggaataattcagaggagcttcctatttaccccaaagtggtagtttaggtgactaaacatgtccaatacaacggtattgtgccacgtggtgggttcccatcgtggtagtttaaggcgtgggcctgctacttagcggttctagacatattccaagaatgtctaggatggaggaacacgtatcgtgctggtgcaaggctagattctaagtagtgtgaaggcttcgttgtgacctctagaatgtacttaatgcgtatagtatggtggtaccgacgggtaccgaacaaactagagcgattcagatcatgtgggtaaagctgtacaaactctgcggaattctctaaactaatcgattagccatgctcacggtcatgagcgctttggtgaagtgttatgagtatagactatgttttaaaatgagaacatgtaacttggtttgaaattgataaaatgtgttgagttctgtgagtgtggtgatatattatgacttgttgtcaaggatgacaacaagagattgattatgatggaattatgatgaacttaatgataaaagttaaaacttgtttttgatagttgaattgccaactccattacaaaagatttgtgaaacaaaacctctttatgccgaaaataaactacataatgccttcctttgaatatatgccttatatgtagtatgttaggattgtcttgtgcttgccaatacattaatttgattaatatactaactcttgctgttggaataaacttttgcttgcaggatttagacttagtctttgagtgatgcatgtttcgattgcttcttctaggatgagaacttgatggggtatacccctagtcggtgtgcttgtatttgggtagtcaagcttccgttgttctatatttatgtctatttggccggtcggcctatgtatctatttagttgttgtaagtccttaagttcctttcatcttaattgtgtttgctatgtatgtccatgcttaagatgaaagtgtgaatctagtgcacatcctggcaactagattcacatgagtatgagttaagaatatttgagatgttgtagatctttagccatttttgtcagctctcctgaatgtgtaacacatctggtcgccaccttcgagtggattgacgggtacatctcaggctaaagttgactggcaggctaaaggcccagcaatgtctctaatattcttctctcgaggcgtcagatgtttcattatgtttgtatgatgatttgaattattcacatcatctctcaaatataatggaaggtttagagagcctacgacagaatcgccatcattattcgctagcgaagccactgacgcatccgctccgcgcgccaccccaggcgatgtggcaattgcgaggtgacggcccatcattgccagggatgcggttttccactgcgcgctgggccgcgatcggcgaaatgtgtcatgactcaaaaaatactaggcacacatgtcactggatcagaagaatggcgtcaaacctggccactcatggaagggttcggctagggttaacgccgggggttactatcggtaatataggctagggcgtatcgagactaaagggaggaggctgccctcagtacccatgtggcattcccccgagggagtcgggcccggggtagagcagcagccgccccctccgtgcttggggttcgggctgccccggttattattggtgatataggtcagggcgtatcgagactaaagggaggaggctgccctcagtacccttgtggcattcccccgagggagtcgggcccggggtagagcagcagccgccccctccgtgcttggggttcgggctgccccgaccccctctgcatggccgccacgtgtgcggacttaggtgggcgccgcatttaaggcggcctgggcaggcgcgccaaatgcggcgtgccacgcacctgctaaatgacggataggacggtggtagggctcccacaccttgaccgtgtgttaggcggctgttggtatttctcaacgacattactagaaatgtaattcccagcaatggcgcagaaatacttctggtatattatggttatagagttcatccgcaagcgcacggatataccattgtagtatttcactcgagagcattccaaggttatcatatttattttatcccgtgagaagatcatgtagagagaacttaactaataatctatatattgcttgtgataatcatattctaagtaggggttaagataatccaagcgtagaaagatacacaagcattaactactcattctcataatatattatctaagctaagtgaaaagaaaagaggaagataatctattccaatacttctaatatacatagtatacatacattctagttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaaatctaagcagcggaaaataaaattaaacggcgcagacggctcgactccacaggcagcttgaccaaggctacacctaatcctccacaccatcagcatcactgtagatctcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaattataaaacagttaagtgataattaaacaatattaatccaacactatacaacataccctgttgcataggcccaaccattctgaacaaccaccccggctgcacagttctatctccaaaccaggaatgtaccattccaaaccaggagctaatcaaattattaccaatttaagcatcttttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttatccaatagtgaatcataagttatcccaatagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggacggccgagatcgatccaatccaaaacggacggccgagatcgaacggtccacgaccggctcacggcggacgaccccgatgacgtcggcaatgacgtcaccgacagcggcggcggctcggcggagcggacggctcgggtggcgcacgctcgccggcgaacggcggcacttcggcacaaacggagggcaccagcatgtagaggacgacgtggcgaactcaccggtgaccaaaacggcggcggaagaacaacggacgacgacggcgacgaggaggaagcggcggcaaccttcgggtcgacggtgacggcgatgctccggcggtcttcggcggtggcgaagcggcggacgaggatggcgacgacttggcgagcacaacggcggtcttcccgagcgacagcgacggctgaaacgacggcggcgcacggctggagcggcggcgacgacggcaaagctagggcacacggcgctagagcgtttccgacgacgagaggcgaaggcaagggtggcggcgggtagagaagagctcgggggtccttttaaaggggctcgaaggcag

SEQ ID NO: 70976 - DNA, 1120 bp, Oryza sativa
attgggatttaatccccaagaggatcctatgcaaggagggattgagagtggatcccaaccatatcaccctaaccctctggggatgaatttcttcctaccctctaaacctcattccgatacatgtgttctgtatagtctgatcctcttcaaaatgattgtaaagggttagctctataatctttcgacacaagcaaatccctggttttttttttctgacagaaccaatgcgcaataagcatgttatctcatacatatgtcatagaagtcattcttgaacctaaataaaatgtgaatgtatcaagacattcatatagtatatatctgaacgagagaaagtacgtgaagtttggccttgattgcttgctggtgtgtgctgcaggtaagggtatatagcaagaccattatagtcttttcacgtttattgtgcacatttatatgctcatttaagcctatctcaatgcatataatttttattcccaaatttcccttctgctataccggcaaggtttgttctcagagcaaggtttgttccggaggtcgtcggggcaccggcggtgccctaccgccagcgctgcaatcccatccaactcgcactgccacttactagcagcagcaagcccttctcgtggaggtcggttatacgccgctgggttgtctatgactgtgtttagatctaaagtttggatccaaacttcagtacttttccatcacatcaacctatcatacacacataacttttcagtcacatcatctccaatttcaaccaaaatccaaactttggatccatccaaacacagcctatatggtgcatcatcgtggtcaaccgcggcgccatccgccgcgtgcatccgtcatgttcactgtctggcctcgcccatggccgccagcggccatcatcagcacctatggtccgtctgtcctggctacatcaacgacggcgatcgccatcttcgcgctgctgctcacattctacctcttcatgtgcagttcccaggcttgcactatccataacaacttccccatattccattttatcaacatctggtgcctttgtgtcaaatcctgggaatgcatccttcaatgctccagctcaattctcccatgtgcagtaccgacaatt

SEQ ID NO: 70977 - DNA, 5944 bp, Oryza sativa
atcgaacgaagacaagcgagaacgagggaacgaacgtgaacgagaacaagcgaacgaacatgaacgagaacgagcgaacgaacgaggacgaacgttaacgtgaaatgcaatatatatatatatatatatatgttacttcgcatttatcctaatacatctttttgtatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataaaattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgatttttaatataagattactttatttgtaattagacttagtatgtaattattgactacggaattggtgcgacaagtagcaattgactattgtagtcttaaaacataaatgtctcgtgacttagcagatgtttgttgtatcaacagatggctgaccgcgatgaggaacagatattgtacgatataatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgtggagatcatgagagctttgtcccagattcggagaaagagatgctgtggaccacaatgctcgagacattcacccttcctgcgggtacagaggacaagtgaaaaggtggactctgaagaaaatggcagaacagtttcagagcttcaaagggagatctgtaccagagagtatatactgaaggggcatacaccgaacttcgacacattcccaaagctaagggatcactgggacgagttcgttgcatataagacaggtgaacaagggcaggcgatgatggaaagaaacaaagaaaattccgccaagaagaagtaccatcaccacttggggtcaggaggctatagcgtcgcgatgccgaagtgggaagacaccgcaggctagcttgattgagaggggtatcgaaccggcaacagccaattggccggaacgatcgaagttctggtagtatgctcacgggggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcatacctagagttccgggtatcgagctacgaactcaacatgcaagaagaggtggcaaggaaggttgatgaacgcatgtccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctatcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggtggtacatcatcctccctggacgacaagcggcgtctcgtgcaccatctcctccggctccgccatctcctcctcaggatcctgcaccgtctcctcctcatgctccgccagcaccgtctccacctcaggctccagcaccgactcctcctcaggatcctgcaccgactcctcctcgggctcctacacctactcctccgcaagctcctcttccggcaccttcaaagtcaagggcccccccagctccatcgcctgcccacacaagggcaacgaagaaggcgaaagttgacgccgccaagaacaaggacccggggtatgattgcacgcaagaggagcttgacgtttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccattggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatataaaataaaatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccgtacaacacagagttagttcaattttactgtcttcctacataccaaatttcattcccgtacgaacttcctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagacaggtaccgtcataagttcctctgttaattaagaaaatcttgttatgttaattgctactacgaatcatagctttaaactccatgttgggcttggtatcggttccgtcatttggtccgcggcaaatggagagaaagacttaggcggaagttcaaatttcctgtgagtacacatgctctacatttatatttctccgattcaaattaatacatacaactgtatagtatattaattagatctcacgccgttaatttgtcatttatttgtagtgcgcaaagcaaaagcagggaactaacttgtgcggctactacgtgtgtgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgatcacacacaagaaatttatcgcagcggttcaagaacaactcatgggattcatcaacgaagaaatccttgatcccaagggtgaattctactacgacggaaacacaattcaccggtccttatcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatatacatatatatatgtatgcatatatatgtattgaaacatatatatgcatggtttatatatatatatatatataaaccatgcagcaacagggccatgcaaaaaaaaaaaaaaggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtggtggtgcctcgccgttgcgtcgcttcatctcttcatcctgcgtaactcatgcatccgaacagcaatacactttttcccaactttcaccaggtacgtagatgtagcgtcggataattaatatccttaattaattcgcactcttctacgtgattactatttgattccatcgatctctacgagtcggattcatcctcattgcatgtgtgcctgcaatcgccatgcctgtgccgcagtgcctccaaaatccatatcccagacatgcatccggcggttgtaggatcggaggttcactgcaaggagaggagtctgccgtcatccggcggcggctggagtcttgcacttcgctagataccacagagtgagcgaggtcattcgtacgcatggcaactaatctctctagcaagcagaacctcaggtgcgcttactattttcgctatcatgtgatgtgtgtgttgtgtgttatgtccgctagatttaaatgagtccttaggtggatgctgaaagttttggcgcatcttcatttgctatggatttaatctttcgattgattttgccttttttttctagattaattttatacttaacgtttctcggtaaattcaattttgcatctattctttactaggaccgttattctgcattagctatgggctatggctgtttttttagataatggattataataaacccggcctctacaccttgtgagggtctatacagcctaagctatggctgtttttagttcacgtattgctactaacagcgtgccattaaaattttgctgtcctattttctgaattagaaatgttacttggtgttggatatgattctgatcataatcattagtcaatatatttcctatctaattgtgcatgataagaat

SEQ ID NO: 70978 - DNA, 1579 bp, Oryza sativa
gtctgacttggattgcatcacttcacttttgccagacagcacaatgcaacgattacatatacattttatgaataaatgttatatggatattccccatttaactaacttgatgacttaatctaatgtatcaccatgcaaatacagctccaaattctcttcatatcttagtactttctctcttggttactgttacgttttacaaatatactgatctttatattaacctagagaaatttgacttcgattccccttcaattccagcggcaacgcgcggggtatcatccagttaccataaaaattgcaaccgccgagagaaccggggatgaagagacccccggtcacccccacgacgtaatgaaggcaataatcaccgggatcccgatcccagcgatccatcttcttcatcatcatgttcatcaagtagacatccacggagatgttctcgagatgatgatcgtcgattagatttctaacctggaggtggctacagagctttcaagccttatctatgggaagtccgatggcccacaaacttccggacccgttgagaagtatgacggtaacaccgatcctgaggagttacttcatgtctattcaaccgtcctctacggagctggcatagatgatagcacgttgggaaattacttgccgactgtgctgaaaggttatgcccgctcatggcttatacaccttctcaagtcgtctattggatcatggagcgatctctgaaagcaattcgtcataaatttccaaggtatgtacaaaagacatgaggtcaaggacgatctacatgctacgagacaaaaaaaggtgaacctctcagggattttatacggtgattcaatgaataccgtaatactatccctgacatcacagacacttctgtcatcagggcattcaaatctagagtcggagatcgttatatcatacaagagagctggcaacaaagagaataaatctgttatgaatctattcgagatcgttgacagatgtgctgacgctgacgaagctctccgacgaaacgatggcaatgagaaagtgtccgatgacaaggtgccagcaaagaaggaagaacctggaactagcaagaagacgaagcagtccttcaagaggaacaaaaagaacaaggctgaggccgaagttctcgtcattgaccaagagcccccaacagcagtgctgatttgaaattcaaggtgaagcttcaggaaaaaagtggtgcccaataaacaagacatgttctcactctttggctggctactctgtttttcagaaggcgatggcaaaatagatggcgctcacacgagaccaacgagtatgtttgttgagagggaggatagccatccatagtccgaggacgatgctaactttctagacccctttcaccacgttgctcatatcttcagtggttgcactccttactcttcgaaaagagaatgcaaaaaggtgaaacgtgaagtctgtttgatatcctaggggccaaatgtcaaactacggtggtcagatcaaaagattaaattcagatgatgatcaccccaccatgaagactactcctgtatgatatcctatagtggttgagccc

SEQ ID NO: 70979 - DNA, 2149 bp, Oryza sativa
attcctggttcttctctcatttgtttccaagatacggattggtttttcaacataggtcagatcctcttggacctctatctgttcaagattagcttcttcggtaggtacccttaaacactttttcaattgcgacacatggaacacattatggactcctgccaaagattgaggtaactccaactgataagcgacctctcctcttctactgacaatcttataaggtcccacaaaacgcggtgccaattttcctttggtgtgaaaacgatgaacccctcgaagaggcgtgacacgaagatacacataatctccttcttcaaaactcaaatctctacggcgattgtcgacataactcttatgacgcgactgggctacacgcaatctttcttgaatgatctttaccttttcttctgcttcccttaggatatccgtcccgaaaacctgacgttctcccgtttgatcccacaaaagcggagtgcaacacttctgaccatacagtgcttcgtaaggagccatctgaagactagcttgataactgttgttgtacgaaaattctgcatagggtagattcttatcccaacttccaccgaaatctaaagcacaagctctcaacatgtcttccaaaatctgattcaccctttcagtttgtccatctgtttgcggatgataagcagtactaaagttcagcttagaacccatctcttcctgaagtttcttccaaaaatttgaagtaaactgactgcctcgatcagacactattttcttagggacgccatgcaaacacacgatccttgccatatacaattccgctaaccgacttccggaataggttgtctttaccggaatgaaatgagctacttttgtaagtctatcgactatcacccaaatagagtcatggcctgatgacgttctgggtaaaccagtgataaaatccataccgatttcttcccacttccattcaggaatcttcaaaggctgcaacaaaccggcgggtttctgatgttctgccttgactcgctgacaaacatcacatactgctacgtattctgcgatttcacgcttcatacttgcacaccaaaatctttccttgagatcctggtacatttttgtactaccagggtgaatagagtataaggtatcatgagcttttttcagaattgcatcttttaaatctttgttgtcggggacacagattctctcgcccaaccatacagttccttgctcatccttcaagaaaccgatagcttttcctcttctcatattcttcttgatctcttgaatatcaggatcattaatttgggcttctctaacttgatcaattagagtgggcttcgcttctaaggcggcaacgaaacctctactgacaattcccaaatttaatctttcaaattccttgcataattccaatggcaactgtcgtccttctgtagcattgcaataacctttcctgctaagagcgtctgctacaacattagcctttcccgggtgataatgaattcccatgtcataatccttaattaattccaaccatctcctttgtctcatgttcagatccggctgagtaaagatatactttaaactcttgtgatcggtatacacctctgtacgagtaccgaaaagataatgacgccaaattttcaacgcatgaattactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggcaaaatcaaaataggagctaatattaagtgattcttcaactcttggaaactctgctcacattcttccgaccacttgtacttcacatctttctgaagcagtgtcgcgtcccaaaacgactctaaaacacatcctcaaaattatgcttagaataagtaaaatccttgtgaaagcctccaacaattaaaatgtgcgaagttaaaagtcgaataaggcttggaggatttttgtatatttcctaaaagcctaaaatgcgtaaattaattttagtggaattttcagagcacaaataattattaagaagaaattaaccaaggtaaaaatggtttattaaaaaaaaaaccc

SEQ ID NO: 70980 - DNA, 15165 bp, Oryza sativa
ctggcagcacttcagatagcttctgaattttagtgtgaagctagagggaccgagtgccatgttgatgcagaccagaaatgtatgaagtagccatcagcaagaacgtcatcaggcatccattcacatcgtctggtaatgtcgggcgatctgcttcacctgcattggtgctcagaaactggtattttcatgtgcatcacagagtgtggttttcacctaggaaagataaacgattctaggctgcaaggcaatggaatgtatggctaatattttcctgatacatcccagtcccacttgatagggatgtgtacaagggcaacggcacaagaaagctttatgaaaaacatgcgttgtaacgagaagtcactgctaaaaaacccttataggaccggctttataggtgccggttatgagcctttttccacatccacggaataaaaaaaataaaaaaccaacacctttaagcatattggtatatataagatttaacagttatgttttataatcagaatgtttcagtacatgtatttgtggccagggtatcacctgttaaatctatacatacctataagcacgtatttatttcgtagaaacgatatgagaacttcactatgcaaatatttacatgtcatgcctatcatgcacttgtatcacctcagtatatattttgctaagttcaataaaagtttccgttatcttaaaaaaatacaaaacttgcaaaccacaaaatggatggatcgggaatttttagttttccccctctgattatatctgtggcgagttctacccttttcattcataactggattattttttatatatctccaagggtcagaacctctctcaaattattgggttcatcaattacacaaaggaagaagacactaactagaacgaaatttacagggatataacaaaaaagtataattagtactgaactatgaccgggacagccgaaatcaaacgaagagaatagaaacacttgtatgtatcatgacaaattagacttgcaaaatttctccacctcttgacggtgcctcttaatagacatacaggacaaaataattcaaaacgaaataattttatcagatattgactggagcgttgtatagctggtttgggaactgcgtggtatagatgggaattttgtgctctgcttgcagtatagttgagcgtagaggtatggaagaaggaagatgaagtatgttcagaaaatcgagccgtctgtgttcggatatgggaagttgggaactaaactcctcgcacggaaaacggagtgatccattagcacgtgattaattaaatatttgctaattttttttcaaaaatagatcaatatgattttttaaacaactttcgtataaaaactttttgtaaaaaatgcaccgtttagtagtttgaaaaacgtgcgcgcggaaaacgagggagaggggttggaaaaatgggattgcaaacacagccggcttgtggtatacttaccaatagccgaacaattgaacacgccggccggccaaacagatcagaatacacagaggaattgaacagtgtatttgaaccatgaaacaaagctgatattgggtaggcacatatcaaaccagaagaatacagacaatatgtgaatatttttccttacttatactaaaaaatcacttggttggggttcgctccaaatagcaaaaaaatggcatgtattgtgctagttcctgtcgcctctcaagcctatagtgtaagagtggcaaatgatggctgttcttcccatggttgtatctgagagagacatatataatacattgacctattaatagttcctgtcatgtgtactgtttgctggcatgggatattccaacattcccaccaagagagtttatattggtggcattatgatgtgtttttgtagatattgtattatatgatgtgcacaaaatggataccaaggagaggtttcttggacaccattaaagaaggcaagcagactcaagctacaaaggttcaggtgataggtgctagcagatataacaaagacaaaaaatacaagagtatgtgttaaatcaacctagacggccaaaatgaaagaaaagacagagagaaatagtgaaataccctccggtgagcggcggcggcctcctcttctcctttttttttttgactggaaatactgccaggacattgcctcgcagtgtgattttataaaagggataaaaaagttatttacaaattacaagagaccgagaaggaaacaaaatgattatactgtttgtaaccagtcaaaaactgtacgtttaaggggatcctttattctgcacatatgcagaagaacatcggccttgaataaagccctccaagaactgaatgagggaagctcatttcgaaagattttctcatttctttgcttccaaatgtgccaagcagcaataaagaaaatatccaaaaaaaacccttctggttgaactgaatgtgggccaaaaccaccatctgaaagaaattgagaccagagttccacacaattcccaaatactgccagcactgctgactgaaggggaagaagaacaaaagatgctctcttgtctctctgatattattcagccataactcacaagtgagatcatcattctcctttgcacagtgccgtcgatcaagcatatcacttgtgttgagtctatctctaaacaagagccaagcaaaaacttttatcttcattacacatcttgttttccagatccaaacaaaaggtcttggcacttgcacatttgagaaagtgagcttataaaacctcttggttgtgtacttgtcagagttccagatgaaagaccaatcatcacccttgtcattctgcaaagagagagaggacaattcctcctctagaatgatgaattctccataggcttgggtgttcagaggcagcaaaaagcaatcctcaagaggaatagagcacatttgattaacagagagggatctatccaaagcaaccatacacaaagctgggaatgcagtgcacctaatcttgtcattccaaaaatcatcccagaaaagagctgaggatcctgtcctgatgaagcgttttgaaattcccctgaagatatcagacagagccactatatctctccaccaaaaagagactttattccaaactaaatggggcactttggagtcataataagaattccagatcagttgaacccatggcagatcctgccctttgtaaaatttgaccaggtgtttaagcagaagtgttgtgttttgaattcttaagactcctaggccacctttttcctttggtctacacaccaaatcccaagaagcaagagatcttctagttgagtttgggttgtttcccctccagagacagtttttccttgcagtatcaatagctttaaccactgaaacaggcaactacaaagaacacatataatatgttgggattgaggaaatcacagagttgatcaaagtgagtttgcctccatgtggcaaaaattgtgggctagctgtcaatcttctctcaaccctgtctaccaatggtgcaaagtccactacccatggtctagttgtccccataggcaaacccaggtaagtaaaaggcattgtacctatgatacactcaagtataccagcaaaaagctcagcattctcatgagacagattgattgggtagaaataggacttatggtaattaattttgaggccagtagaatgtgcaaaagagttcaacaaagccttaaaacaaaaaacctctctctgtgatgctttgaggagaataaagtgtcatctgcatactagattacttggaaacccctttcatcaagttcattaattggcttgaacaacaaacctagggagcaagctttgttaactattctctgtagtaattcagcacaagaacaaagagcaagggtgaaagtgtatctccttgcctaacccctctcatgcatttaaaagaatttctaggtaccccattgagcagaactgaagaatgtgccgaagaaaaaatcatctgtacccactgcagccacttatcatgaaaacccatacttttcataatggatatcaaggcagagtgctctatagaatcaaaagccttttcaaagtcaagctttaacaagattatttctctctttgactgttgacattgatgcatatactcaaaagaccatgctaaacaatcttgaattggtttgcccttaatgaagccatattgattctcatgaaccagcttaggcattacactctgcaacctatctgccatcaatttggttaatacctttaaactgatacctatcagtgagattggcctataatcattaactgtttctggagaggacttttttggcactaaggttatgaaggatttgtttatcagctatagatcagtataacaagcatggaagtgtgctgctaacctgtaaaagtcatgtgatatgatgggctaaccttagtgtgcctcctcttctccttgatggccagatctagcaggtgtggctggagggtgacgacagtggagaggacgatcgagaatgttgttgatgttgagcctggtttgtttgtgctggtcataccttgaaagtgcaataaatggctgaaggattgtgatctttgatgtggttctggtgttgttgatgagttgttgaataagtgtaaatagcctattcttgatttgtgatgtagttgttctcatctttgacatattgatatgaatattattgtgttcttgttcctggtctataaatgtggatggggaattggggcgggagcaaatatggatgaggaatttggtgccgtgggtgtgaatattgcgggcagcttgacgcatttgttcgatgaaattgagctggcctttttttatttttggttcgtaggaacactttttttttttatgattggggattaatcaagaggacctatattgagcacactaaaaggctggtggcacattagcatcctcgcatgaaccggtatataagcattatgaattgtaattcgaagattaggcatcaattaaacaaaagtttttttttcaggcgtgttcagaatctcgttgctggatggtgaggagccctcttccatatgcttgagggcagcggcgattgcatctgccatcccctaagcaaccatccctttttcccacttgctgctgaagcaccaccaacacctggctggtgacaatgtacatagaggaaattatctgttacgtgatttttttttaacgattcacaccaaacagcgcgaagatttattgaatagagaaggagaaaaattacaaggttagagccttgggaggcaatagctaggaaagaagaaaaaaatatccatcacccacgcactgacagcacctaaacacagccttagagaaggctagcaccggaccaaccgccgctagtctaacaaaggaactacaaccgagatgacccaaaaaccaaccctaacattggaaaccctaggggtgaaaacggatcggataatatcccatccgatccgatctactctgaatccttccgaaacaaggatatggtatgggcttatccgatacggatacggatgcggatgcggattatctgacagttttgtcggattatccgataagaagtttgtcggataatccgaaattatcaacatatataaccactctatctattgcatataacataagttggtacatccaatgccctaattcatcaactatcatagaatttttagtctaaggcttttattgtctcatgtcacactcaagtagctatattttttatattatgggcatcaatcatgtattcatattctttagcacttaatcatataattattacgattggtcatttattgagtattgtattattgttccatggattgttaactcgatgtcgcattgattgcatatacatgtaacatccgataaatttaatccatttctaaaccgattccgcaccgactccgaaccatttccgacatccgaaacaatccgctccgcatccgtacactatcctcacctgctctgaattcgcttaaaaaatattgtttaggatatgttatgaccactatccgtccgaatccgttccattttcactcctaggaaacccgaacacctctagccacatctttgggattgagggagagagggtaagagaaaagatggaaccactctccccctaggccctctgacatggcccacttgcacaagctagaacgccgacacgagaggacatgacatctcgagtgagcttgcactatatgcttgggaggttttgacaagaggattgccaagacgacatctccagggagaggagcaacgaaggactggccgccgctatccgtcaaggtctcaaagagaaccaagagtgggttttcacccggcagtcccactagaggaaaaggggatgacatgacaatgtcctcgagagggaaaatgatgctcgaaaacgccgccattgccggcccagccaagaccatattaggttttcacccgtttcctgctacctgctaatccacagttgatgctccaatgctccaccaccatctaaccttcgttgacgcgtgggcactactgcaccggcgtcccctaccagcacgccgagctggcctctatcactgccggtcacgcctccgctgctcgtagcaccgccagactcacaccgcctcaactccaccactgccaagtccagggactcccacacctaggctagccgcattggcctccgctaccgccggccgcacctcctcatgccacgccgccaccgctccgccccaatgtagccgccgtcagttcgctgcaccggctgtgcttcggtcagatacggccgaaggtggcccgtggggccagctccggtaatggctgtcgcctcctcgccaagagggcttgctgccaccactccctgtcacgggtgctgcctcccagcaagatcagcatccgccacagcaagatgaccaccatcgccaatcctgtcgttgtcatggccaacccctgctgccgtcgtcacttcgccctccacaacacctcaccggtgccactcacgggccaccggatctggccatgggcgccaaatccagcagccgccatagtcaaactgatgtcgcccgagctccataccaccacccaccacagcagccgggtcgcgccgctgcccaccggcctctcgccggagggacagctctagtgcaccggtgtccccgctgttgcatccttcgggtgagagagagcctcgccgccgccgtccttgcagacgcatggcttgccggtgggtcgctcaggcggcagcgaggtggagggtggagggagagcgtggtgacggcggtgggttttggggcgccgtccgtgtcgcccagggacgggagcgcacagaagggagcggagtcaaaccatctaagttattccctgttgcgtgattgactgctcctgattttgcttcacggtgtcctagtgataacttttggtacacatcatagcagataactttctgatgctcctctcaaacatatagtgcacacactaatatttggttacaacttttgctccttctccatgattctactagcaaacaatctttgttcttcgtcatgattctaccagcaaactggcttgtttcttcttgacatactacttcctttcattgtgtgatttttgacaccacagtcaccataattaacaggccgaccaccctatcagtatctcactggtcctttaattttcaatttttagtgaccacatgactagcttttgtggttgttgcactcggtccaatgcatggctgttagttcacatccattctatttgcatgtcttccataggccgtgtttagttacatgtaaaacaaaattgatgtatacagacacacatttaaagtattaaatgtagactaataacaaaaagattctgcctgtaaaaagcgaaacgaatctattaagcctaattaatctgtcattagtaaatgtttactgtagtaacacattgtcaaatcatggtgtaattaggctcaaaagattcgttttgtaatttacatgcaaactatgcaattgtttttttcatccacatttaatactccatgtatgtgtacaaacatttgatgtgatggaatttttggaagtttgaagggaactaaacacggccatagtttcaaattttctttcagacctgtgggatcaggatggcatcgatcataggagatctaaatgatcgttttcttttttcaaaacaagagaacaaacacgcagaaaaaatgaaaacaaatgacattgaaaatcgttctaatatgcacatcaaggatgcaagcaggctgctacactaccgcaatagtctgtgctatagtatagtatcatgaacagtaaagtcagcaaaccatttcaaacaacaatcattagaacttctgttagcgcactcaacaagacacaagaacacacacaagaattggcaatctcctctccaatatattctcaaatccaacaggattgagccaccgccaccatcgccaccaattgccaagatcgactctgttcttgagtttcttcagttatatacagttaagtctctctctcacccactcctctcttgccagctgtgacagcaacacaacagctacacgcaactattacatggcccaatctggcccagtatacaatgggttcttctttcttgcgcgtcttggatatatccggcccactcttgtatcagcatctccttcttcttcagtgaactgttcaccgtcatcgacaatgcttggcttcgtcatcccttcaggttcactgacaatcccctttccttgacaattggcttgtccccaagccaatgcagcagggaaccttgtttataaatcctccaagtcctcccaggttgcttcatctggcaccgaatgagaccattgaaccaaaacttgatggactggagaattacctttcatgtaagtacaggaatccaggagacgagctgggaattgcaggtcttggttagggccaggcaggtcggacaacactggtggttggaaatccttagcacccttgagctgagaaacatggaatacaggatgtatagtactggatttaggaagctgcaacctgtaagccactgaacccaacttctcgaaaacatgaaaggtccaaaatacttaaatgacagtttatgattcgccctgggagctactaaagattggacatatggttgtaacttgaggtagacccaatcacccactgcaaaagaccgaaaacttctcttcttgtctgccatgtgtttcatcttttgctgtgctctattgagatgttgtttgataagagcttgcatgagatttctttccttgagccatacagccaggtcaggtatagcgcaatcagctgaactgatgccgaaatgtctaggaggatgaccatacaaaacatcaaaaggtgatgatgacagggaagaatgataactagttttataccagaattctgccaaatgaagccaagaaaaccacttagtaggagtagcatgaacaaaacttttgagatagatttccaaacattggttaactctttcagtttgcccatctgattgtgggtgataggctgtgctcatgtgcaattgtgttccagctcccttgaatagctgctcccataactggctagtgaaaactctatccctatctgaaataatggtctgaggcaagccatgtaacttgtagacattgaccatgaatagctttgctacatcaattgcagtatagggatgagatagaggaaggaaatgggcatacttggaaaatttgtccacaatgaccagaatacaatcatatctgaaggatcgaggaagtccttcaatgaagtccatggaaatgatttgccatgccccttctggcacaggtaaaggttgcaatagtcctgggtaccgatttctatcaggtttagcttgtagacagatttgacactgatgcacaaaatcttttgccatcttcttcattcctaaccaggcaaacaatcttttaagttttctgtatgtcactggaaaacctgaatgcccacccataggactagagtgcatctcttgcagcaacttgagttgtaactcaggattgtgtccaatccatattcttcccttatatttaattaaaccatcatgcaaggagtactgaggactagattcaggattaatagccagagctgttatcaattttgttgagtactcatctccttcatatccttttatgacatcttgtatccatagtggagtacaactggaaatcagggctaattcaccatcttcttgatatttcctggagagtgcatcagctgctgcattactagtcccctttctatagtagatcttataattgagacccaatagcttagtaaatgccttatgttgccagggtgtatgaagtcactgatctgataaatgcataagactatgatggtctgtcaatatgatgaattcccttaattgaaaataagatctccagtggtgcacagcaagaaggatagccatgcactctttctcatatgtggataaaccccttgttcttggacccaatgctttactgacataagccagaggatggctgttttgtgacaatactggcccaatacctgattcagatgcatctgtttcaactatgaatggttcattgaaatttggtagggctaggactggtgctgtcactagtgcctgtttgagtttctggaatgctgcatcagtgtcggcagtccactggtatggtacccctttccttagtaactgagttaatggtttgctaataatgccaaaaccttgcacaaatttcctgtaatacccagccaaacccaaaaatccccttagcttcttaggagtggatggtactgcctagtttaagacttcctgtaccttgtctggatcagttgataccccagcagcactgattacatgccccaaataagttaactgttgttgtgcaaagtagcactttgataatttcaccttccaattgtgttccctgagcagtgaaaggacttgatctatatgtgacagatgagtttctaggtctgggctatagatgagaatgtcatcaaaaaatacaagtgcaaattttcttagtactaatttcaatgtatcattcatagcaccttggaaagtagctagggctccagttaacccaaaggacatcaccttatactcataatgccctgtatgagtctgaaatgcagtcttgtattcttcaccagccttcattcttatttggtgatagcctgcccttaaatttagctttgtgaaccattttgcaccagctaactcatcaagagttcatctatcactggcattggataagatccctttactgtgatagcattaagctgtctgtagtcaatgaccaatctccaagtaccatccttcttcctaaccaaaagagctggtgatgaaaatgcactttggcttggttgaataactcctgtttgaagcatctcctggatttgagcttcaatctcatccttaagtgcaggattgaacctgtaaggtctcaaattaacaggtttagaaccaggaattaaaggaatactatgatcacagtatctctgtggtggcagtccttttggttcctcaaatacatccttaaacttttgcagcagtggtaaaatgagctcagaagtgggtactatctgttcttcttcattcatgaatagttgtaccatgtacatgagggctccttccttagccatgcctaagcattgatgtaatgaaactagttgacagtgattagtttgggagacaataccttggagcttgatagactgatcatttgattggaattccatccatttgtgaacccaatcaatgtgcattggactgaatttctccaaccagtccatacccaatattacatcataagtacccaggggcaacagtctgaagttacttttgaaagtataaccttgcatccacaggattagacaactgagttactcctgataactgtaatccaacttgggtgtccaggaaggagtgagtactgccagagtccactaacatgagtaattttgttccctgaattcttccccttaatctgagagagttagctgattcagtgcccaacaatgcctgttgtgatattgccattagagttcccttttcaggttcagttgcaacctgctaatcttcctgcacagttactagttcagagtcatcatggatagcttccaacaattcttgcacaaaatgtatctgaactgaagtggcacatttatgatcccttccccatctttcaccacaaacaaagcagagacccttagattttctataggccttaagagctgaaattctctcttcctttgccttgttggcatcactgttcctcctgtcttcaggtgaataagatgttccagttctaggggtattaggagcagagacaggattgttaattctagtaacatgtttatagcctgggttaacttccactctacggatgccacttggtttagtaccaacaagagcttcctcctgtaacaatgctattgcacaagcagagtccatatctgaaggtctctgaactaaaaccacacccctgatttcatccttgagtccctcaacaaaacttgtcacaaagtaaacaggtttcagagtgccatcataagcaataagctggtgcatcaaactgtcaaacttctctacatactcttctacagtaccagtttgctgcacatggaaccactggcgaattaggccttcctgtctgtctctagtgaatcgtgaacagactaaatcacacaaagtgagccaagagattcctgtgatttgtgatctaatggattgtaactagaaagctgcatttccttcaaaatttagagtggctaccttaacccagtgctgcgaaggaataccataaacatcaaaatactgctcacagtcacacttccacatttggggattttcaccatcaaattttgggcaggtcatcgggggcaaacagctactcagatcaaatgtgctggtgtgtggcattttggcggaattcaaatcgagatgagatggatgagtaaaagatggatccctcttaccaaccaaccaggaggtgtcttgacttggtgacccctggagcggaattcctgatggaatttcttcatacttcttcgtgatactgctctccaacagatcaaccttcttgttgagatcttggaacgtaccccccaattcatccaccttcttctccaccagtgggatgcgtacctctaggttcttcttgagttccatcagatctgcacgcgagcgctcctcggcttccaccctccgcttctcattctcctcaatcgtcttgagcaagaggtcgagcttgccgtcttgcgccatcagctgcgccgcttgtttggtgatgtagcgcggccgctccagatagcagggcgctccagattagcttactcctcacactccactctgatccgattaacccgaagaaggcaagttgctttttcgcggggtcgattccgaagaactaaccccaatccttctctggattttgcaatcagatcagagattccaggagcgagagcgctctgataccagaattgttagcgcactcaacaagaacacaagaacacacacaagaattggcaatctcctctcccatatattctcaaatccaacaggattgagccaccgccgccatcgccaccaattgccaagatcgactctgttcttgagtttcttcagttatatacagttaagtctctctctctctcacccactcctctcttgccagctgtgacagcaacacaacagctacacgcaactattacatggcccaatctggcccaatatacaatgggttcttctttcttgcgcgtcttgaatagacccggcccactcttgtatcagcatctcctccttcttcagtgaactatttaccgtcatcgacaatgcttggcttcgtcatcccttcaggttcactgacaacttcccaatttcaaatccctgtgatgtgcaccttgaaacagaggttctagatgtagccccgattttttttccaagaaacacgaaaagtaacggatgaaattgttggaatctaacgaaatttcaatgtgacatgcacttaatttttttaaaaaataaactaacctgtagaactgcaaaaaacttcaatctgatcgttggatcaaaatctaaagagtaaattttagaaaagcccaagttttatggtcagaattgcagaaaaccacatgcttaaagcttcacaaaaccccacccttatgcaatttgagcatgaaattacttaaattttgaaatattttaattgttaaatcactaagattgatagtgtaatccattactaccttaaaaattttgtttgagatatgctgaaatttatcaagatttcaattaaggtggggttttatgaaacactgagaccataaaatatgtggttatgtgccacacgttataatatcaattttttcctcaactttgaccaaaaacccggtgttttttgaaatttacttaaatctgaaagcaatataacatcattgaaaaaaatgccaaaactcatttggtatgaagacagaattgagaaatggaattgaggatgaatttgctaaacttcatgaatcaaatcatgttccaaaagtgcattgcatacaaatgcaccgtatctctcactggcttgttccccctcaaaccctaaaaagaacgatctttttgctcttttctttcccattgtttatatctcctatctctctgccttttatacaatagagtacatctctacacaatactcaagatatgatacgagagagatggacttggatgagttgcagtcgtagtactgtctgtaacttatgcaatcatagcagctaccatttgatctgaatcggacggcacagattagtcaaagcactgtaccaaaagtgctatagaataaaatattacaatggttgatactgtagatgtcaatctggaccgttaataatcaaaaggaacggctgaaaatacatgcagtcctaagtctgatctcaatccgagagggagctaatctcaatttgagagggatggtataaaattagtacattgaattattggtgtatgtattgaggaagttggttctagtaatattttgtggattccgtaagaccttgttggttaatctctctaagggagggattggaggggatttaccacacctattgtggtgtggaattattccccctcaataccctctaaaccgaacaatgtctaaaggattattggtgtatgtattgaggaag

SEQ ID NO: 70981 - DNA, 942 bp, Oryza sativa
acctatctccttgcaaatgaagcactctgcatccttagctggccctgtcttttgaaccttggtcttagagttgctagtagtcgtgatctcatcagagtttagctttctcttttgaccactcttcttattgtttggcttgcgcttatgcatacccatcacatggttggagtttttcttaatgctttcctcggcagtctttagcgtcacatgcaattctgccaaggtcctgttcaggttgttcatgttgaaattcattatgaatggctcaaagctgggagggagcgactggagaatcaaatcagtagccaactctcggctaaggggaaagccaagcttatccagactctcggtgtaaccaatcattttgatcacatgtgggctcactggattaccttctgcaagcctgcacgcaaacaaggactttgaggtattaaacctctcagctcttgcttggtcctcaaacatgttacgtagtcccgtgattatcgtatgagcatccaatgcctcatattgcctttgaagcttaagggacatagtagcaagcatgagacagcttatatcaagatattcattgcatcgcctttcatgctccctacgttgagtagcaggagcattgttgggcaagtcagctagaaaaggctgtgtaagcacaaactctttgtgctcttgcctgagaacaattctcaggttgtgataccaatccatgaagtttgttccagtcaacttctctttctcaagaatagaccgcaagttaaaattggatggtgcaggagctgtcatgatctacaatagaaatatatgtgtgcaaaatcagcaccattttacatttaacctttcattaaacaatttaacaaaagatactcccaccatgtattgtgaaacaaaattccctcatttattagtgtctagttagctttggcatcacagctacacaactatcaa

SEQ ID NO: 70982 - DNA, 2240 bp, Oryza sativa
tcttggaaggacagccttagccaagttcatggtagcatcccaatatgcacatcaacttataaagatacttgtcagtgttatggataaggcataccccacgatcttgggttgggctcggtctaatatactaaatcttatacggaatcatgcctcatatacggaaggtgttttggataaggagggaggagcaaagttcaagttggaaactacaaggactactcggatcgtatccatatttgtctacttggttctaattggacaaggggacatctgtgggtataaatacaagacccttgtcatgcccagaaattcccgaatagaattctaagcagaatgtacattaaaatccctgtcttacagatccacgtcttacaaacattataaaagtcttacatgaatgcaacggaaaattaaagataacaggagctaagccttgacttggattgtcgccggaacaccaccccacaggcatcctcgatggcacggacgaagcccactcctcagagaaaccaccatcggacgcacacacgaactttgagggttgggagatagagcaagactgagtactatccactgtactcaacaagtcataccagaacggaggatatgatgcaatatataaccaaaggaaggctaaaggggatcatttgcataaagctagcatttataaacagtagttgaaaatagtaaaacagttgtagtaattaatcaatattaaccatccactgtccaacactacaccacgttgcaacaggcccaaccaaccacctgaactattcaattccattagactaagctaggctgagactaatcacggtgaatcaggttgaccgcccataagacacagaggtgaatctgatcagaggtgtacaactgtacccacaagacacagccccatgacacgtttccgtgcgccgacatgccaccacgacataccggaaagaggccatgacaggacccttcgcataaccccctctagccaagcacaccacacctcaggtttcacccttgtccccagcgggcaacgggcagtcccctctcgtgcctaggtgaatccggaagcgacagaagccgtcgcagggcccaccccgctccatcatgcccacccttgcctgggagcgtcggctagaggaaagctacactacaagcccagccgttgcccacgttggcttgtggtaagtacgataagttcttccagggcgtcccgcgaaccagcaaaaccatgcacccacaacccaccattggtatattttaattagccaacaccatagtggtagtacatgtccaacattaagctaaaccaatgtctaacatttaatgtgaatcccccattgtatgcgagttcaactaagcatggctaagcaatccctaactcaacatctaatcatgttatatccccaagctaacaaaggaacaaggtaacaaatagtatggctgagacagtaggtaatcatctcatggtagcattgtaaaataatgcagtatttaaaggaaaacaatagggcatttgcaatatacgatcaacatgtccaagtgacaagcatgacttgccttgctccgctgttgaagggacctcggctacaacttcgaagtacaccggagcgtcgggagagccggattctacacgacatacaaggcaaacaatgcagacaggctataaggctactgaaacagagaacaaaaccatttttaacggattctttgtatttttcttgatttactgagccttgaatgggcttaaacggagctcggatgaattttctatgaattttagaagattcactgtgtttttactataaacagaaaaatccttaattgatttattgtgcaattattaaaccctggagggagagacgggtggtgccgacatgcgggccccacatggcagtggctttgggcgccagctcatggtgcatcgggtccacggcccggggaaaggaggtgcaccacgtggcacacacgtggcgccgatgtggcaccgacgcagcagccacgcaggtgaccacgctggcggcggaacgggcagccccgatccactcggggtgaatcggacggcggagggggcggcacgcagtcggcgcgcacgggcctggctcaagccggcccggcggccatggtgcgcggcggcgcggctcgacgcagcggcggcgcaaggcggcgaccgaccggcggcggagatcggcggcgacgcgggcggcgctagcggcggctgagtggctaggcgacggcgcggcggctaa

SEQ ID NO: 70983 - DNA, 9012 bp, Oryza sativa
  unsure (1)..(9012): unsure at all n locations
gttcgttgggttcacggccttgataaataattgaatagttctaggatggtgtttccaaaatagctttgagcaactaaatatctttaaatgctgtttactgcaaccctaaacctttatagtataactcctttgtactcccttgcatttattctgcacttgtgggtgtgtcttgttgagtacggtggttgtactcagtcttgctcaatttttcccaaccccagaagaggagcccctagaagatgaaggctttggtgtctagctcgtgcctgccgtcaagtgcctgtggtcgtcgccctagtcttccgctgtttctcgtttgtctctgtgtgtgctgggccttcgctgcccatgtaataaattaactatttacgcttccgcttgttaaactttgaattgtatcaacttttggtgtaccttgcctcctgggacaaggattaatgcacgcacgtaaggaacgcccgttgggttatttccggtcgtgacaagttggtatcagagccacccttgaccctaggacgagccgtagatcccaagccatagcagtattttcgaaataaaaatcctttgtatttgtgaaaaccctctagtctctctctgtcttgctgcttcatttatcgccaaaatctgacctttttaaatgttgcttttctttttgtttttgtttgtagatggccggcagcgtcagccgtcgtggcttggacatgactggtttcgtcttggagctgcggggcatgtgcgttgtcctggggtatccgcatggagtggactaccaggccaggccgcttccggatcaggagggtgacgatgcagagccccacgctgcgtgggaggttactgcagtgatcctcactggctctcccgagcggacttcgctggcagtcaccgcgggtggagattctttccccgccgcttaccagaacgccgctctcctcgccatcggcactcttcaccagcgctacccggacgagttgtagcactcgccctaccgctaccaccctcgccgtggaggagcccgcgactacgccaccttccgggatgctagctcggaggatgacgctaccatcgtgcacctggcgcgcatggtggaggcgtacgacgcggctcgtatcgacttccatcagatggtgcgccgtgggatggtcgagaacaacttgaagatcctggagctgcatcaggagaacctgcagctcaagaaggacctagacgcagtggaggcgcagctgcatcagctcaagatcgcccagggagaggtctgccgccccaagcgccaccgcgtctaccgcagccagaagatcaccgcccgcaaaagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttattcgtctaagcaacttgaactttaatgaaccaatttaatagcagtaataaattcaagaattatggtagtcgtgggtggttagctttaattgtcagctctctctctgtttgctggttctgtgtggggttttcagatggtgatgaccaggagaagtgctaataccggtgatggcaaccaacctgaaggcagcaaccacaaccaccagggcagcccacctccacctcctcctccgcctccaccaccaccaccagataccaacgccattctcacccaaatcctcgcccagcaggccaacatgatgactgctttcctccaccacctccaaaatccgccacaacagaatgctccaccaccacccccacaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggcccgtttcaccgccgctttccggaggacccatgtgcctgccggagtcatggcccttaagaaaagggaattccgggagttgaagcaaggcaaccgctctgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacaggatgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaatgcccgaagccgaggcgccagcaaggccaagcgcctccccgctccaacaatggtggtaaggatgttattcggggtcgtgtgaaccatgtgacggccgaggacgtgctgacaactccagacgtcatcgttggtacgttcctcatccattccatccctgctaccattttgttcgactctggagcttcccactcgtttatatctgtgccattcgtggggagaaatcagttgggggtagaaaggcttaggaaccctttgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgtgcgagacgcacggttactctgtaccgagggccggaacaaccggttgttttctttgcacccccaacctctgtcagaagttcagaacttcatcagatagtactgtcagaaatccccatcgtcagagagttcggagacgtgtttccggaagaactacccggtatgccgcccaaccgggagattgagttccggatagatcttgctccaggaaccactccgctgtacaagcgaccctaccgtatggcagcaaatgaactggccgaagtcaagaaacagttggaagagttgaaagaaaaggggtatatacgtccgagtacttccccctagggtgctcctgtgatttttgtggagaagaaagacaagacgaagaggatgtgcgtcgactacagagctctcaatgaggtcaccatcaaaaacaagtaccctcttccccggatcgatgatctgttcgatcagcttaaaggtgccacggtattctccaagatcgatcttcgttccggatatcaccaattacgcattcgtgaagaagatattccgaagaccgcattcaccacgcgatacgggctgtatgaattcacggtgatgtcgttcggtttaaccaatgctcctgccttcttcatgaacctaatgaacaaagtgttcatggaatacttggataagtttgttgtggttttcattgatgacattctggtatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaagaagttgctgtggaccccgaaacagtgaccgccgtcactgattggaagcaacccaagaccgtcactcaaattcgcagtttcttaggtttggcaggatactaccggaggtttatcgagaacttctccaaaatcgctcgacccatgacacagttgttgaagaaagaagagaaatttgtgtggagcccgcaatgcgagaaggcgtttcaaactctcaaagaaaggctggtttcctcgccagtgttagtcttgccagatactcgcaaggatttcatggtgtattgtgacgcttcgcgccaaggattggggtgcgtgctcatgcaggacggtcatgtggtggcctatgcctcacgccagctacggccccatgaatgcaactaccctacccatgacttggagttagccgcggtggttcatgctctaaaaatctggcggcactatctcattgggaatcgctgtgaaatatataccgatcataagagtttgaaatacatcttcacccagtcggatctgaatcttcggcagaggagatggttagaactcatcaaggattatgatgtgggaattcactatcatcctggtaaggccaacgtggtcgctgacgctctaagtcgaaagagctattgcaacactcttaacgtccgtggcattccacccaaacttaatcaacagatggaagccctgaacctaagcatagttggtcgcggattcttggctgcgttggaagccaagcctaccttgctcgatcaaatccgcgaggctcagaggaacgacccggacatgcgtggactcctcaaaaatatgaaacagggtaaagctgcgggtttcacagaggatgaacacggaaccctatggaacggaaatcgagtatgcgttccagataacagagaacttaaacagctgatacttcaggaagctcacgaaagtccttattccatccaccctggcagtacgaagatgtacttagacttgaaggagaaatactggtgggtcagtatgaagcgggaaattgtagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggtgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattattaagaaataaacaaagttaaaatgattttataaaaagaaaaaccctaaaaagtcctttttcccccccccttcccctcttgggccggctcggcccacctccttccctctctcctctcccccgcggcccatccggcctcctccccgtgcgcgtgccgctgacgggtggccccgcccgccaccctcgctgacgggtggggcccacctgtcatccctatcctcccgccgttcccgccgcccgcgccctagcgccgccgccgccgcgaatcccgccgcctcccgtcgtccccgcgtgcaataaagcggggggaaatattccccgtgatcccctctctctttccccccatttctccctctctctcccgcgttcaaacgggcggatttgcccccgcaaatctcgccggcgccattgatggcggccgacctcccgcgccggtttcctcccttccccggccaccctctctcgccccggctctatttaaaccctccccgcacctcctccgtccggttccgcctctcgccgcccttcctcctcgccggatttgagctcgcgatgtcgctctctctctcgccgtcgccgccgagctccggtccgccgccgtcgtcaccccggaccgcctcccacctcggggccggctccttcggcttcgccgcatcctcgccgacctcgtccacctctccgtttcggtcgccgaccgccggagcgccgccgcccccgtctacccgagccgcgccgccaccttcctccgctccggtcgccgttcccgtcgtcgccgtcgacccggggtgagccgtggaccgccgtttcacttcccccttccctcccctctctcgggcgccgctccgccgcgccggtggtcgccggcggcgaccatcagggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgcaagccgcgtgcacccggtccaccgtggaccgtgaggctgccgcgtgggccccactcccgtggacccggtccgcgcgcccctccctcggctgacgcaataaatccgattttttaattaaaatttaaatgaagaaattcgcaaatattcaattaaagagcatataaacttcaaatggccataactttgccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatgatctttgaacatattgaatcccagtttgtaaaattatattgatttaaattattgcattatcgctttatttaaattcccgcgttatcactgttttatttagccatgcctatttacctttgttatgaccttattattattgttattgttattatttccttgttcaccctagaataaacaaaaccccaactagtgggcactctactcatggtaccactagtatgattttaggtagatgcttcgctatttaattaggtaacattaggcggttttacaactatagactttgggaatattcatatcacctggacactatggaatggtttggttattgtggaattggcttcacaccgccccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcatgtcttccgtccatatgccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacgtgcttaacaattaaaatgtggaatggttggcctgggttggcttgggacgagctgggacccagggtcgggttgccagttcggtctgaatcatcgtaggccttgggttaaggcaggttcgtgtgggttcacggccttgattaataatactatgtagctctaggatcgtctttataaaatggctttgggcaaccaagtgacttttaaatgctgtttactgcaaaacttaacccctatattattatcccctcgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtatatattatcgatataataaagatgtgccttttgtatcatgtttgtttggtgtaccccggcttttcctgggacggggattaatacaatagcgttcgggaaaaggcaattttcccggtcgcgacaacctcatcgagcacctaccgcgcaatgaagagtgctagctcttatttaaccctaatttagcctatttcctatttaaatcttgccctataaattccaatttttgcaccgatgaagtttacttaatatttgtgttattttaaccaaaagattcacccgagattaatgttacccacattttattgttatataatttatttgaatttttaattagggctaattgttattccctcacaaataaatttaattgttaccaatatggctacgataatatttatttatttctatccactcctaatctttattntaaatgatttcaattatttatttagccaaattaatttaaaggtttattcctcgatagttattctttatttgcgattaatgaactccga

SEQ ID NO: 70984 - DNA, 924 bp, Oryza sativa
tgttagtacctagcagatttcagtcgatggagattagttttgttagctaacagtgcttacttcagagctaccacctatacctagttttgttagttttgtaagcaaaggggtcagccgatggtcgatggagtagcgaaggggctgccggcggcggcagcggcaccgggagggggcttcttcttattctcatcaaggtcacgaggaccttgatgggcattggcggcccccattcagtccaatggcacgacgataagcaggccaccgctcgctgctgcaattccctcgcccgccaaccgccgccaccgctccagtgcccgccgccaccactctgttgtcgccacggctcaaggggaagagagagagagagagagggggggttaaagagcgaggctgacatatgggatatgtgggtcccacaatactttttttgaatgaaaaataggttccacatatattttttaattctaataccacctaagcgccacgtatgatgaaaaccaagtcaacaccgccacgtagatggcacatcagtgaaactgcgttccaaaaccgtcgagggagtcaaattgcacctgttttgataattgagtgatcgagatatccggtattgtggttcagagatacgaatcagattcggtcactagctatgggagtccaagtgaacttatttccctacaaatctaggtccagtttgttcctgcaatgtgggccaatgcaatctgggctcagtaaatcgaacctgcaaatctacggggctttttctcaaaacaaaacgagcacgcaataatgatgggttacaaacttatagttccgcacgcactgtgcaggaggcgatcggggagggtctcgttcgggatagggagatcgtgcacgtttctccatcgtacggcaagaaatttgagtgtaactaaaaaaaaaattcac

SEQ ID NO: 70985 - DNA, 785 bp, Oryza sativa
tttcaaatggtccattagcaacatataaaagcagatttcctggttttcagttagcagccaaacagaatgcctagcaattgaaggatcaagacattcatcaaaggaaacaaagcaatggaggaccaatcaatagtccgtatgtctacactgataaccattacaaaagttactagaaaaatataaagtgatataatagattaaagacaattctatcaatcagatatgtcacctcctcttctggtagttttattaatctctcctcctgtgcatgccacttccgaacaatcacctggaaatagcatacagaaaatggtactgtaaacatgcaagttactgccatcatcagaatccccccccccccaaaaaaaaaaaatcaaactttgacttccttcaaaattttaagtacagttgagaatattaatcgtcattcactgtgacaacaatcacaacattcattttcatctcttgcttcagtacatcttacaagtgagttcttctttgttggcttttcttctgttcattctatagaccaaattagattttttttcttttagccaggcatacatatctatatatatacaatacatgcaagtttatccattatttgaaaatgagtggttagatccacgcattcatgtaactacacttcagcaaatcatatcaacagtatcttatttgctaagatgaaaataaaaaagagaataacatacggtagtaatgcaactgtagtaaaaataaatacaatactactttatttagcaggacagggttctacatttgaattc

SEQ ID NO: 70986 - DNA, 3878 bp, Oryza sativa
tctcctaaagcaagcaccgattaggggggaggttttcaactcgaaatttttgcttgaactctatacgaaaggtgaagaactctctatcctccttcatttggctccatttttgttatatttcgttggtggaaagtggagtttttttaatattttgacaaggtttgttctaactaatttttgcaaaatctagcttcaaaatatatgttttgatgggcaaattttgcatgtaatcaattgtacatactagttacatgtattgttgtatttttttttggagacaaatgcatttaaacttttgtatgaaatacctgcggtctatttttttatttgtaacttttttgcctttatataattagatggatcagtcgtcatggatgtatgagatgtggagaacgcagccgatatttattaaggaagcatctaatttattgatcaggctaaggcgcatgctttgagggagaatatgacaaagatcttttgtccgtgccgtcattgcaagaatcagaaattgttggtagatcctggtgaaatattgggtcacataatggagtacggattcaccgccaactacaaggtttgaacctatcacagggaattcgccaatccgaaagatgacgatgaagagttatgtttcgagatgaatgaggcagagaattttataatcgaagacatgtcgcgtgaaagaatggttgtcgatgtttccaccgatagtgatgatttcgatggtagttttgatttagaggatatgctacgccatgttaaaccagaggtgctagcgggcaggtcacgaggattggagaattggcaggcattagagaaggcatcgaaggatcttctttacgatgaaccgaagggatgtgataaggatttcacagtcttgcgttcagtgcttgaacttctaagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaatggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccagaaaatagatggtatgattcgacatcccgccgacgctcgccagtggaagacatttgatgcaaaacacccagaatttgctaaggatcctaggaatgtaaggtttgcattgagcactgatggaatgaacccgtttggtgacataagcagctcgcacagcacatggccagtccttctcacaatgtataatcttccaacatgaatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacagatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaatgttgtatatggaaagggaaagaagaagacagtaaagaggaagaaagctgatggtgacaacggtactgcgtcgcctttcaagaagcactcaattttcttcaaatatttagattacaggaaggacctagagattcgacatgcaattgatgttatgcacctcgagaagaacgtgtttgatagcaccgttggcacattgctggacatcccgagtaaaacgaaggatggattgaagtcacgtaacaaccttgtatatttgtccatacggcatgaccttcacccagtagtgctgccaaatgggaagaccgagattcctcctgcttgttactcgttgacacttgaagagaaaaaagccttcagtaaatgtttacaaggggttagagtgcctactggtttcacatcgaacatcaggaagctagtatcaatgaaggatttgaccatttcgggatacaatgcgcatgactgtcataggttgctaacggtgttcctaccaattgctataagggcagtcaaaccagtccacacaaaggtggttataacaaagttgtgctactttttcaatcgaatttcgcagaaggtatttgatcctttggaattaggtccgcttcagacatttgccatcgagactgtatgacagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcatccggaaggatcattgatagaggaatacacaactgaagaggcagtcgagtgttgtatggactacataaaggatgctaatgccattggcattcctgttcatcgacatgaaggtagattgtctggaaggggtactgttggtaggaagcagttcttcaataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctccgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcactgcacaaaacagtaggatccgtgtcgaagcgattgacacgagtggagaaaagaggtcgtattatgggaccattcaagaaataagggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtgttccaaatgtacgtgcatgaatttaggtcccccttatgttgtaatcattagcatgtaacatttgattacgagttttgagcaattttcatgagttttcttagtgccaaaaacattggaatggataattgtggcgaaatattgggaaataa

SEQ ID NO: 70987 - DNA, 1072 bp, Oryza sativa
aaaggaaaagactggaggaggaaaactaaacacggacaaaacaagcccactccaactaacaaattatcattaacctttttgtgactatagagtactttgttttttttaattaggagtacatagtggtattcgtacgggcgtgaccgaattattaactctcttctgatgctgacgtgttgggtcccacctaacgctaacccccacttgtcagtaatgcaaatgatatgtaacggcgagtgccatcggaccacggcccatactttagtcggcccagaaaatactgcttatcttttagacttttaattttggaatacgtctattttatctccctctcacgctcatgttgaatcgtgcccctcaaccgcaaaaccggtataatgtctccctcgtcttcaaaaaccaatgcaaatcaactccttcgatggttttgaaagtggtttctaccaacatggcagtttgatcgcggttgacttgttgaaacaatatgtgggacccatatgttagcaacttccaccttgtatcgtcttctttcccacctcttccctccctatattttctctgttggtcctctctcaccttccatcagcaatgcaggacctagccggtcagttgtgcacactaggaggacctgcccagtcgaggcgcgcaggagaggagctcgcatgccgaccgcgcacgcatagaggaccttgcctactacagtctacggtagaggagctcgttggagctggccaactgtgcacccagggaagacctggtcaattgggcgcacagggcaggagctcgttggccggctgcgcatacagagagggccttgctggtcgtgttgtgtggatgaggagctcagtggttgtccgcacgcacgcggggaggacctggctggccacaacgcgagaatggaggagattgctgatcggctacgctcaagaggaggaatccccgtccatgacacgcgctgggaggagcttgtcgggcggcttcatgcacgtgcactgaggagccctctggccagggggcaaaggggaaggagctcgcagaccggctgtgctcagaggggggggggggggggggg

SEQ ID NO: 70988 - DNA, 2482 bp, Oryza sativa
taacagtgggacctgcatataagtagctgacatttgtaatatctctttgtagctataaaaagaggaccaagaccacatggaaaaggggttggattctttgaaggcggactacaacatcaagaagcaccgttgctgactaaaacattcagaagcacccttattgacaacaacatcgagaaagagtccatattgttagtctctcctggaaatcatgagagtagtaaccagaaccaagagagaacacatccacaccttgtaatcctcgataatctcagatatagtcaagaacaaaacagcagggtgttatgcttcctcatggcccgaacgtatttacatcatttggctttttgcatttatcgtattttctgaaaacggacctcgaacacccgcaccctagccaaatctctaggggaaggggctccttatttccccgcttaaggacctcgggctctgacacatggtgagagagaagattttcttgacttcaattccaccacatctcacatatccaagcataaactttggtttgtttggatgaggattcattttttttaacgaaagataagaatttgtgtgttcgtcaaaagaaatgtaggatgtaataaggaaatgatttgtcacttgccaaacaaaatgttgtactcctgattttctccttaaaatcaattggttgcacgataaaagccatgttgagctggacgctaaacatttaacgttactaagatctccactaacgctcgcacattcagcaaattaatttagcattgactactattacaagtttataacgaggcgttagctagacactaatagggcgggctcacactattagtatttttagtaagatggctagtacttgcttaaatccacacacatgtgatatcacgggagagaacaacttttcattgttcttttaatctcttttagaagaaatcttctctcaaatatttatttttttcttcttgaaatgaggaatatatgtcgttattcaatacatcagtctcgacttaaaaagttaatcccttctattctgaccaaacgtacagaactaattcttgcacatgcactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttaccaaccaggactaaagatcatctttagtcccggttcgaatgctgtcaggacctgtcaggcccccccgggaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaattggaggtgcctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtgtgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaagaaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttatt

SEQ ID NO: 70989 - DNA, 9834 bp, Oryza sativa
tcgccgccgcacggacctctcccccctcgccgttgtagccgtcgccgcagcacggacctctcccccctcgccgtcgccgtcaccaccgcacggacctctcccccctcgccgttgccgtcgccgccgccaggacctctcccccctcgccgtcgccgtcgccgccgcacggacctctcccccctcgccgttgccgtcgccgccgccaggtcgtccccgccgccaagtcgtccccgctaccgccggctcctccccgaagtcgccccgcccctcaccgtcgccgacgccgctgccaggacttctaccccctcgccgttgccgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgttaaattgggatttatgtataattgggacttttgttaaattggcacctatgttaaattgggacttatgtttaaattgaaacttatgttaaattgagatttatgtatatttgggacttttgttaaattggcacctatgttaaattgtgacttatgtttaaattgagacttatgttatattgggatttatgtataattgggacttttgttaaattggcacctatgtcaaatggagatttctgtttaattgtgactgatgctaaattgggacctatgttaaattgtgacttatgtttaaattgggacttatgttaaattgagaattatgttaaattgggacttatgtgaaattaagttattgggacttatgtgaaaataagttaaattgtgacctatgttaaattgagatttatgtataattaggacttatgtttaattgagatttatgtataattgggacttatgttaaattgggacttatgtcaaattgagacttatgtgaaattgcgttaaattggtacttacgtaaaattgggacttatgtcaaattcttttacgtcaagttggaacatgtcgaacgaaaaggttccatcgaatgcaccaatagcgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgttgaaaatcgttagccatgtattattccctaactatgatgtgacatgaacctaatggtgtatagagttacctattctttgcagatggtagtccgacgccgctcgaaacgtaaagccgagaggaacaggacagagcaagaagttgagatggacaccgctacgtctgcacctgaacgtacggagacatctacaagtgcaggcgggagtgggaaaaaaagatgtggtgagagaagcaagaataaattacccaaggaaacttacaacgtgattgctctcgatcaggatgggaagcccgtcgagccaccgatagtgcggtccaagttcagcaacgcatgtggcactctagtcaggacacgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcatacaacagctgaagcattggctttgaggaaaaaaatgtcatacgctggtcacgtcgatcaatggcgggagatcgagcaaagatttgccgcggccggtaagcccctgctggtagaccccatggttgaacgtagcaagaactgggtttgggcgcgtagcacaggtcaagtctcggatgagggagacatactattcgagactccagacatagaagaagtgactactaatttgcagcagatagtcgagaaagaaagatcaggacagttcgtcccacggtggggagcgagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcctttccaaggttattccctgatagccaacaacccacacaatccgcacagcaaacaactaatgtacccagcagtgtaggctcagtgcagacaactaccttccctgtggatagtataactggaccacctccgtgcagtctcatcgtaccaatcggtcgcgctggaaagactaaggaggttgcaatgggttttgcaatacccggacgtcaattccacaacacggcaatccctgaggattacgcaaggatacaggtcgccaaggtccatagcaaccacgtttccttggaactagacatacctacacttgaggggattgaacttctcggtgatgcagtgaatcagtttatcttgtggcaccgcagagacataatcctgagcgcggcctttcctgcagcaggatcttcaaccccatcctcatcacaggcaatgactgctgccgctcctgcaccaccgtcgccttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaatgagaaacagcggaagactagggcgacgaccacaggcgcttgacggcaggcacgagctagacaccaaagccttcatcttccaggggctcctcttctgggtttgggaaaaattgagcaagactgagtacaaccaccgtattcaacaagacacacccacaagtacagaataaatgcaagggagtacaaaggagttatactataaagggttagggttgcagtaaacagcatttaaagatatttagttgctcaaaactatttagtaaacacgattctagaactatacaatattatttatcaaagccgtgaacccacacgaacctgccttaacccaaggcctacgatgattcagaccgaactggcaacccgaccctgggtcccagctcgtcccaagccaacccaggccaaccattccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccacagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccatttgtcacaccctgaaaattcaaaatatatatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaatcccttctctctcctcagcccagtccggcccagtccgcagccgcccgcgcgagcgcgctgtcgctgacaggtggggcccacccgtcagtcgtcgtcttcctcgggccgaaaccctagtttcgcgccgccgagctgccgtcgccgccgctttccaaatccggccgttcctttccttctccggccgatttgttagaggggaaacaatctccgggatctcctctaccttttctcctttggaatctttggttaaatcgctttggaaagcgtcggagacgagttcgtttcggatcggttttccctctctccaagccgaaggtttccttcgccgttgccgtcgccgtgggccttcgccgccgcctccgagcccctttaaaaggacccccggtgtctcctctacccgtcgcagccctcgccttcgcctctcgtcgccggaagagctgtagcgccgtgtgccctagctttgccgtcgccgccgccgctccagccgtgcgccgccgtcgtttcagccgtcgccgtcgctcgggaagaccgccgtcgtgcttgccaagtcgccgccgtcctcgtccgccccttcgctgccgtcggagaccgccggagcatcgtcgccgtcgtcaacccgaaggtagccgccgcttccttctcgtcgccgtcgtcgtccgttccttttccgccgccgttttggtcaccggtgtgttcgccgcgttgtcctctacgtgctggtgccctccgttggtgccgtggtgccgccgttcgccggcgagtgtccgccgcccgagccgttttcttcgccgagccgccgccgtcgtcggtgatgtcatcgttgacgtcatcgggatcctctcccgtgagccggtcatggaccgatcgatcttggccgtccgatttggatcggatcaatctcggccgtccgttcgcgtgaaccgccgcccatgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaattctctaattttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatacaattgcttagccctgcttagaaacattagtacacttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatacaaccatattatgccatcctttgttatcctgtgcacttgcatatttgctgcgtggcttgttgagtatgtcatatactcaccttgcaatcattcatcagaagaagagttctacaatgaggctgatggtgtggaggattaggtgtagccttggtcaagctgcctgtggagtggagccgtctgcgccgtttatttaatttccgctgcttagaactttattgattgagaagaactatctacctctgtaatgacattttattcgcttattaattagagtattatttgtactctattatcaatttgttattgtgtgcctcggctgattcctggacgagggttcacacacatgtaagcgtttggaattttggatagaaattccgggcgtgacaagttggtatcagagcccctttgaccctaggttataccaaatggttacccaaagaagccctctgaaaaatattggaaaagtagaactgttctcctccctttctcttttaattaaccaaactaatggcacatgcacttcataattttttttttaatggttttcattaaaaatttattccagtgttattagtactgtacatctattactgtactaatggctcatttatcagcaaaagttttacaatactgttttatttaatcttgctgcaataaaataaatttagtatgttgattttataatttcctttcatctcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggatttgggactgcccctttttatacccagattcctcatgatcgtcatgaagagaagtgccgagtcaaagtcaccttgaacagcaatagtgaagatattccctcagtgatgttcgaagctggaggaagaaactacatccatgcatgtcaggaggtggcaaggatcgccataggagagctccgtgatcgctacagtgatcaattggccgacactgagtatcgttaccatcctcgccaaccccagggaagtgaccgtggcagttatcttgagactgaaggaattgagaattatgttaccacaagacatttggttgagatgttgtgggctatggatgaaagtcgtgcggagactgtgttagcagctcaagatcgtgaagaccggaatcatggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcttaagtagtgatgaagaagaagaatctaagcgcaacaattccaagattgagtgggtagcaacccaagatgatgaagacgagccttcaatcgacctccgatgcttggaagaactagagtgacttgttaagtcgttgtcatagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagttttccccgttttctcttcttgtgccctgtccatgccagatggtgaacactcgtagcaatgggaatggtcccaacaaccccaataacaacaatggagagaatcccactcttgctcaagttcttgctcaacaaacacagcttatgaacatgatgatgcagcaatttcagaatcagcaaaaccaagggaataatcatgcacctccccagaacaagttagcagaatttcttcgtgtgaggccgcctgttttctctagtaccactaatcctgttgaagctagtgattggctgcatgccatagagaagaagttggatttacttcagtgcactgatcaggagaaggtatcttatgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtataatcgcatggagcagaagaaacgtcggattgctcaattcaagacacaacagggaaataatcagaagccgcgtcttactttaggaccccagtctatgccacagggaggttcttcgtctgttgttcgtccgcaacgtcagttcttcaacaacaatgctggcaacaacatccgtaataaagctccacgtcctgttgcagctccagtacagcaacaacctgccaagagggagcaaggcagcaagcccgtggtgtgtttcaactgtggagacccaggacattatgctgacaagtgtccgaagccccgtcgcgtgaaggttgtccctgcccagagtaactctgctgtaccagtatccaaggctcgtgtaaatcatgtcgctgctgcagaagctcaagatgctccagatgtaattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctcggtcagaatagaaattaaaggagtaccatttctggccagatcttatcttgttagaatccaaagacctatgatgtcatcctagggatgg

SEQ ID NO: 70990 - DNA, 726 bp, Oryza sativa
  unsure (1)..(726): unsure at all n locations
cgatggggtannnnttaagatgctatggctgtctgcccggaagtcgactctagaggatccccactttgtcaatcttttcaagatttggcggtccagtctttgaagatgctcataggggttggggttacctgcctgccttcataggggtgagtgcccctgccttttgagtgtctgccttgtactgtgtaattttaaaaaaaaagttttagggggaattaataaaacaaagaaactttacgtatgcattggtaataatggggataaaaaaaattttgggtttcggtcaacaactaatttggacatagaaactaccaatattaccattttaatttttggagaaacccaattattaaatatgtcggacacttttggatgaacatattatgtcattcattggggattcttatcctctttggggcttttttggaacgtgagaaaattttttgatatattcctattggaatttgattgaattatgaatattctttaaaaatggtggttatattggaaagaattgttaaattggagttcggtctacttataaggatggcgtgttcaagaaaaatgaaggcccttttggcttttttgtggaaaaaaggttacatttttgttttttttttgctgtttccctttggtgaccccactccccccccgcacgaattgcttaattgcattgattgtccgttgtaattaattttggttaaattctaccaacctgtcctcccg

SEQ ID NO: 70991 - DNA, 3710 bp, Oryza sativa
atcctatatcgcggtgaggagtatgagaacctagaagcatgccctgtttgcaaagcactacgatacaagattagacgggacgatccaggagaagttgacgggcagctaataaagaagagaattctgctaaggtgatgtggtatttccctataataccacggctaaggcgtttgttcaggaacaaggggaatgctagaatgttgcgatggcacgccgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgagacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacaatgtttgctatggttaaagatcttaaagtagtgttcggaaaggggcctggaagccagcatatagagagcgaagatggtcacgtggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagtatatgaaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgagcagcacttggctctagttcgcgctaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacaagagcccaagacatgaagagcacgaaccaaaatagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtgacaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattagaatttttattaattatatttgcttattacgatttatccacttaatttattacagccaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatatctttagtcccggttgttgagaacaaccggaagtgatatagtcccggttgttgagaacaaccgggagtaaagatccaggggtatatatattcccggtgcgccctcgtcttcttcaccaacacttaaac

SEQ ID NO: 70992 - DNA, 2758 bp, Oryza sativa
tatccgggagaaaatatccatattcgtatccgtatccgaaatatccgagaattatccgatccgaaaggtatccgtatccgtttttgtccagagcggacggaaactatccgctccgttttcatccctattgacaagccactggaagatgagataggaggaagacatgaaagagagagacagtgggagatgtaagaagatgagatgaggtggaagtcgctaatatgtgggttacatttgctgatcgacttagcgagtcaaccattgtcaaactgccactctagtagaaatcatttccaaaatcactgaaggagttaatttgcaccggttttcaaatatggggaggcgttatacccagttttgtgtctgggaaaggggattcaactggaagcatacaaacgaaggccaaatagaattattcctttaagttttatcactgctttaggccctgtttgttttagctaaagatttgtaatatggattattgagtcagattactgtaagctggattataataagccgacgtagaataagctattagttgtttgtttctctggattattagctggttgtttggtgttagccacctaataatctaaaaaaacacctttagagtggattactatattatattatattaatctggcttataaattataataatctattataataaggtatatgtttgtttcggcttactcctaataatccagattataataatcctaagctgaaacaaacagggccttagtcggcccaattacactctttatttcaatttattaattcgactccaatcacactctagagttctttctctcttttctttatcatcactcgacttatttatatttctctgtcttttgactcgaattacactcgaatttttttatttctatgtgcttcaccaaccgaaactttttttaaaagtgtggtttgagaaaagtatgaagtcttattatcttctttataatccattgtctcctccagccgggagattaccattcacccgacgcagcgacctcaacagttgcctatgtcctcaaattatctaacgtttgatcttgtatttctcttcttttatctcatgtgtgttttcctttcctctcaaattttgagacatttggaaacaataataaaaaaagaaaatatgaaaataaaaaaattcaccgtcgtcacaactcaagagcaatcactaacaaacttcggttgagtccatcataatcttgtttgttatgggtgaattgccgatagcttcaagcaccttcatattcatcagttttgccaatcaggccaatgtgtgtgcttcaaacatttgcaccgcaagatagaaagaccaacttgtattaggaccgtcctcttgtagcatgcaagtgtgccagcatgataggcatagaaaaaattaactttcacctctggatttggtgaactccactgtctcgattcgtagcaaaaacgactgtcggttatatagaagagtggctaaattgcaaaacaaaacgccatgtctagttgcttcctctcctgccaatgcctaccagcacatatatattcatgctctgcactgctatgcaatgctttagcatatattagatgtgaaatttgtcattccattactgtgatgatgaacaaacaaaatgacttgttggaggaaacaactgaaactcatacatgtgtgtgtccgggtgagggcttcgatcgatcatctaaggaattcatgacagacaatgcatatgatgtaaaggagcagcaaatatgtagaaatgctaataaataaatacattgacgtatgtgttgctttctttttgacattaaacatataaaaaaaattgaggtcagaatagggatatatacaaaatctttcttttttcagaataactttctgatctcagctctaattaatttgtagaggagaatgctcgcccaaaagaatggtagcaaagtccggtttgatgtagcttttcattctcgtttgagcaactcgtccagaattagtattaaacactgtcatttcatttctttcataaacatgattttagagtgtgtttcgttaggcttttcaacctgcttttgcttttgcaaaagccaaaagccaaccaaaggacccaaaagccacagctgcttttgctccaagccagtttttggtgtagtataaatcaaaataatctctaccctacgctttcacctgcttttggaaaaaaaaattacccacctttgccattagaaaaaaacatttcgcttcgttcttttttttctcccgtccgttcccatcgcgcgtcgctcctcctcaccgagccgccgccgccgctcctcctcctcgctgagctgccccgccgtcgccgctcctcctcctcaccgccgcggccgtccccgccctccctgtccccgactccaccacctccttccgccgctgccgccgctcctcgcggacgaggaggagagagtacatcaagcgatggcgatggcgatgcgaagagaagacatccgctcctctactccggcgagccgccttcccacaccggcggggcgggtcagccccagccggcgagtgcggccagccgccggcgtaaccatcggaaaaaaatttggtgcataccggatgcaaacctcaatccgtgcgtacccgagtcagatgtgcgacgcgtggatgaggcgtgcatctggcggccggcctgtaccttgcgcgcacagccgcgtctccgctcggctcggctgatctcgatgcattacgcgcggctcgtgctcgctcctctcggctcgg

SEQ ID NO: 70993 - DNA, 663 bp, Oryza sativa
  unsure (1)..(663): unsure at all n locations
gagcattgaacgggaggaaggggcaaaattagtcatgagacaaaattcatgggggataaatattagcagacgggggaactagctgaaaaccagtgtcttgcaataatcaagaaaagtagggttctaagctttaaagtgggataaatttcctggaaaaaaaaaacatagacatttggcaatccaacatcagccagaaattggagttggctagccagaagatcctaccaactaaaatgggaggtgatgggatgacagactcaccagtcgccatcaaccaccagtaagttttgggtggattacccaatctacagctatttttatgtaaattgttttggtggattacccaatcaacagctatttttatgtaaattgcgcataaaatacataacgcaaagtgtataatgaaagaaaagatgtggaaaggacataaagcaaaaagaagatactaggtgggctgtcanccagacagcccacttatatctccaaccctgccaatactattccttctccagaaaccatagagaacagtgatgccattcgtgactcaaccattgattgggatgatgaaccagatcaaccatgaaccacaaactgagatgatgaaccagggtcgtgggatgtggcggtgaaccacgaatccggtcaccataggatgtgcaacat

SEQ ID NO: 70994 - DNA, 9482 bp, Oryza sativa
ccttcctccacgcgcgggacggtgctacctacctgcccgccggccgcttctctccgtcgaaccgcaccaccgctttacgaacgcctccagccggatagcccacggcgatgccatcttcctcctcgtgcaggaggccgctgctgtcattcctcgtgaaggtggctgcttgacatcccagtatcatttatattcaattgtttcaggaataacaaatagcttcagatgtagtatgattcttcctgcctgataggtggtatgccattgatgtactgcttgttcatatacactcaatttttttccatatacagtcaattgatgcaagcatgccctcaaatcgattgcaccatcctgattcttagagtttgcgtgccctaaaaaattgattgtatattctttagtcatacaggttgattcttccggtcatgggagttggttcccaagtaaattgctcattacatttttacatacaccatctttgcaggtgagatatgtggggtgcagcattgctggtgattcaagattagaaagactaaaatgaacaagaggccgcttaagaaataccatagaacaaccaaagacagaacaatagagtgaagacatgctgctttctgaaggaatttattctgggagctgatgtgtgtggaagtagttagttttgcctgatgtatgtagtctttctttgtaatatgtactatgtatagcctgtacatggttaagagtttgcaaggattgtagtccagatgctataaatttgaaacccatttttttggttcaaattgcaaatatctgtacaatgcagttttttttttatctgaaataagtatgacgtgttggatgctatgaaatctgcagtggattgatgtgataaaaaaattgtggttgtttatctgattcctttcaaaaagaaaatatgcaatattgtgtaatctaaagtcttgatgttcaatctggaatgtgatgtcatgtctagaaattttctgaaacaatatagatgttttcacatttcatacatagctaccaaattcatggtttgagaatgatcagctattatttttttagaatgatcagccatcttactgattgccgaatccaggataagaacctgcaagagaatgagcattgttttcattggtggaatcatctacatgagcagcaaatgctttgcactgaacatgaccttgccgccactgccgtcacctacaacgcccgtggtcaggacgagaacacaggggatgaggcagcggcggcatacggagaggtggccgcatcgatagataacggaggagatagtgaaagagcgagccggcgacgtcgaggagaggcaattacgatccgatggagtcgagatagggagggagatcgcggcggcagcgggaaggggaaagcggagttgcggccggaggaaaggcgagccgtccagctcgttgactccgcttcgttctggttgttggagccgatacgagcgagctgagctgacccttatcatgctgcggctccagccgtgcgtgccggccgtcggatgcacgcctcatccacgcgtcgcacatctgactcgggtacgcacggattgaggtttgcatccggtatgcaccaaatttttttccgtaaccatcccctgctttgctgtgctaggaggaaggagaaaactactatttagacgacatgtggggtccactcgttagggaagaagcttttccaaaagccacgtgtataaagaacttttggcttcctcacaactacttttccaaatctattttttaaaaagttatagcccacagcagcttttccaaaagctgcaacacaaccaaaaacacccttagtaacattctcctttcctatcaaatttcaggatatatagagacgatctcatcaatcaaatttcaggatatatatagaaacgatcttaaccgccagtcggcggtcatcttcatgctcatctgccaacatcttgtcggtccgctattatttcgcattggttagtagttagctcaataaaaacaatcctcaagaaaaaaaaattgaaaatggagctgatgaccactatcgcaattcacgagtgatcactagtgaactttggttcagtccatcacgatcttgttgcttgtgactcatgactgagttgtcgatggcgccaagcacattcatcctcatcattctcgctaatcaaacagatgagtgtgatcaacatttgcatcgaatgagagaaagaacagctcagatcagaacgagccgcttgtagcgtgcaattgcgccaaaactaactttcgcttgaggattaggtgaactccactatctcatagcaaaactagaccgtatgtagcgtgcaagtgcttcagaggcatagagtgaactaactttcgccttcaaatttagtgaactccacaatttcacagcacaactacggtgggttataaatagaagtggctgaattacaaaacataataccatgtctagttgcttcttctcctgccaatgtctacctgcacatgcatattcatgctctgcactgctatgctatgctttagcatatattaggtgtgagatttgtcattccattattatgataatgaacaaaccaaataacttgttagaggaaggccttcgtaagaaatgaataactgaccatgcatgcatatcagggcaaaggagcagaaaatatctactccctccgtcccaaaatataataacttatagcctttagaatttgtctcaaaatataacaacttctccaccaacattctattctcaaccaatcacaatcctccaccattcagtttttctacctacctctatttttcctccaatcacaacactcttccatttaattctaccaactttcttaataaccgtgttcaactctaaacatgcttatattctgggatagaggtagtagggattatgcataagctttttttttttttgaaacggtgacatcatgagctctgcaggatatattgaaaaggaagaggaatgcattagcatatttagtgcgaatagatagaacaatgtttttcttttgtactttttgaactataaaccatatataaaaaaattgagttgagaataggccgatattgtcgaaacaagatttcggcaataataaaaaggggtggctgtcaagctaggaaagtggatgggtttagagacaaggaattttatacaggttcaggccttcttattcaagaagtaatactctactcctgtccggggataattccgccgagtgtgttattgattgtatgattaggagaaaaaagaatcgtcccaagaggaacccggacacctccttatataggggaagggatccgtattacaaagtacagtccatatcctaacggaatatgggattacagataaaatacaatcgtaaccgactaggatcccgggtattttcttgacatacaagtttagaatctaacccaagtcctcataaagatattctatctatatttggtaccatatatccagctggaatataaccgccatgtagatatggggtaaccataatctccacagtagcccccgagaccttcgcagttgaccaaaatagtcttctcgaaacaaaaaaacaataatccgagtgcttcaattcaacttgctccggctcgccgagtgctaaaagactgtgaagggcgaaaataaaacatggtgcatcgagtagatgcacctaattaggtgtagcccccgactatgtgattagttgaaaaactaaacatatagtcaagaaccgagtggttttatagcgaagcccgcatggtacttagtaagatacccagccgactgtttctcaacttgaacttatcaaggacaaaaaatacaagaagggccgagtgataacactcaaaggtccagaaatagacatgttcgatagaaattgagtaaaaatctcataaaatgatccaccaaacatgatagaaaatcatggtaattaatgactctaatagcctaggctgtgacccttaccataaccaaaataagcatataacatgctaaaagaatggctattaataaatcagtcatctcaaatcaacccaaacagcttttgcagcctaaaaaagcttacaaaaatggtataacacctttctatcgggcaccttttcatatgcatcataataattccaaagaattattgaatcgcgttaaaaaggattttaatagcatcgggccacatcattatgagcacatattgccaaagcaaaaagcgcctaagtccctagggatcacaatgggccacgctgaaaacataattgggctgaagtactgtataggcccaggcccattagtacttccgataccctaaaaacaccgaagtccaaacgtcgtttcgtcttccccgccgagactctcgccattccccactccgtgctacagtatagaaccacgccgacgaagctagggttcatcaatctgctccaacccaccctcaaaaacttcgcgaaatttctccccgcgtccaccgctccgattccccattcctctccagccatatctcagaccaaattaaaccatccagttcacattcatggcggaagaaagagaaagcttcgagagtcagtgggcgccctccgatgtgacagaagataatctgaaggagatggtggcgcacggcgttctcccagcgaaggagattatcgggtggcgaccggcgttcggcgaagcattcccgacccccgacacacacgaaatcgtggtatttgctcatttcttctatggcggattttctcttccaacctcaagattctttcgggggattctgaacttctacgggattagcttgcatcacttgaatccaaactccatagtgcatattgccaattttatccatgcctgcgaagcttttctggcattaggcctcatttcgccttgttccgccgcatcttcttcctcaagccccagccaaacaagagcaaaccgtgcgttgttgggggagctggtttccaactcagaggaaccttgagccaaaaatatttctccatgcccttcaaaacctcaaacaaaggctggcatgcaaactggttctatgttcagaatcctaagcccgcactccccgagtactgttgtcttcctccggtctaccaggacacatggaattcattgcctatgggagatgaagctgctcaggcagtggaattgatggaacgcatgctaaaactgaaggaacaaggtttgcagggagaacagatcactcggcacttcatcaaaagtcgattagctccaatcaaagagagatcccgcacggcttttgagtttgatggcaagcatgatccaaatcgggaagatccagattctcttgactttaaggtcatgaaagaaagaatgtacaagatcttctcaaacgctattgttgtcagctattcacatctgctgcccgttgtgccattcaatgcattcaaccctcctccaccggtatgcactcaaacatctcagcctttctcaaaatacagtcttatctgtttgttgaatcagttaacaataaaggatatcacgcccaggaatttgctttgatgaagtcggatcccccaatcgctcaacaccgatctccctaccaccaaactgggcaagggagcggtggaccaagaattcggtctgaaactcaaccaagtgctcctgatccagtcggccagccaaattctcgcaagaggaaggtggttttaagcgacgacgaaggcgacactgctagaaagcttggagaccgagaggcaaccaaaaaactgccgaagtagtctactccaaggaagaaaacatccagtcgtcctgtgccaaagatcaggaagtcttccaggtataactcctataacgatctcccttgcggtgatgcgcgctcggtgcaataataatactgataatcaaacttgcaggaaaccatctgatatagatccttctggaaaagactctgacctggccggcagggaagcggatccctcaaaagaaaccaggccgactgcaaaagatcacctgagtgataatccgcaggcaagcgacaatgtagaacccagcgacgaaccccgactgtgagccagtcggccggagctggagtcggagttcaccaggagcccccgactgaaaaccagtcggatacagggccaagccaaaaaactcccgaggttgaagctcaaacaaacagtcctcccggaaaagaagctggcaacgactcagaaaccagatctcctgtgaggacacaagagtccacccgttctcgaccgggaattatcacaggtaaacacaccatctgagatcatgtcgatccaacagcctttatttgatctcctcacctttattcatgaatacactagggccaatgattggtgatgaagaagagatcctccggatacaagcagttgaggattcacgccctcccattctggtcaagtggtgggatgacaacatgcagcctcaaggaatcgtaataaataagcaaaaagaagacgaggaggtatgcttgctgaaaaaggcactcagccaagccacccgtattgtaaatgtaagctctttggcgcctgacctcaaccgtctcgtttgctatttaatctaggcgctaattaaactgtcttgcagaggattcatcttaggaacgaagctaaaacggcaaccttagagaggctagtccctcatctcgggaccctcgaagccaccaggagtcagctgtacgaaacaaaagagcttgccaggaaaaatgagcatgatctgagggatcgaattgctgagcttcaggaatccaattttgaactgagtggctcatcaaaaggtacgcacaaactctgcccaactaacttgtgccgttgtctttgtaatcatgattaaccggggttaatgtagtgcaagctgccaagatatctcagttggagaagcagattcaaattctggaaaatgacaaggcagaactggcaagacaaaaagacttggctttaaaggaagttgaaggtatcgacaatcaatacttcaaaagccattatcctccatatgctgacttatgaatgtgaatctgtgggccaaccgcaagatcaagtctcaagctcaattcgacgtcctggttggcaagatcaaaaaacttgaaggagcctgggatgaagtgcttaccctggtggcccaattggttcagcgcattgtctttaattaccaccggccgagtgcccttgatgcttttggaatttcgacaagctgagaagtgcttcggataatatttcaagaacatcaagaagctggaagtataggagcagtcttacgttggcaggaccaattttcttatatccagggtgaccgttaatgcctttgatggttttgcaaatggaacaaccgaaaaacttggtcttgaccttattagcgatgcgcagaagccacttgacagatgctgctgatgtagttgagagattctaggacaccgatcatggaccgactggttctgataattgtgatgatgaaaagactgactaactaatgtaccaatgattttgatgaataatgatgatggaggcacaatttgtgcaatactgatgaatttatgttgggcttgatatcttagcttagttcgtgatttcttaaaagtgtttgtcaaacctggttgagcctaaaacccgcaaaagttggtaaaaaactttcagtcctcattgagtaagccaagaaatcaaacagggcaatgatacatcaagtaagcaaattgaattcataaaaatcacactccattattatcatagtagccccctgactgaaaacttcaaggaaaaaacttgaagttagcagtcaaagaggaaagatacaaacgaaatgcctaagcataaaatcgacgaaggtgttcaatattccaagaatgttgatgagagtaccgtcttcgcgcttgagtcgataagaacctggccgagtaacttcagcaattatgaacggtccttcccataagggagataatttatgccgatcctgtgttgtttgaattttcctcagaaccaggtcgccgactaaaaaggctcgcgatcgaacattctgattatgataacggcgcaacccttacaaatatcgagtcgactgaattaaagctgcttctcgagcttcttctagtcgattgatgtcgtctactcggccctcttcatagccctcctcgttgaagttccgaaatcgtagtgattcaaattccacttcactcggcaacattgcttctgcacaataaaccaaaaagaacggcgactggtcggtggcccgactaggagtagtgcgtaaagaccaaagtacggacggcagctgatctacccacttgccagcgtagggacgtagtcggtcaaaaactcgtgctttgatcccttgaagtatcatgccgttagcacgttcgacttgtccgttactcatggggtgtgccacggaggcgtaacaaattttgatgccaaagtcttcacaaaagtctttaaagctccgccagtgaattgagtgccattatcagtgatgatccgattaggtaccccaaaccgatgccaatgttgatgaaaaaatctctagctttatctgctgtgatcgtgatgaccggtttagcctcaatccacttggagaatttgttgatagccacaaagagatgcgtgtaaccgccgactgcccttttaaacgagccgaccatgtcaagcccccagaccgcaaacggccaggacaacgggatggtttgcaactctgggctgcaaatgagtttgtctggcaaaaaattgacaaccttcgcatgtccgcacaaacttgtcagcttcaaacacagttgtaggccaaaaaaaaccttgccagtaagctttgttgacaatggtccgtgcggcggcttgattaccacaaatccagaatgtatatccttcaccaattgtctcgcttcttccaaagacacacagcgctgcagtattcctgatggacttttcttgtacaactcagcctcatgaataatgtaaagtctgctgcatctggaaatccgctcggcttcgtttttgtcttgagggagttcttgcctgctcaaaaattttataaacggttctctctagtcggcttcgatcatgcttatgccttgagtatccatggcttcgactgtctcttttctgggcacggttggttcgtaaaggtgttcgacaaacacatttgaaggagctgcttcccgttttgaaccaaaattggccagtctgtcggctgcttcattattatgtcggagaacatgggtgagctcaagtccatcaatttattttccaacttgtgtacctcttgtcgataagcggtcatattatcatctaggcatgaccactctttcatgacttgattgacaaccaactgagagtctccacggacgattagtcggcgaatacctagagataatgcaatccttagtccatgaagtagcgcctcatattccgccacgttatgggacgcagaaaaatgtatccacaatacgtagctcaatctttctccagtcggggaaatcaagacgaccccagctccagtgcctgtaagcctctttgacccatcaaaatgcatag

SEQ ID NO: 70995 - DNA, 713 bp, Oryza sativa
cgccgagtggaacgactactataggcgaattcgagctcggtaccctgggaaggggaggccggccgggaaggggaggaggaaggggagagaagggggaggagaggaggaaggggagaagttggagagttagaggatagatatgaggagagggggtgagattcgatctgttaagttgtaactgtggaggagaggataagggatatggattatatactatgtgtttaattttagtccccgctggtacattattgatctttatctacagattgcacgccccttacttttttaaaattgtttgacccatttccttattttacactttcccggtactacttattctttttccccaatttatatcatgactaaccataaacatttttatctaccctgttctaatatcgaatttttattacccatacaactacctcctatactttcggttaaattcgacccgaccctatattgaaatactgccgacccttcataaataacttttccatccatctatacaattaaaatttccatatatttttattacttaatcacacgagcaagctaccttgacagatttaaaaggttattaatactataactgttatggcaatctatttacctgtatgttttaagcttttacctccattaatgtttacacttccaaccttaataaactaatgattatatgactcttttctagtcatttacatcttcctatt

SEQ ID NO: 70996 - DNA, 1487 bp, Oryza sativa
tgccgcgacaacgtgaacgagaacgagaacgatcgaacgaacgagagtgagaacgagaacgatcgaacgaagacaagcgagaacgagggaacgaacgtgaatgagaacaagcgaacgaacgtgaatgagaatgagcgaacgaacgtgaacgagctagggaacgtgaacgagcgaacgaacgaggatgatcgttaacgtgaaatgcaatatatatatatatatgtatatatatatatatatgtatatatatatatatatatatatatgttacttcgcatttatcctaatacatttttttgtatcttgcagaaaagacgtgttgtcggagtcgtccgtcaagcctgagtggaagagctagccctagaacgaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtaccccggccgaagccgccaagaactatgtacgtcacagcggttgggttgtgcgggataacgtgcctgtcagtacggtgtactggcgaagaacaagggcacgcggag

SEQ ID NO: 70997 - DNA, 4032 bp, Oryza sativa
gagcttcaagggagatctgtaccagaagtatatactgaaggggcagacaccgaacttcgacacattcccaaagctaagggatcactgggacagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagtcctggtactatgctcacggtggaacgctcaacccagctgatggctcactggtcttcggctatcagatacaagaggctgcgcgacgactaacagatgcagtggaagcctcctctcagggcacgttccaaccagacagagatagggacgagctgacactcgccctgcagactccagagcatccaggatgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggctgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctgcaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccaccgcaggctccagcatcgactcctcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtcccttagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggtttttgatactggattcatcgaccctcggaaagtaaacgtcgcaatgctcgaccaatatccacaagaaacagaggacaatctcgtccatctcctaaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaagtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctatgagtacacatgctctacatttatatttctccgattcaaatacatacaagtgtatattaattagatctctcgttgtttgtcatttatttgtagtgcgcaaagcaaaagcagggaactaacttatgcggctattacgtgtgcgagtattgccactgccttgcagaccaaatcatcaccacaagagagctcgatgtatgtacaaataaattcaaaatttcattacgtagcgatttcttgtttaattactaatcaattttatacattcatattgtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataatatatatatgtataaatacatatatattatgcatgtatatacatataatataatataatatatatatatacatatatatatgtatgcatatatatgtattgaaacatatatatgcatggtttatatatatatatatatatataaaccatgcagcaacaggggcatgaaaaaaaaaaaggtcagctcgatctttagtcccggttggtgttaccaaccgggactaaagatcgatctttactcccggttatttcacccgggactaaagatagcgatctttagtcccgaattggtactcccggtttagaaaccgggactaaaggggggttacgaaccgggactacaaagggtttctccaccagtgatgcatggtagccgtgtatcctatcttcatgtccattaattatctagaaccataatagcttctttgcatggacagtcgaacacaatgacatatattaagaaaatgaaagcatccggcttctgtgtaactagtagttcctctaccggcgtacgtgctttgtctgtagttcttgaataaatggaaattaaagaagaccacttgtgcttgatagtactactgttggtgtgtaaggggctgggataagcacgatgaaccctaaaaaaaaaaaagagagaaattacagaataaaatgcaaacctcatatcagcacggtaaaaaaaaaggaaaaacatgttaaacactgacgagtatgaacacacgaaaaagaatatgatgtgaataatacctg

SEQ ID NO: 70998 - DNA, 952 bp, Oryza sativa
tgttcacttatattctggaacctgatgtagtacttgttttctacaactttgttaactctatgaaatattcaaaaccaaaggttttatgaagtaattctttttttcggctggaataagaaaggacagataccaatactttaatttgttaactttatataagccgaatggtaatcttttttctgcgcaacttttgccaaagctgaatgagaatctcgtctttgtaaaaggcttttttttgggcttgataaagggtgccaacttaggcagcacaacgtcaatcaaaagaaaaggaaaaagggaaaagagtggaggctgtggagctagcgaagaactggagctgtggagatgcactgatgcactggtcgttctttgttgtctgtgcaaagttgaaaaaactcaccggtaggccctccaagtttgattttaccataataccatttttttcttgcgcgaggaaatatcagtttgcctttgaccaaatgaattagtggatccgaagatgttgacatgaactctctctctctctctctcaagtggttaaccatgcatgcaaccatttttttaaatcttttataatttaactgaaaaatcgttcagtaaccaattgttaaaacaaacaatctagccattcactgaaggtaacatggtaagctattgactgtaaatatttatgtaatgtcgaaaataacttgccatgtgacatagcaaaaatataattttcaaaatacaaaaaaaaaatcacatgcgacccaatcaaatactcctatcagtgataattgaccccgcaagccatctagggtcaattctagtacaattccacgtagatttcctcccaccctaagaaaagttgtcactttgttctttaaaaagaccaactcgcgtgactttcttctttctgcgctgtaaagataatagaatgaaacattccggcttttgctcaagagagctacag

SEQ ID NO: 70999 - DNA, 683 bp, Oryza sativa
aagaagatgtgataagagagttaatttgagtggtaatgaagagaggttaatcatggagtagtagaaaggggttgatcagaatattgggtcagtattttttgtttctattttttgcgtgttgtaatcctagaagggatatgcaacttgttgttagatctgtgtgtttgtttgttatacacgtacgatccgatatggttgattaattatattctggaaggttgcatgcaagaaagttaagtggagaacaataagagattctgtgtgcttgactgcttgttgctgtgtgattcgttaggtttcagttgtgtccaacgtgtaggttctccctggtaacactagtggttaaaaagggtgcccaatttgatgcctccctatggaattggggaacaaaggatggacaattctgcggcatccaaacaacttgatgggaagaatcaatgtgcaggcgaaaatgggtttctttttcaaatagtacaaactacaaaatgtgagccgaatttcacatatatgcgttcgtggaaatgaattcttcctaatgttggaagaaactctaaccaccattaggcccctttgtatatttcattaaatacctatacatcgagactccgcccaacatttttagcggtgtgcatagtaagatgaattggggaacaaggatcgttgacaattcgtggcatattcaa

SEQ ID NO: 71000 - DNA, 23167 bp, Oryza sativa
  unsure (1)..(23167): unsure at all n locations
atggttattattttagctaatgaaattaacttctagccttttcttctaattagagatgcatacatccattacacaaaaaatgttaaaaacgaaagtggcaaaaagaaaaatacatgaaaagttggcctagaaataaaaccaccttctgttgccgaatcataaccacttacgagaacctattgagtacgacatacagacaacaatgagttggtgaagcaatagtcgtagcaacaccctctagaaaggatgcaactcgcatcaccgtcaccaaatccaaccaatcaatgatatatcaaaagggtttcaagttggattgcaagcaaagtttctccatgacaacgctttcgggaagaaaatatttcctaggtcattaccattcctagtttcctacattgaaccggttaaggtcagatgtactcgctttccaggagtacgcattagcataaatccattatcgttagcgcattgattgatctatctggatatctatatcaggtatagttggctgctacaaagtagtccatgcatgcctcactacttttttttttgaggggggcactactatagaaatgcacaaagatgacggcactataggtgccgcaagtgttaaaattggcatctatcgatcttttcccacctccacaggctgaaaatatatttaaccggcacctttatgcaactataggtgtcggttctaaataaaaccgatacagatactatatatgccttttttttaaaaaaaataaactttaatatattatagttatcggttaaaacatatcataggtaccggttttttaaaaaattgacacccataaaaattgagccggatctcccctttttaatgcaaagggagatggagcttatccactcgcccctctctctctagccctacttccctcctcctatcctctccacggcttcctcctcctcatctctccactggccaagagatggtgacaacaggcgaagctgcgtcaggcgcaacgttgactcccacagcagatccagtgtcggcggcatcggtggcgggcgggttggcgccagcgatggatcttgcggcggatccggtggctacggtggctggtggggtggcgtcagctacagatcctacgacggatcaggaggcaacggtgtcagcattgggcagggcaggttcggaggcgactctgacggtgggctgtttgggttacatgaattggggatttttttttggatcaatttgtgctatgtggaattgtgttttgtgatttgtgttatttgtgcagtcttggtagatggatccatgatggtttgtgctgttttggggatgtttttggatctatggtggtgtgggtgtaatgaggagcggctcgatgtatcggcttagactgtattattgcagaactttgaccacgagaaaatggtgttagaaaaataacgtccgcttgatctactattgacatccccatctcttattgttgagaaattctagatctgtgtgaaaaaaaatgttctgtgcttaattgatgaaactatttcatgtagttggcctgttactaatcctttgtattactaaacgttcatcaattttatatcactactacaaaaacgtaaataggtgtcgccaccataggtgccggcacaccaaaaaccggcacctataatgcctttcccgcctatgcacccacccccacgcaccatatattcaaaaactggcacctttatgtctaaatatgtgccggtttttaaataaaaccgacacctaaaacctgtgttagagaaaggtgccggttctaaacctaaaactggcacctttaatcttctccctcccacactagtcgttggcgggccccacacataggtgccggttttaaggcaaaggtgccagttctcaacccaaaaccggcacctttatttcaatagtatttttcatgtccgatggtgggagtgccggtttttgtatgaagtgtcggtttcttttatagaaccggcacctatttacttaaaactgttatccattcactctctcccccttatccgttcactctccctctctctctctctcggcgcggcggcagcggcgcgtccccctcgcagcctgcccccctctcctcctcctcctcctcgtggcgccctccaagtcgtcgtcggctgtggcggcggcggcggccaaggtgcgggaggagggagaggtctcctcctgcgccgacgacgacgatgtgaggagggctcccgacggcgacgacggtgacgaggtgaggagggagaggtctcatccggcagcagcagcagtgaggagggctcgatggcgtccagcggcgaggaggtgtgcagcggtggtgtggtgcggcggcgctaggcagtgctaggcggcgaggaggaggcgagcggcggcggcagatccatcccacggtacccccattctcttatttctaatcgattgaattagtgcaaatagaagcacgtcctcaagaacaacacccattcatcagtaattagggagtactaatcctagttctagggacagttaactacaagtactccattcagcacatgaggcctctcctccattcagcacgtcctcactcgctgcctgcctgcctcctcaatctgtcatagttgcagcggactcctccgcatcccagacgtgtatctactactgaatttgtttttttttgtttttactttccgattgaaatcagttctatgaatgctctgaagttttcaatttcacaacatggtcgatgcacttcattatatctgaaatgagttaggaacttgctatcaaccccttgtttatggctgtaaaatttgcaaaagataatacttttggctggtaagtacaagtatttggtgatgtatatccttgctcattttcttaatctgcaaacgaaccaagtagatttgtttgatgtatatacttgataactttcttaagttacaaaaggagccaaactagctatgtcgttttatggctgtaaatgccatttttggttttgcttccatgatgagcaggtctagtcagtagaatttgtctgtgtatatctctaaccactttagttgtttgtgaatctatctatagtttggtggatgtgaattatctgcttggctgtgaatgccaagttgttcgttaaaatagcattctgaactcagaacaactctgaactagttgtgcactcccttgatttttagtttgtcgtacagaggtttttgttagtgcatgtgatatgtagagctattcctgaactaagatgtttagagattaattgtacataacacaaatctttgataattctgttctgttgcgtttctttggtttagaaactgtggatttcttgctctgtcctgcaaaaggaccacatttattttctccttcaatctggagcatcaccttatcctttccaggatgaccttcatagtatgatagggacgccgagttttgcaatcaacagtactatgcattttactgacaaatactcaaaagtactttacttcatttctaacaatgtactcaattagtgggagtatgtgatttttggcacgctggttttgcgcagagagcgggcgcgtgttcgccgcgggcctcaacgactttgggcagctcgggataggctcctccgtgactcatccgctggtactgcttcttgtgcatcatgcctccatgtgaaattttcatctacattgtgagtcagcctacttttgcacaggaggcaaaagctggctggacatatatcagaattgcaattttcactcctgtaaagtttcttttgtgtgcaaatcattttccagtgcaactgcaggttccaatttttgtaggtgtcatgtagatgattctcatatatgttcttctcaatatgaattttcttgttcctgttcgatgtctgctctaatttttgatgaacaacgatgtctgaatctgaatatttaaactaggcatattttgagttaggatatatatgcaaatgtttaggatttaaagataggaatttttgaacttacgaatttttagacttaccgaattttaacttaggcttgtatgtttttatttgttgagaatgtgaatgtgaatgaatgtcttgtatggatgtggggctgtagggatgaaatggggtttgtagagaattggggttgtatggatgaatttactgcattttttattttttttgtcccaacaaataggtgccggattttaggttagaaccggcacctattaggaccatatagggccggttttaacctaaaaaccggcacctatttgacagccacagggctctttggcttagaaccggcacctccgcatcttattaccagtatcatcagtgcagcctcctttgtgctggttcggaaaaccggcacctattagcgtttctgaaccgacacctattaccctttctgtagtagtgtataaatccagttggattgagaagccaagtccaatcaaaatgaatagctcatcaattaaaatcaaggttgtgatgaaatccttattttgcaacaacggagatcatagtaatgctaaaccagacatggcttttatcttgcaaaagaaaggtaactggattttgtagccctttaggaggccttcaagaagcagcactcatatcatcccaattggaactttggctgctccatcttgaagatggtttttgacgaaatatgctaactgaagttgatggaaacatggtgtacatagatggcagttttggctttcgcattgtgcaattatggtatatagaatagcagagctaggaaatttgtagttttaataccaaaaaacacttgtatacatatcaattctctctcgtgaagtcgggcccaacagattctgctttacggtctggtactgataacttcgtcgtacagattaaacagagaccaaaccaaaggtttgggaaaaatatcgaaagcatcgagtgagaaataaaacgtggtttgtgtcttgcacttgaacgaaccctcctgatgcctctcaaacatatggcacactgcacatattttttttacatatactgatatttggttacaacttctgttcatctcaatatcgctactaaaagaattaggttatgtgatgaggacatcgcaggtacacaggtacatcaacactacgtaaacaagaatgatggtttacgccatatatcacattaagaaaataaagatgacgtaaaccaagctgatagattacatctaaacaagaatgatcaagtataccatggttcaatcacgcgcaatcatgttaggataatacaataagaggtgaactaactatttgctcaacttaacccaaatattttaagttcggttcgaattggctgtggcagtgggcaattgcttacgttttatacccaaagacatcatcactacaccatgaaagatgggttacatcgagtatgacaagggtaaggcagaggcagacttagcccatacactacttgcggtgtctacgccaacaaggagacaatttacgctgcaggaggttaatttctatggcttgggcgatcctgccagtcaagagatgtggtgcatggcatagatcattgaaaatattgctaagtctagttttgaatgtaataatctccttctcaacatcattttctaatgagtagtttgagcctcttttactgaaggttgtactggagctgaagggctatgcacgaaccctagaaaactctttgcattctcatttgttttagccttggtcactggaacggattttttttattttttaaactttttattttttttattttaaaaatatatcaagccaaaacttatttcttgaatctaaaccttttgaccatgctagaccgcctagcatgacaatactgacacgctccacgcaatgggtgtgtcgagggaaaaccctcaatagcagggagtcgtgagacccccctttcgtgagttcggccgggggcggaggctcgtctctcaaaattcgcttgttcgtccctaagactaccagcgagcttacacatagtcggattatacaggttcaggccgcaatagagcgtaacaccctactcctgtgcttgggattatggatgaagttacaagggtttcttcacttcagagagcgcacttgcttcctctcttctgaagttcaggttttctgggaatcgaccccttgctctgtgggtagggtcctccatttatagctttaagggcataccacacgtgccgactctacctactctccacggggggaggggggaccccacttcacttctttgggcttcaaaacgtgccttctcccgaaagctaagcaataaccgattcttgagcggaacccggcgccgtcccccgtctgacacgggggacggcccggtcattccctcataaatgatcgatgacatgcaacagcccttcctcgagtgatgccctgatgtgacgggtcacacctacccccacttcgccggggacaagggcggcgtgatgatatgactgccctatccatcagatgtgatgaaaacgggccggtcacagaccggtcacatccgacggacaggggttagctaggcgcgccgcacgtctgccctgactgcattaaatgcagcgagggacagttggggcgctgcgcatttatggctgttcagcttgccgggcgagggcctcggggcgaaggcgcggtagagcccgaggcggtgacgtcataccccgaggctcccccctcccgctgcttctacgactcgcgtggcgcgtgagtggggccaaccggccaagccacgtggccggaggaaaagtaattctcctctacttcacatacccccgggcccatatctccgacagtagcccccggcgccatatcaggtattgatttcctaggatcgtcttgacatggcgcctcacgactcgtcaaactggggttgtgggcccgacagggaatctaaaaggatatcatcgcgtggctaggttggcgcacttatcacggcagtggtttgaccgcctttgactgcgctcatgatgaagatgcttggggcgcgataaccgggggggtcacttagaccgcgcctcgattctctcgcccgctacacttgcgacggaagcggtgacggtttgcccaacttgcgcttatggccgttgcacactccacctcgagtgtgccactgacaggcgcacaaaaggtggaagcggacacaacgggcgacgcaatgattgggcgcgggatgcggagagacaaacgcgggcgcgaagatcgtgaaggcagttatgggggcgcgaaacgaggaggcgaacgcggatgaggcgaggataaaagggggcggagaaggagactttgccttcttcctttcgccaatcgctcactcatcctttcgcttctcgagccctaacactctcgcctcctcacactatctcaaactcctcattctccaccatctctccgccggttgccatggcccaagacgccggggacgcagtgctcccttcctcccgcatcacggcagacaggcaccttagccttcctcgcaagatcatgccggaaggtgtcgtcgtgcgggcgggagagtcgcggccacggccgcgatatccggagcggttcgtacacctcttatccttcgccatggcgggcttgatcccgccgctctccagattcttccatgaagttctggatttctacgagattcacgccttgcatctcgcacctaatgccgtgatgacgctggccatcttcgcgcatttgtgcgagatgttcattggggtgcgaccgacgatgcggcttttccaggccttcttcatcccgcagctgctgcaaggcgtagtggtgggggaatgctacttccagccccgaccgggcacagcgggccagtacatcgagagccacctccacaagaaatgggaggattggaagaaggactagttctacaccgctttgccggaccatccgtgacttcaagttcccgctggccctcctgaaaggtctgccgcatggctggcgacgtgggagctgggcgaggaatatgacgcggtgtgggatcgcctcaagggcctgcggagcctgggcctcactggggcgatggtctttggcgattacttccgccgctgcatcgcacctcttcaggaacgatcccgtggagcgtgggaatacaccggtcccaatgaccccatgcggactcatgtgggcgagcgctgggactggggtgaggaagacgcgaagagggtgattcggcgggtgctgggcctggactctgccgagccaacactaatccccgacgggattcttcccctctgctgcgatcgcgaccgggagagcaagggcccgggagcaactccgggaggcggccgacatgattgtttcgagcttcgaggggtcggccccccggttcacctccggacatacctcggatgaggagagcggaagcggggacgatgacggcggcgacgactgggacgacattgttagcggcgccggtcatgggggcccgggcactccgtgatcgctcacgcttcttatttccttttgcgtgtgcctgtaacaaacacttcttgtatttaggccatcgtgccatcctgtcttgttctgcaattgaaaactctttaattcctttcactttttcgccttttctatcgatgcctgttacatagtgaaaagaaaaaaccaaggcagaaagggataattagacagcctgcgattgatatatcgtttgaccccgtccccccccctcgggcttgttccatcaagaaggtaaacccgcgttcggtccacgaaacctaagtaccgataagcaagaccattgccccgagggagccgcccagcgggactggccggaccgaggctgcgacgaccgggggtcggggacgaccatgtgtaggcccttccaatctcccggggttcggcacagcccggggcacggcccgcgttcgtgctccctttcggtggttctccggtcactttatagcatttaggttttagaacaaacgcggattatttcttgagttgggacaagccagactaaaaggggaaaaaagggtctttgcgaagaagtagaaagaaggttattgcttttaaaaggaaaacaggatacatagtggtagcccccggccagtcccatacataccgagggattgtgtgggtgctggcttgagctccaggaaaacaaaaaatctcgatttcatggatagaaacgacggaggtgctcgatattccaggggttgggcagctctgtgccgtcctccgtggttaaccgaacggaacctggtcagggcacgccgatcactttgtatggtccttcccacattggcgagagcttgctcagccctaggcgcgactgaacgcggcgtaggacgaggacgctaacttgtagtgatggggcccggacatggcgctgatggtagcgtcgcaggctttgttggtagcgggcggcgtgcaaggccgctcgccttctccgttcttcaagataatcgagatcgtcgcggcgaaggtcatcttggttggcctcgttgtacagagcgacacgaggcgaacccagggaaagctcggagggtaggaccgcttcggcgccgtacaccaggaaaaatggtgtttcccctgtggcacggcttggagtggttcgatttgcccacagcacggcgggcaactcctcaaaccatgaatccccgtgtttcttgaggacgttgtacgtcttggtcttgagtcctttgaggatttcggcgttggctcgctcgacttggccattgctcttggggtgggcgggtgaggcaaagcacaatttgatggccatgtcgtcacagtaatcgccaaacagctcactggtgaactgggtgccgttgtttgtaatgatacggttgggcactccgaatcgagacgtgatgcccctgatgaacttaagagcagaatgcttgtcgattttgacgactgggtaggcttcgggccacttagtgaatttgttgatggcgacgtacaagtgctgatacccgcctcgagctgcctttaacggtccaaggatatctagcccccagactgcgaaaggccaagataatggaatgacctgtaaggcctgggctggctggtgggtctgcttggcatggaacaggcatgccttgcaccgctggaccaattcttgggcgtcttgtaatgcagtcggccaataaaaaccttgccggaaggcttttccgaccaaagttcgtgaggccgagtgggctccgcactcaccctgatgggcgtcggctatgagctcaatgccctgctctcgaggaatgcacttcaggagtatctcgttggcgacacgccggtagagggccccctctacgaggacgtaccgcttggagatacgcgcgagcttttcagctttcgcgcagtcctcgggaagagtattgccatcgagatacgcccggatgtcggtcatccacacgacctgacgaggggggtcagggttgaccccctcgggccccgaggggcgcgggtcgccagaggttgggtcggagggcgcatcgttggggtccctcaaagggctgggtcgcgccgatggctgcgcgagcctttcttcaaaagtccctggggggagtggggctcgtgccgacgcaacacgcgacaactcgtcagcaactgtgttgtcgcgtcggggcacgtgccggagctctagtccgtcgaagtggcgttccatgcgccgtacctcccggacgtatgcttccatttgcgggtcggtgcactgatattctttagatacttgatttacgaccagctgggagtcgcctaagaccagaccaggagaaggcggatgcccattctggtcgccgccctcaatcctgcgaggagcccttcatgttctgccatgttgttcgtggctcggaagtcgagacgcacgacgtatttgaggacatccccgtttggcgaggttagcgtgactccgacacctgcaccttgaaggttgagggaaccgtcgaaatgcatcatccagtgcccgccacgaatatcggcgtttggatcctcttcttctccgggggagaagggggcattggatggaatcgattcgtccaccggggtccattccgcgatgaagtcagcaaggatttgactcttgattgcatgccgaggctcgaagtgcagatcgaactcagctagctcgatagcccatttcaccacccgtccagtaccctctctgttatgcaaaatttggccaagagggtacgatgtcactacggaaacccgatgcgcttgaaagtaatgccgcagcttcctcgaggccatcaagacggcataaagcattttctgggcctgcggataccgggttttcgcatctcaaagtgcctcgctgacgaagtagacgggccgctgcacctttcggcggggccggttcgtgctgttaggggctggtgactcggggcgcacctgttcggaggtcccgaggggatcccggactgcctcgggatcatcgagcctagggccacctgtcaaagtctgcactcctcccttgggggcctcggggccctcccggaggcaggaagctttggtcgctagactctcgggggacgaggggccatcgcaagtcggagggccctcccgttcgccttcctcatgctcaaccactagggcggcactcaccacatggggggtcgctgccaagtagagtagcaagggttcctccggccccggggctaccaagatgggaggggaagtgaggtaagctttcagctgattgagagcttgctcagtttcctccgtccatacaaacggcccggagcgcttgagtagtttgaacaggggcagcgccctctcacccagtctcgatataaaccgactcagggcggccatgcatccagtgacgcagtgcacatccctaagcttgctggggggggcgcatcctctctatcgcacgtattttctcaggatttgcttctatgcctcgggaagagactagaaaaccgagaagtttgcccgccggcacaccgaacacacacttatcggggttcagctttacgcgcgtggacctaagactatcaaaagtttcagccaggtcctgtagcaacgtgtcctggtggcgcgtctttactaccaggtcatcaacatacgcctctacattgcgccctatctgattacttaaagtaatacgagtcatgcgctgaaaagtagggcatgcattcttcaacccaaaaggcatggttgtataacaaaaagtgcccacaggagtaataaaagcaattttttcctcatcttccctagccatacaaatctgatggtacccagaatatgcatctagaaaacacaaaagttcgcaccccgcagcggtgtcgactatttggtctatgcgtggcagagggaagggatctttgggccatgccttgttgaggtcggtgtagtcgatgcacatccatagcttgccattggccttcgggacgaccaccgggttcgccagccattccgggtagatcacctcacgaatgaagtcagcctccaggagccgcgccacctcctccctgatgaaggcctgccgctccggggcttgacgccgtaccttctgccggacaggtcgcacatccggccgcacggcaaggaggtgctcgatcacctccctggggaccccgtgcatatctgacggtttccacgcgaaaacgtcagaatttgcccgcaggaaggagacgagcgtgccttcctatttggcgtgcaaagtcccgccaatcttggcggtcttggacgggtcgtcaccaagggggatttccttgacgggcacctcgtcaaccgaggtgaggtgcttcttggaagtgtgagacgcagatgcctcatgggcctgtggttccgtggccaccgccaggttgtctgcacgctgctctgcgtaggcgagggcaaccttgacatcaccaaagatggtgatgggaccagcaggacctggcattttcatctggaggtaggcgtaatgggtggcggccatgaactccaccaacgcaggtctgcccagaaccgcgttgtagggcagattgagatccgccacatcgaaatcgatccgctcggtgcggaagttggcggagtcaccgaaagtcaccggaagctctatgtggccaagcggccacgtgtgccccggagtaacgccaatgatcgggagcgatggctggagcttcatccccggggctttgagcgcgtcaaaggcagccggggagatgatgctcagactggccccgccatccaccagcacacttttcatcttgacgttgtggatggttgggtagaccaccagggccaacttcccccccgagcgagcaccgtgggatggtcattctggtcgaatgtgagcttcacctccgaccagcgcgccttccggactgcctcatgcgtggggacagcggccagaagctctcgcctcatggccttgaagcttcggcgagaggtgtgagcgcaagctcccccgtcaagcgtggcgacggtcccttgaggtatctggaaatccaaatcctcactatctccgccatcatcggcagggcccttgttcttggcctcctctcgatgttcaccggttaaggtcgtgggggctttgccctcccgtcgaccctgccgcttctcctcatcaggctttcagaatcgctcggccaaattcttgaccaagcggcagtcggcgagactgtggcggtaggtgttgtgcaccgagcaccacttgtccgccgaccggccatcaccggagggaacagtagggctcggcttgtcgccggcagcctttcctttgcgtggggcccgtgtgggcccgtccgctgcaaggacatgaccctcgtcatcggagcggactgatttccttttgcctctcctatctcgccgcttagagcggggggcagactcgggggtagccgcggccgccgcaccggtgccaggagagttccaggcccacgcctcctccttccaggccaccttgtccgcctgctcgaagagctcagcagtggtcttgggctccttggaggcgatcttctctagcatgcaattgtgtcgcacgccgttccggaacgcatatacaaccgcgtgggctggaatgcacggaatggtgttacggacctgacagaagcgctgtatgtacgaacggagggactcatcatccttccgccgtacagcgtgtaggtccgcctcttcccccgggcggggatatgtgccctggaagttcgtgatgaactgctggcacaggtcctcccaggagtgaatggagtcggggggcgggtcattaaccagccacgcgcctcacccttgagggccatgggaaagtaattcgccatgacccggtcgtcaccccctgcagccacgataaccgtggtatagatctggaggaacttggagggattgatgctaccatcatacttctccgtaaggttagggcgaaacttcgggggccatcggacattccggagactcgccacgaaggccctacaacctgtccccccaggggtgagtgtgggaggagggccgcctcgtgaggaagaatgtggcgctccagatgaggaggcaccttcccccatacgggcagctcggcgctcatcccagcgttgctcgatgttgattcgagcgtcctgcgtaccgtagaggctgtcatgacgcctccggcttccagaggcccccgacgatgttgggaccgtagaccgcctcaagatcgtggccgattgacgagcccttctcctcgctgacgaggagagggtgaccaaggtatgtgatgtaccggcggcagcggatcgaccacccgtggccaactaccgttgggcagcagtgaccaagttggccaagtcgtccagccagcgctgaacaggagtctccggctccgggtttactgggggatgccgtagaagtgcgcctgctgcttgaagcgcgccttggggcgaaccgccgtctccataatcgagacggcggcgtaccccgacgcgtcgcagcctccctccgccacagggaggagagagtcccgaaccacctgaacgagcggaattatccctccgcgaaggttcgcggcggggaggagttggagatccatggcgacggtgatgaggacctcggctctcgccggaatcctcactccctgatggggtggaggtgaacgccaccgcctcctcctccacttgtaggacctcgaccatggtcggcagagtcctgaaaaaacttgggacaaaagaaagcgaattcctcccgggacgcgcaaccgccccctacctggcgcgccagctgtcgagggaaaaccctcaatagcagggagtcgtgagacccccctttcgtgagttcggccgggggcggaggctcgtctctcaaaattcgcttgttcgtccctaagactaccagcgagcttacacgcagttggattatacaggttcaggccgcaacaagcataacaccctactcctgtgcttgggattatggatgaagttacaagggtttcttcacttcagagagcgcacttgcttcctctcttctgaagttcaggttttctgggaatcgaccccttgctctgtgggcagggtcctccttttatagctttaaggggataccacacgtgccgactctacatactctccacggggggagggtaggggaccccacttcacttctttgggctttataacgtgccttctcccagaagctaagcaataaccgattcttgagcgaaacccggcgccgtcccccgcatgacacgggggacgacccggtcattccctcataaatgatcgatgacatgcaaccgcccttcctcgagtgacacccagatgtgacgggtcacactaacccccactctgccggggacaagggcgacgtgatgatatgactgccctatccatcggatgtgatggaaacgggccggtcacagaccggtcacatccgacagacaggggttagctaggcgcgccgcacgtctgccctgactgcattaaatgcagcgagggacagttggggcgctgcgcatttatggctgttcagcctgcgctcccctctgccgcgtggcggccgggcgagggcctcggggcgaaggcgcggtagagcccgagggggtgacgtcataccccgaggcccccccctccccccgttgcttctacgactcgcgtggcgcgtgagtggggccaaccggccaagccacgtggccggaggaaaagtaattctcctctacttcacataccctcgggcccatatctctgacagggtgtggcatccttcagcgatggtagcgagggtgatgtggccaaatatcgttgtcacgccatctaaaccggtgtgaccaactaacgttgccacgccactcagaccaacgtgacagtgttgatttgttacgccagtggtttagattctaaaaataattttgggaagggtctattttttaaattataataaaaaaggctcaaaaaataaacaaaaattactaggttaacgtgattgagtcactgaagctaaatcacgttaactacaatttcaatgcctaacgtttattatgaacaaaaattataagctgatggtactttaatctatctatctatctattatctatcttctatctattatatactaaaagtccattaaactccctacaaacgctcttaagccgccacgtgtacccctacaaacgctcctaagtcgccacatggcactatataatcttaccgttgattttcacttaaattggtggacccgttattttacaccattagattagatctattatttaaaaaataattttctcatgtttataacatacaagtgctacatgatgcaaacgctacttcttgtctttccgtatgtacaaacgcacgtgactgaaaacaaaactataaaaccttcctattcttcgctagaagaaaaaaatgcacatgtatagaaaaagacagaaaaagacatacatccataaaaatcaatggtctttaaaatatgatttctacaatataaaaataaaatatataacttcacaaatataaataaatttagttaaatctatctattgttatatactaaaagtccattaaacttcctacaaacgctactaaaccgccacgtggcgttttaatagacgggaaacatctagccctcaattttcatttaaactagtggatccattattttgcaccattagattagattaaaacctcccttcctctcctctccttgcacgttttgtggacgaaattgcagaaaaccgcgcacactttaacaattggcacttaagtacatatattttggtagtgtagtttgacaaaaccacactatcaatgaatggattcacctgtgagatgacgtggttgttccacctaagatgaggacgtggcatcctgttaacttggactataaaagcatatgtttgattatttatcttactaataaaaatacgtaattaaaatacattgcggcaaatgacattggcatgtattaattaactccataacaatttgtcaaaaaaaaccgcatcaaactatatactttatggtatcaaatattacttaacaaatatagaacggtaatttgaactatgtaaaaatgcaaaccatataatttagttgtgttttttaagtagatccaatttaaattttaatttgtgtgaaattaacattctcaaaccattttggaatttttcgaaactgtttggtaggtatttcaatagtgtcgacgggtgatacccgcagaccggatatagagggtattggggtacgttggtacaaggatctacgtagtgtgacatcgagcaatcaaaagacaagaattatactggttcaggccccttgattggtaatagccctaatccagctgatatgggattatatggtggaaaacacaggttacaaagggaacgatggaacttgtcggatccggcgagattgtggttgagttgattcgactagctctcgaagacttggctcctcgtagactccggcttcgtaggctgtgtgggttgtgttggctctgagattcgatgtcctatgccctccccgggggtcccttttatatcgcagatctggaggtctccaagtaggactcggagatataagacccaatacgatacgtcgacgacccagttctgtccgagaaggattcttcccatctgtagatttcgtgaaaggtttccttagaatatgtaggaaatatccgcatgcgcgtgggtatgccacatcgatatgtaacgtatatcgaagggtaaagggtatgccgaacccgtaaccctgacaaatagtaataaatcctacattatacatagatgtaaagaaaattcaccaataatattttcaacaggtgaagtatatatcattggtttttttatattttctaataattatttaaatgatatgaaaatagtcagaatgtaacaaaaaataacatatttatttaagaatttcaaatatagttaataatggtccaacgacataagtcgataaaaaataactatttattttaaaagattataataaattagggttcctgactaatatatgatgaaaacatgagagacagtacattgggagaagggatgaatgaggcggagggggtggatgttgggcgctggtatacgtatgtacatacatacaatgcccctcgggctctatattggcacaatcgatgtttactgtatgttttcactccaatacatatccaaaatgacatatttggttaaggttggcttttgactctagctaccacaacaattataattttatatctttatttgtgattgatcaaaaaaggcagttctgccagttagaggaaacaatccaatccaagagtgccaaacgatcttctactacgtaagtgctctagaatatattctatggtactatttaaatgactttattagacagtatttaatgatcttttagtatatgggtacatagatatacttgccggtagctntgtacttttattccataccttccgggtataaaataaagtatgttttttataaatatttatagttttatttataaataaataaataaataaatcaagatcacattaactatattttactacatagaagttaacatggcaactaaataacaatggaaaattaattgtacatatgtattatgttatactaaatcattcattgcacgtaacaaaaatcaattaaacacgctctatagagctcataaatcaccgtataatatgttgtaaaattgtaataaatagtaattaaattgacgtatctattatttttaactattagatctattttttaaaaaaatcttaagttgccatgtgtcaccttctataaaaaaacaggaaaaaccatagaaattcttagaaaaaataaaacaccccgtcatcggctttcacttaaatcatttagaaaaatagaaaaataaaatcttcaccacctcctcaccctcccatgtacacaatactgtcgtccactccctattgttttatctcttaaattaaaagagaaacaataaataatgtttgatattttttagaaactaagtacaaacgcaaaaaactcacagcacgcacacactcaccccctattaatgcatacatgcatatacccctataagtacttctgagagattaggctgacctattttgacattgatgaagtcgccacacacctcgctgtcgactggtacgtcgcctaccattgaaagaattttttaagtctaagacttgtacccgagtgggcaagttccaccacacacatgcatatacccctatgagtacttctgagagattagactgacgtattttgacattgacgaagtctccacacacctcattgtcgacgggtacgtcacctaccattgaaagaatttgtcaagtctaggacttgcacccgagtgggcaagttccaccacaaagaacctaaccagttgagctacatttacttcgtattaatgttggatattaaaacaaccataatatttaagctacatttctggaatactcttatgaattttaaaccagtggaactattatttctaaccgttatatctatcttatataataaaaaaaagcgtgtattcatggtacatcacatttcaaaagtatttttgcgcaattatattttgtcgttattgtatgcacgttagcttgtgtggaagctctgacccactctacatgaaatgttcatagatggactggctgtcaaactacatctatcatattaggctacataaacctatacatttagtggaggttcatgttccacccaattaatcctcgaataaaccatgataatatatatgcaattaaaaaaatatcttacttttactttacacttactttttgttgacatgttttctaaagaaaataagtctaccttcttttcaaatgatgaaaaagattataaataattgtttatagatagtattacttaaatatgatataatataaagctaataggttaaaaaattataaaagcaattaatgccgactaaagcaatttatggagaaatcgtgatagatgttcttcggttaatatttcgcttttacaggtctcaaacttagtgtacgacgcatgcccgcgtattcacacgggctaccttcctagttactcctaatgttaataatcagcaattgcaatttctgacaatggcaacacactctgatcaattcgcagcttcaagtcacgattaattcagggaactgctgttgcaaatgttctaccttttcttaaatattatgcagattttaccatcaaaactcctgccacattgttcagaaattgcaggttatctttgtacttctctcacgaaaaaagcaccgtagcgcactacaattttcattcgtccgatcctctgcttgtatgcgtgccagcatactgtaacaaacccaatcggtcttatgacgctcggatatgagaaattcccaattcgtagtaagttggttctcaatgcctcctaagcctaccttgtatatatagagtgggtaatgtgttaaccacatctatgttctggtagactggcacttgccatatgcttcgcaatatcatggtgaacttcttctctggcaatataaaggcaatatatatgtgaatcgtgcaatagttcaccacagaatcataaataactgcagttcagatagcacatgcatctgtcttgcactcttgatacaaacacattgtatcttttcgcttgcctattgacgtcctccttgtaggacatatccacatgctctgatataaccattgattgttcagtacttcagtacaagtgaatggaacaggtgcattagctatatatggtcttaataaagagcctcggtactctctagtactatatatatatagtagaaagcaatttaaattgttgatctcatttcaacaaagagtttagacctatttgtactaactaccccagttagcagtagtagaaacgtaaagaagcattattatcaattaaataggtgtggatgggtataattatcatttagctatgattaaacctgtttttttctttttttttggcattttcgatggaatttgatcgatgctagcgcaatggatgaccacagatcgatctagctaggaaaaaataaatgataaagttacccctaatcactttattagtaaattacgtatgtacccttaataactaatggttcagattatttttacgggtagtataatactatcagtagagaataccggagcatcgcttcttaattaatagaggattaaaaataatatctaaatgggactagaatatttggggctgtaaagaatgcatgaaacatgagtttgggctagatcagtttttgtcgacaccaaacgaagtaatttggtcggtgccatgaactttgctcaatctttatttttctccactgtgcaggcaatctttttttttctcgaatatgcaggagatatgtgtatcgttatgttaagaataagaaagagagggtacaaccctaagtacgaaaccaaacacgcacacactaagtatctagtaacctatgctgcaaacccagccacaacagtgaaccaaaccatgatgtgagactaaccagagtaataaaaaggatagcccccgaaccccagccaatctattcatgatattatatgttcaattaaggtattgctcatgtgaagtactaattccaccaactcattataaaaaataattcattatcttgagcttgtgaaaaacaaagggaaagttctatagatgagattcgtaggattgaatcattatcatgtggcgcgaataacaatgtcgccaaagttgccaatgatttaataaagcatacgtggcgaatatatatcgagtgagcggtaaaagacgagtgaatgacaaatctattggcccacatttacatatatcaatatatatatatatatatattttaagtaaatttcgtaaaactacgtatactttgcatggtctatcacaaaactatatatctaaaaacttgtttcacaaaactacagattcagtgccttcgtttatcacaaaactacatggactttgtacaatatttcacaaaattacatatttaagaatttgtttcacaaaactatagatttaatatcttcatttatcccaaaactacaagtttagtgtcttcattatcacaaaactacaggttttagcattgacctgtagtttcgtgataatagaggcactaaatccgtagtcttgtgataaatgaagacactaaatgtgtagttctatgataaacgaatacactaaatttatagttttgtgaaacaagttcttaaatatttagttttgtgatagattaaacaaagtacctatagttttgtcataaacggagacactaaatctgtagttttgtgaacaagctattaatataaaatcaaaggtgtttttgattattattctgtgatgaacaattggcattggagattattggttttgttatttggaatttattcatgaagtggttttggagatgattggatttacaggtgaattacaggtgttgttattttatgtgaccggtcagaccgggcgtgtgctgacggtcagaccggcgcagcccgcggtctgaccggccgactctgtgtcggtttcagtttcgggttgtttgtttggatatccgtgattgtttcatgattatggattctagatggatactatacgtatgtaatactgttgtttgctactaataagtcaagttggagatagcttggtctcggaatatggttctttgtttatttcatgtgtaggtgactcgatgcctcgggagtgtatttgcggtgatggaccgggagtcggcttggggataaggcgacgtccgtgatggtcagagatcatgcaggatacttaggctagagttgatgcacgtggttggtgaaggggctgcaggaat

SEQ ID NO: 71001 - DNA, 696 bp, Oryza sativa
tgttaaattgctccggatttacactaaaataagcaatcattgctcttctacaccgcttcttttactgcgtggatgaaatcacaaaaggtggggcattcttcggccaaccgcgaggactggacgacttgacccatgtccaaacgcgcttgttccgagtataccgccctataaaaacacacctcgccagatccgatgcatgtgtctgctagcctactctccacatgcggtgattaacccctcacataaactccctactagaagacaagacttcattaatgagtcatgtgcgacgatatatcggaagctgctgccggcctgctgtaaatcgtatcaggcagcctcataatccctaccgctattgcagcgactgcacaacattagggacatcagcaacttcggcgaggcttgagttcacattgggtaggcccggtttttgcaaaaaataccaaaacgtactatattcctatgctacgaacttataaaccttagcttcaggtgggagggcaaagacataaaaggactgtacactttggtgggcaaaagaacggtaacaagtcttggccttgacggggttcttgcatgcttaggtgcccaaaatttggccagctggcaaaattttcgcatgaccttttttttaggtaccgaacattgggaggcaaccaaactgaacccacctttttgaccattttccgaaat

SEQ ID NO: 71002 - DNA, 11336 bp, Oryza sativa
cttcgatttgtgtttcaccgggtttcggtggtctaactggcgacacactagcggtcagactggcggcatcacagcggtcagaccggcgggtgaccttcggtcagacaagcgtcggcaacaagcaacaggagctgacctcggcggtcagaccggagatctaatcttggtcagaccgacggcaacctggcggtcagaccggcaggacaacttcggtcagaccgcgatccgtcgaattcgagggtaacttttatttccgctaaaagtttccggtttttgggtataccaactattcatccctctctggttggcttagttgttgtgtttcgatcctacaattaaatctgtagttttatgataacttgtgcaaaatacttgtagttttatgaaatttactcatattttttcaataatggaattgggttaagtattgcaatctgtaaggaattacaaaacgtccgcgacagagtcaagttcaaaattcaaatcattagataaacacaaaaagtttccctgtaaactaaattcaacgccctctaaagaactctattactgaagtgatccaatgttactgttttgctcgaaaatacagggggggatccgtgaatagggagctatcattgttcatatggtaaacaaacagcagtgtctgcatgagtgactatgtggcatgatctgcagataggttattctgagtttatgcacagcttgtacacaagctgaacaattgtgaagatcatagcgtgttaggtttaatcccacattaataattgatgatggagaagtacgacttaataggtgagggcagtcctcacccattagactgtattttgggttgtgtagtctcaggaactaaagtcgtggctctagttgggtttgtggtggagcaggtccaatgtgacctaggtgactcacggttgatgagccgggctgcgcattgtaatatagtgttgcatttcctgtcacctcccaaaccttaccatgtctatgaaactttctagacacgtacaccctaattgttttctttactcatgaccattatccaaaaaaatgaagaccttgcagtctattgaaacgctcgctcgaaccttaagattaattcagggagtcaagaatgctcatttgcacgcatgatttaaagaagagtctgcttggtggccttcctgcaacaattccttgggttattatatgtgttgtcatcatagatgtagacgtgtggttattttttaagttcatgaaattcctctgtttttatgggtatcttcttgtacttcatgaaccctgagtattatctatatgtaaaaattgtcctagtacaaattcactaaataaggttgtgtttagatccagaggtgaaaagttttggcgtgtcacattggatatatggacacacatttgaagtattaaacgtatactaataacaaaacaaattacagattccgtctgtaagctgcgagataaatttattaagcctgattaatccgtcattagcaaatatttactgtagcactacagtgtcagattatggagcaattaggcttaaaagatttatctcgtaatttacacgcaatctgtgtaatagttttctttctatatttaatactccatatatgtgtccaaacatttgttgtgatatggtgaaaaattttgacaggggatctaaacagaccctaagtaatattgtagcttcaaattaatgacaatggcaatgcactttcaacgttcacgtaatcaaattgatgcggtgcgccccaattgattattggccactcttaccatagaaaacttatttttcagcgtacttgcgatagcttgtgcagttttgatggatgggcagaagttttgatggatgggcagagggacaatttgctcacctctttttcatcgaaaaaacatgtagtaactggtatgtctggataatagttgatatccaaaataccaacagggatggactccccccatctcaaaatgtaactataatgtttgatttagcattgctgactatgattacaatgatgcccgagatcactattagtactttttggaaactttagcaggtgtagcattcggccgcttgcaaaactgtgttttgatcacctataaaaactgtttttctagtagtgtgtgatacaaattggtgagcacgtatcaaacggtgctcttttttcaatttttttcccaccagcatttcttcgaattcatttttttaatatctagtttacttatttatgtccttaagtaaataattatcatagcattcaaaataatccgtaatccattaatatctatcctcacttcaacaaggacactactgacagacatcatcaggaaaataggataatagccaatagttattttttcttcctataggctcacggccaatgtttgttgcctgatcaagcgtttgggctgtttgcgtgctgctgtcacgatgctgccgctggttcaagatagcctgcacaacgctgtcacaggaggaatgctgttgcagcctgaaaaatcacccgccaaggcttgattacggggattgatattgtgtcgaggtagatgtatggctacggttagtgagtcaatgagacgcacgactaacattctcccgatacatcccagtcctactgcagacggtttgcgaaagggcaatcgcaatgagaaagcgtgcatccttgtcggctcagtcgaacatttttatgctccctccgtttcaaaatatttgaccgttcgtcttattaaaaaaaattgaagtaattattaattcttttcatatcatttgattcattgttaaatatatttttatgtaggcatataattttacatatttcacaaaagtttttgaataagacgaacgtcaaacatgtgctaaaaagtcaatggtgtcaaatatttcgaaacggagggagtatataggaagttgtcaagttgttgaccacctttccagactgcactaattaatgtcaagttcattactggatgactattttcagtggaaaattcctttaacctttcgagcgggtctctagtagtttggggttcaatcgtgtattacatatcatctaaattgtgaggaaaacaaattaaaaattaaaataaattaataaaatatattaatttatgatatatcactctctaaacatgcaagttcaaaacttcacgcgtttcgaattatcaaaacatatgtatatattaatatgcttaatcattcatacgtatgtttggagggtttgtatcgtataaatatcatggtgctattctttggttatcattctaagtgtttaagttggccccctcatctctaaatcttccctctgccattgctggtccagtagttggattttactaaggacagtaggtatcaactagacatctatatcaactaggtacataaggcttccgcatatttttttcgttcgtctttttttcctgtccttttctccgtcctttttttcgccctttttcctcttttttttccatccaccttttttcttgccagttcttccttttttcatccactttttttcgctatttcgcatgtcttttttcatcgttttctcggtttttttcatcttttcttcgtcgctattttttacatcacattttttggcatgcggtaagaattcggttttttccgtcatcgtgatttaatctccaaccgccactcaggtcaaatcctagcgccaccgccacattgatctgcctccccttgcgttttctcctccaattagttacgaaaattcattctccactactctctcattattttccccttgatttcctcttacaattcggctttacttcaccggatttaatctctatttaacaggcgccctttttatctcaagttttgccaattgctccgattttaatatgaaaggaaagagaagatcaagtgaatcaaagaccctcaatcaattatagtgatgggatgatcaagaaagattcgactagattttgatgggaggatcggctcctgcatcgtacgggcacttccgtaggttgaagacgacagttagctgtgcgagctgggctacagctctacctgtgagctgagctgatgataacagactaggctaggctgaaaaggaagaaagtaatgggtttttagtgcaaaccaagtataatgtatagcaattaaaaacggttttatgcgttgcatcgcagaggcattttttatagtttaattacaatatctgattgtccaatattatatcgacagtaaaacactttaacgatttctaaagttcatgccaattttagaataatcagtggttgcgtgcaaatatagtgtcctttcagatgaaaatttgtatgttacagcctacaggaaatattttgcacatgcaaattaaacaatctaaattgttagtcttcaggtgcacccaacgataaaacacggtgacaattgagccgctaattgagcatatgatatatatcctaacgaaaatcgaccagcgaattgcggagttcttattattattacatttatcatacacagtgatgtccgtttgggactagggaatggctataggtacaataagactttgaacatgagaattctcctttttcctgaggaatacaatattgtgtcatatgcaagaaaagccaaccaccaacaatatgaatatgtgggataaagttcaaactaactagatcaaaactaataattaagatgtaactaggaaggtagcccgcgcatatgcgcgggcatgtgcgtaaattttttttacgaatgtccatgtgtggatggttttttatcaaaaatattctttcactttatcataaactaaaattaaactaattcgacgtgctttgaacgttggttacttgaaacatataaattgaactaaaattactttaaactgtgttgtttctaatacatgagaaaattttgtgtcgaaacaatagatgtgttccctatgaatgtccaattatttttgttagattctgtttgaaattttaaatatattcattttattagtcttgctaaaatgtttgaatatttctatttagaatgggtaataaacccaacaaaaacaaattttatactagataaatttcattttattttcatttctttttatctccatttttttggataaatccactttatgaagcatcttttgaaatgctttgatctctgtaagtcagaatgaaaatatatgtgggttgatcctacaacctgccatagggtaaaggcatcaattctaaattatctcgctccaattaagtaagaaaaaataaaatagatgtcatagtattttcttagcaaattaccactaaactggagtatcatgtaataattgcatatttctagattgttctattctatatgtcacaaattcacgatgtactataggaagttttacccaaaaaaatagatatggtcttttaattcctatatgtaattggcttatgtatagctgaggccacatcatggttgtttcattcttaagattccttggtgcaaccaatgtgcccagtacaatcggtttgttgttcaactggccacgtgacttcatagatcatatatataatttagaagctatgatcattttatgattatttatttatctcctgaagtgatcatttattgataaaagcatcaatatgaaaatgtatgggtaaatatttacctcctatatataagctgagaaaaagttgatagaaagtcgttagatgtctaacaggatataagtaatgggtcaaccagttttataaaaaattgagctgtgatattttgatttttagtgagcaattttagtattttcttttctttagggtaaaatttgctacaggatattaaaaaacatgtaattggccgagagacaccgtaagaacgcgtatctgttgtggcacaccgaaaaaattggtaattagctactggacgcccacgatattattttataatatccaaaggaaatgcagagagagacaataacaaaagtataacttttcccatacctactaagtctggcttgcaaacaccttcgatgcagcaacagcacccgccagcggtgaggtggctctctagagaggagggagggtgtcaaggagggcccatgcacctgggcttgtggctccatgtcatttccacacttgttgccgctacagtgtgagggctatgctggcgctgatgctccgccacacaccatgcttggggtgagcacaacgtggaccacctcttaattcatgtcgagtagggtgtcgcagagcgcaggctattgttgtcgatctcggagtcgtggcacgccacgctgccataccctccactgcccatgtcgtgactaccacggtgttagagcgatatgcgagccgcacatggcaggaaggggcaaaatcatactttcgtgattgtttctcttcccttttcctttggatataacaaaataatgccacgggtatctagcagctaattaccagttttttgcggtgtcccatagcagatatacgttcttgcagtgtcacttagctaattatactttttttgggatgtcctgttgtaaattttacctttattgagaagaggcttcaatatggatgtgggttcataatgtaatttttgttagcagttaaatatagtcaatatgggcattaagttattgttttcacttagaaaaataatagctggctagacctaataggtggagattcgtttgtggtcttttctttgctcataaaaataattttaattttaattatcatagagatataaaagctgtgaaaagtaatgttgcacactgcatgtgaacgggaatggaggaagggttgagatgtttcttttttttagaaaaatattgattgatttgatgatctaaaataatgtgttgatgtttaagtaaaaaaccgatggttggatgttatttttttcttagatttattaggtttttttttccaatttaagtgagacaagtagcagcttagcaaaatacccatagggaaggaaaggaaggagaggatgggaagatggtttgggatgttttttattaaaaaaaatagatacaataatgatgtaaaataatgtgtgtatcgatttaagtggaaaacaatggatggatgtttctctaatttaacattgtcataccacgatttagaaatatttataagatgtttaatgggctttaacacctatttttgagattattttcaataaagttaattttagttttaagtgtgacagggataaaaaacataaaggaacagggagcctactaattgatcactctagcgtggtggactgtataggggacgtgggtggttttggttttctaagatagatctaacaataataggttcaccgatttaaataaaaatcgacggagatttatctattttattagggtgccacgtggcgatttgagagtatttatagggtgccatgtcacggtttgggagtgtttgtaggatatttaatggatttttaagtgtaagatagatagatagtactacatacatatggtttttctctttatcttatatggtagaaaattatattttatatttttctcccgattatactatgtactttattttactttatcacacatattttttcttccgacgaacggaacgtaagctttattgtttttttttctgaatcatcgtattttaccttttatacagggaatgtattatatacacacctaatgattcgtaataggtccaccaatttaaaagaaaatcaactatagatatagatataatctaatggtctaaaatgatgggtccaccaattaaatgaaaatcaatagtgccacgtggcgtcataggagtgtttatagagtaccacgtggtggtttgagagcgtttttaggaagtttaatggacttttagtatataatagatagatgcccgacatattagaattcctcagcaataggaaaatataaattataaaatatatcatgagtagtttgatgcatatgttatattaatgttgtttttaatgctatagtaatttgttattaaacctatttgccaaagaaaaaaatgtatatgataattgattaaggaataattgccaaggaataccaatcaaatagtaagagggcttgtagatgcgtcgtgactatatttgaattttattatttgaattttattgttatagtatagaaaatcctaatttaaaaaggccatctattttgttttcgatggttttagcaccgtacttatacttactttttagggttttatagttcttttttatcgtgcttacagcatacatgtgcatgttccttttttttttcaagtgaacggtatatctcaatgtttttttttcttgatagctttttttcatcgtatacgtacgttagttgttttttttcaaacgttatcggtatatctttgtacgttcgtacttaatttctggtaatccgattctctggtatatataggaagcacaaaccaatagatataatctaatggtctaaaataatgggtccaccaatttaagtgaaaatcgacggtgggattgtagaatgacacatggcgatctaggagtatttgtaggagtgccacatggcagcgtaggagcgtttgtagaatgttttatgaacttttagtatataatagatagatagatatgaacaagagcgcaatgtctggaaactataggtaccaacttcaacgtcttaatttggagaacctgggcccctgcaaaatgtaagttcaacgcgtgacttgtcatccaaaatatagtttggatctctcatcgacttgctactagaggctggccgaacaatggggcttgcctccgccgtatgcaaacgagacaacaatccatctcttagccccactgtagatatatcaaaaggatatggagcctattcgccacctaggttacccacaactggacccgaaccattaggacatatgtcaaagcatccaaaattggacccgagcctatctgctgctgctagtcctacaccttgtgcggttgcactagcaccacataatgagaaatcaagagtacagatctatataacatcgtggcgcttttttgttctcggattccaaaccatcggatctaaatgtacaggccggtcgaagaccatgacaatgtacagtcattatattgtgcagttgctactgcgacaatgcttgatctcagaccctcctatgctaatgaaccattcaggagattgaaggtgtagctggcagcagtatgtgctggagatccctgtctggttcaaaatgatttaggttcctgcctgcttagttcctagttgcctcccatcccaacaatagtcgggcgatgctagtgaagagatctcaagaaaacttttatttgcatttctcttctgtgcttctggaaatcctatatattgcctttcatgtcagatgcatctcctatatgtcgtcccttgggctaccaaagcatgcacatttagggcccgctcagatcgatgatattttcaaccataccattatttggtaaaattaacaattgtatagctatatttagtttgttattaaatattgacaatgtatatgaaattttggtaatatattatgggctattcagattgatgctattttcaatcatagcacttttttttttggcaaagtccaaaaaaaagtatctacatttatttcattaccaaactttggtaaatacataaaaatcttagcaaaattttgacaatattgttaacttgccaaaagtttattttggctacaatctaaatagcccatattaaatcaatcctatcaaaattttgacaacgtagttaccaatttgcaaaaatttagtaaggtttattttggcaccaatctgaatagactcttatttcttcattattacactgtaaaaatagtacataatgaaagtggtaattaattagagagtgcatcatatgcgactaatatcctttggttatcatatagtaccatttgaattttgaaagccccagcagtagtagctgcaagctagataaaatagattatttctgtccatataaacgcattcttcatacttcgcactgataaaataactgcggatacttcgcaccgggctaacccaacccctagtgacaactcataagtatattatacacataacagaagaggcagctgagctcaacacaaatcacaagcaatatataatactacttctgaagctagaaactagaaatgccgcaagagccatgaagctaagcagctagctaatagttttatgaacatatgcaacgctttctcattcgcacgacaaattgagtttgggcttgggtagcaccgggagacgcgaattaagcaaaatgtgggatgaaagtatttttggacaatgtaggtggctgcgccctcatgtgccctcaggtttcaggatccagcatggcaaagttctgtacgagactgaagtattttgtcctacaatttattgagcttcacgagcaaatgagcactctgaaggctagcttgttcggatcattgggatttaatccccaacgggaacctatcagggagggattgagtggatccctctcccaaatcacccaaaccttctgggggatgaatcccttccgaccctctaaaccccactctgatacatgtgtttggtttggtccgatcctcttcaaaatgatggtaaagagttaagctagcactataatctttcgacataagaacagtgtgaaacacgcaagcaattccctgatttttttttctgacagaactaatgcgtaataactaagcatcatatctcatatacttcatagaattcattcttgaacctaaataaaagatgaatgtatcaacacattcatatatgaactgaacaacagaaagtacatgaagtttggccatactgtttatgtgtgctggtaagggtagaaagaccattctagtcttttcacgtctattgtgcacatttatatgcctctttaagcctatctcaatgcatagtgttttatccctaaatttccattcttctcagcaccttgacaaggtcccaaggcaaggtttgttccggtggtcatcggcgtgccagcggtgccctaccgctggcacggaaatcccatccaactcacgccaccacttaggtagcagcagcaagccctcctcatcgttcggtacgtcctcgagcagcagacttttggtttctcatcttcaaacaagaagcaagcagcaaggagcccgtgatcgccagttcatctcctcaagcagcaagcaaacaaacaaacgcaacttttttgtcactatacatatcgccgatgcttataatcatactctggtgttttggtaaatcgttaatatcaaacttgagccaccccactaatacagtgtaatgcacgggcattttgctagtgtgtgtatatatatacatatatacatatatatatatatatatatat

SEQ ID NO: 71003 - DNA, 3577 bp, Oryza sativa
aaatatactggcgcatatgttagtatggtccttactccaattgcatcataacaaaagaggagtaaaggatggttctatagcaatcttataatgggccaactgttactgaaattcacatggaaaacacacgacaaaataaccgcaccatccatcttattgccctgagcattggagcgttccttcccatggtcatcctcctcgtcaaagtggcaattacaacaaaaccactgcctcatattgtctcctcacaacttgaacacctgaaccaaatgcacggaatagttagcatacgtataaagatcagagcacataattgaccaatgcattaaattacgcaagaagtacacttctgtacagtgtacaacatctgtactctcagcaggttggaactaagtcaactagagtcttactgttttcctctacggaaaagcttacagtttccagattcaacatgcaacagtgtggaccaacatgccttcttagaagcagtaaacctaaaatctagtaatctacaaaccactgtgagtacggctatttcaggtactatgcgagcgtagcaatccaatcgcttaaataagcaataataataataataataataataatcaaagtgctaataaccaggatggattgggggtatccactcccagacagaagtatggatttgaattacgctgacagcaaagtgagaagcaaaacccacactgatggaacagcgatcagagcagagggctaccactcaccaagcaaacgaaatcaccgccgggttcgatggcgatggcgcgacgagagaattcgagacaccaccagggggagctagggttcagaggcgagacgaagtggagcttgggcgcgcacaggctcaggggagggtggaggaagtggccggcagcggcagcggcggcggcggcggtggcgcagcctccgcgtcctggttgcctgctcgagttaaagccgccgtccttatgggaggggaaggggattattagtattaatcggtattaatccggctcgttaatttcgcgattagtattaagagcggcgggattagcaggcgtgaggtggccgggaatgtgattgtgagctggtcggctgccgatttccttgacaggtggggaccagagacgtggggcccattagtcagtgcggttgggctggaaccaggtggccgtttttggaattttctggctgcgcacaacatcagcgtggactgatcctccccgtgtgggtgacatagggggacagtgagcatgtggggcccgcatgtgcttaggggaggagcgtgttaatccgcctccatgttcgaaatggatgtggggcccacgacagaaaacagcaccgaaaacgtgtgggtcccagcggcgtgcgcagataaaagcaagtttaataatgtagcctactactagctccaatttatctatagccaatctaatagccaattcatacgatagttgcttgctatactattaatatatggtcccacatatcatacacatgtcttggagtccgcgctgcagctggctacagatttatagcccgctgctcttctctctcatcttttatctcattaaaatatgcttatacctgactaatagcctgctattgtacctgctctaagggcaattattatgggcatgtgtaaacagtgaaatttggtaatcggcaaagacgtcatcggcttagaatcattatcggctgcagcatctcggaatcagtcgatgggagttatcaagtcaccaatagttggattcttgctatattcggttaaggaaatcaatctactaaagaaagcttatccctaagtgaccgagtttaaagaggatgtggcatggcagtttatctattaattaggaatagtttgttagtttccttttatctttaggaaagtgtgtttagtgtccgatgaggacttgtattttccttttatctttaggttagtttctttcttgtccgacaaggacttgtatcaacccatgggtataaatatgtacacccggggtctatgtaatctatcactctggatcaataacactctcggcgcatcgccaccctctttcccgaggtttttacttatcttccggcaggatttgggcacctgacgcggggctgcatcggttcagttcgatctccggcgaaggggtaagtcctacgttccgtcgggccctggtgaatctgtcatctacgtcggcatcgtttaaggctgcatcgcttcgatctcttggatcgctctggtttggttgattgatttgcctacctgatatctcaagtctatctccaattccattgtgtttagagacgcatcggtttagttgggactgtctcggttaggtccgatcttctgtcttagccgatatatctctacaatcacaatgctgttctaaatagatttgttatatccatcacattagacagatctatcggctcatcgagtattagattatcatatacaatctcgtgctgcatcggttaggttcgacctactagattgttgttgataatataagtcttgctaagctgataggttcatgctactgttttatcggggtgctagccgataagttatctggacgttgcatcggcttagagtgatagattacatagaccccaggtgtacatacttatacccatgggttgatacaagtccttgtcggacaagaaagaaactaacctaaagataaaaggaaaatacaagtccttatcaaacactaaacacactttcctaaagataaaaggaaactaacaaactattcctaattaatagataaactaccatgccgcatcctctttaaactcggtcacttagggataagcttcttttagtagattgatttccttaaccgaatatagcaggaatccgactattggcgacttgataactcccatcggctgattccgagatgctgcagccgataatgattctaagccgatgacgtctttcccgattaccaaatttcactgttaacacatgccccctagttttggagtatgaggactcatgctccaaaattctcttctgtctgatcttgtaatcggctttcatgagctgatactgatgtgtttgccccctagccgaggttgaatgatcttggcattgacttcttctttagacatgtggatataaaattcgtggtcccaccgggcgtgccaaaagcgtgttgacagaaaacacgaggcctgggagatctgcttaactcctgtgcaggtccaaatatgatgagatgtgggcgtgccagtcagtttgatcctgcaacggacaagatatgcaaatagtagatcaaaatagccgatcggctgacaagccgatggagtaattccagccgatggccgataatagccgatgccgataccagccgatagcgatagggtttaaacaatcggctatatgtccaatgtagatgatgatataaaggcaatcggctgatgatgatgtaataaaataacaatataatccagtataaaccaatcggctagcaatgacatgataaataagcatcgatccgaaagttaaagcacacatcggctggaggtccgatgtcatgaaatccacaagattagattaaacagttaatctttgttg

SEQ ID NO: 71004 - DNA, 1840 bp, Oryza sativa
caaaacgaggaaaaactctaataaaaaccaagtaaacagtacataaaaagtaacaaaacatgtagatctcaattttagatgaattttgcaagttgaatggcccaatttggagttcgaatgaattagatatgaattttagaagttttgagccattttaatgaatttttagaattattaataatttattgtgcaattattaaataatttctcaaaggaaaggcctgctgctgacatcatcaaaggggccggctccgacaggcgggtcccacgagtcagcgacacacaaggggttggcgcacggtggacacggtccaccatggctggggcggcaccgtggaccaggaccaccacgggtccacgggcggcggcccagatcggcaaaaaggggggctggcttgccggccaacccgacaaggcggtggcggcggcacacggccggcggctgagaggcggtggcgcacgaccaccggccatcgacggcgagcggcggcgcgggaagcagcggaagggatgggaggaggagagggggatgctcaccgagcacccgacggcaagacgacgacggaaggtggccggtggagctcgggcggcggcgctccgacaaaggacggcaaccggggtttcctggggaagaaaagggaggtgcggggagatgagtccggcgacgattcgcggagacagaggagtggccgagctacacacgagggctgcggtgccggggaaggcaacggcgcagtgcggcgtcaatcgaggaggcggcgcaacgcggttggagacaacaaatgagatgatggctcggcctcgcagtgagaatggcgctgcggggggtggaagaggaaaaaggagtggagaccgggtggatctcggcacggcgatgccgacggcgacgacaacggcgacgcagcttggcggtggctagggtggcggcggttggcggctgaagatcgccggcgggcggcggagagagggagcgcggtggctcgaaggatttcgagcacgggaagtctcgggagagaggggaaaatggagagggaggtccgagcatcctttttattggctcggggcgacgggatcgtggccgatttgggccggcaaccgacggcgacatggggaagagagagagagagtgagaggctccggattccgcgggggagggggggaggagagtggggcgacgcgaacggcgaggtgaagaagggggcggcgcggtccgggcccacacgggagaggctgtaggctaccgaaggaggcggcgacgtgggtggctcgggcggccacggcggttgccagcccgtgggtcccacctgtcgcgagagggagagaggaggccggttgggggaggaccaatagactttagagggaaagggggccgagcgagatgattgaggggaggacttggaccgagcccgaaaggagggaaggggaatttatttgcttttctttttatttaatttgattatatgaactttgtattgttataattatttattgagctccgaaaattcgcgggaaattttttaggaaaaattcccggccaatgatttttaagggaaaattttaattctcccattatttcacttgattaaattgatttaacttttatttaatttctagaaaatacattatttaatgatttttaatccctaacgaaaatcgaggcgttacaccgggggcaacggggaccactccgcggccacccaggaatgccaccgcctgcgaaggtgtcactgcgacttctccccgtgccactacatcccctcctctaccgccgcatcaaagggagtgggaggcggagatggcgcggtggctcaaggaggccaaggagatggaggtgctcgag

SEQ ID NO: 71005 - DNA, 4607 bp, Oryza sativa
attcctgcagccctgatgtccgtttggtactaaggaatggcaatcgatacatatataagactttggacattagaattttccttctcttgaacaaaattgtgtgatatgcaaaaaaaaaaaaagagccaagtaactaccaacaatatgaaatatgtgggataaaattcgaacaaactagaacagaactaataattaagatgcaatataagcaagaaatagacaggcatcaagatttcttgggaccacgatcttatatggaaggtggcgctggcagcagtatatatatgtgctggagatcccattctggttaaaaatgatttgagttcctccctgctgttcctagttgcctccctgccctacaatcatcgggctatgctagtgaagatctcaaggaaacttttatttgtatctcttctctgcttctggaaatcctatatattgcctttcatgtcactactggggaaaaggcccttcactcccggtttgtaaccctttttactcctgagttgcaaaccgggatactcaatccgggtataaagatgcatatctttagtcctgattaaagtaaccaggagtaaaaatgggtcttcccacaggccctccgcctggccgctcctcgatctgctctagggatgaggagaaggagaggttaaggatcagagagaggagggataggaagatgaggaggagaagataaggataagagagaataagaagatgataagtttgggaggataaatcctcgggattatatactatatatggatttttagttctggttggtgttatcaaccgggactaaagatttgaacaatctttactccaggttggtattaccaaccgggactaatactccaggttggtattaccaaccaggactaaagatgttcggcccaccgacaggccactaacataggatgatctttagtcccggttggtaataaagattacatagcttttaatcgggactaaaaattatttttttgtcccggtttttattggaaccggaactattgtagttttcggccaaccctgcaaagatcagttttctagtagtttgacagatgcatctcctatatatatgtcatctgttgggctaccaaattaagcatgcatgtttagggcgatattttcaaccataccattatttggtaaaattgataattatatggctatatttaatttattaccaaagattgacatcattaaactaatcctaccaaaattttggcaatattactaatttgccaaaatttagtaaggttcattttgacaccaatataaaatactcttatttcttcagtacactgtaaaaacgtacataattgaagtggtaattaattaccgagtgcatcatatgtacttaatatcctttggttatcaaatagtaccatttgaatttgaaagccccagcagtagtagttgtaagctagataaatagatattttctgtccatataaacgcatccctcatagtttgcactgacaaaataactgtggatacttcacactgggttaacctgggtcctggcgacagctatctattacactataatatctattacactataagtccattaaactttctacaaacgctcttaaaccgtcacatgtcattcctacaaacgctcctatattaccacgtggcgctttaataaatcctagaaattataaaaaaaaagcaaaacatccaaccgttggttttcgtttaatcttgtggacccattatttttaatcatcagatcattataaaaaaactatcaaattaatctatctcaaaaaaatcccacatcacctcgtcgtgtccccatttatctgtagttttgtacgtccgtccgtacatacgtacatatcccctatatgtcttttttctttttttcttcttatatacttagattagatgaaaaaaaacaaaaaagttcatgttaactatatgttttaagttgtaaaaatacatattatttcatgttttattctatatatcacatctcatcaaaacgtccataaaaatattaataaattaaaaatgtagattacatgattgtatatcacttactaacatagttaaattgaacttgtatttttgaaaagtaaaaacaatttaaattgtgagtagcattctaaaaaattactcactccctattgggtaatactgacatgtccaaatgacattattaaatatatcatgaacgtattttcatataatatatatgtctttattcatatatttttggaaaattaacgatcatatttttttacactatgtggatgtccttttatctcttaggcttcattcggtttacctaatcggatgagcttctctaggacacgtgaaacaaataatgtcttcaacgtaagattaattaagtactaaatattacaaacttgaatatggatttgtttgatcttttagaaaactttgcatataaagtatttgtaaaacacacatcattttaatagttcaggaaacatgctcaccataaatgtgggaatagcattttatactatatatttttactaaatatatagtataaaatatattttgtcaattaggaatagccaaatatatcaatcatatatccctactaatccctatataaataagtttcatatataaaccactatccaccaatcatcaagattgcttatgaggtgtctgtgcactgtgcacctataattagatggcatctaataagcatggctgttatcaagtaccgataaaggacaatactaagggaaaccatcaacaaataataggtgaatattgacaccaccaagacacaacaaacaataattgactacaaatagattgtaactattgagtaatataacgttcctacacacctacatacactcctaagatgccacgtgatgctctaagaaattagggtaaatctaacaaaagttttaagaaaaaagtaaaacatctaaccattgatttacacttaaactggtggatcaattattttcagccattagattagatctcttcgagtaatccattgtggctatgactaatagcggggctgtttggttcccagccacactttaccattacttgccaacaaaagttgtcacaccttgcctaaggtgaggtgatcaaattgttagccacaacttactaagcctaagggaatcttgccacacttttttgagccattgacacgtgggacccaatttattggaggggaatcttgccacaactgtggctacaaccaaacacctgtcaaatttgcctaaccttaggcgtggcaaactgtggcaaagtgtggcttgcaaccaaacacacccagcattcctgcactcctaattaatatgtcatgtgacgctctaataatatattagagaaaatctaagaaaaattataagaaaaaaaagcaaaatctagctattgatttacacacataaccatgtagatatattattttcaaccattatattatatctattcaaataatccctcactatgtacgtacacaagcgatgtcataaaagaaaaaaagaagaagagagtgtatatgatcagcccaatcgagtagttttctctttctttcttcgcagctctaagatttttctcaaattgtccatatgagtagcgaccactcctggcgaggttgtcgaagaagccatgccaccgcaacactgcttcatgtcatcttgccaattttcttgaaagtatatttttttactaatgatgtaaaagtcaatcacgagcacatatataaacgtttgcacacccctcataaatacacatatgcacacctacccccaagagaaaaaatatttgtcccaaaaaaggaaaaagtgcagcttagtatttccagaaaaaaaacatatatacataccatcgaaaatatcacatggaagcacattatatctttgtgattatgtcattctcatatatatatataatgttaataattagtacaaataattttgacaataatatatattattccatcgtatattacccatgaacatgcataggtgaatcaaatgtataataaaagaaaaaacaacacaaaaatatatcaactcatatgtttgcgaatgatggtgataaacgtgtttagatataaccacgtcatttcgtactatccttatagtttatgggtgtaatttagtccatttcctttaaaaaagtcacttccatataaggatttaccacttaagaattttttgggattccctttaaaattaatcaacactaaataagtaagttgcccgcgcatgtgcacgggccaccttcctagtttcataaatacacataatacaagaggcagctcaacacaaatcacaagcaatatatataatatgacttctgaagctagaaactagaaatgcaagagccatgaggctagctaataattttatcatcatatgcaaagcattctcattcacacgacaaattgagtttgggcttgggaagcaccgggagacacgaattatgcaaaatttgggataaaagtatttttggacaatgtaggtggttgcgccctcgtgtgccctcaggttttagaatcctccttggcatggttctgtgcgagactgaagtattttgtcctacaatttcttgacctacaatttcttgaccttcatgagcaaatg

SEQ ID NO: 71006 - DNA, 29127 bp, Oryza sativa
atatacctggtcttataaaacatatgtgagatataatgtgatgttcagaaaatgttaatttctcataagtgtcaatgtgtgacagaatgccttcgatatagtaagaacattttctattcaatatataatgactatatagagactatctatatggatttatctattctttttgagggaaaaaatatattgacataagtatatgtgtattcatacgaagatatcttctgattgcaatatgcaaggccacggtacatatgaagtcagcttttgctcttttgtgtgcatgaatcttatttgtgttattaagttttcaagtcacatgctactatttgtactcaaatatatttaacaaccttatagttgaaacaagctacactagccacaaagaattcgattttcactaatgtggaataaactagacctttaaccataactttaatgctagaagagtacaatagttctttttaattttttatgtagtttagtaacttaatggtacttaagctagtgtggaatttgtacttattaactcacacttttgttgttttcgataacaacaataatattatgtgatcttactctcatgtacacaagcaccagtaggtccgtgaaaggatacaaaacggatccaactccaggtaattcaagtaaagtggaactggtttatgaaaagaaattttgtaatatgtcaatactctcttatagtactttcagctcaatcagtctaaaacatataggtactactcaataccagaggggaaggaatccaactagcggcaatattcaacatggttttgtgtgactgttatgtgaggatttgattttgtgatagttggtttctccattgttcttttggaatattatgtaattgttgttggaggatgtgacttcttaagaattggtctgtgctgaagttttagaatatgctacctcaatagcatccaaatgttagcatttccttttaaagttgtattttaattgccacaaatgttttatttaccaaatcaagtacttttgaaaggaagtcatcattattggtatcacaaactagtttatcaaatcacatacttaagggatacattatcatagaattgtggatttatgtgagaaaaaaccaccaaaatgtagtatgcattataataaaataagagataatatattctgtgccattgagtttgtcatggttctatgatttaccaccgaatttgtacacttccattatatgccatcaggttttgaaattctctcctacaatttgccattgctgtcagttactttgtccttttgaaaagacaaaatcacacataatcaaatgcacaagatttattgttgtcgcatttctcaggtagccgacctgattggttgctagtttatctccaatgaaaataacagaacaagatttcttctctacctctttgagtgtcaaggataaggcatacctcctacacaaggattcatggaatacggcaataccatatacttgattgtatacgagcaggtatcctttaattaaggaaatatggtagataatataaaaaagaaaattatcttcccggaatagaaggtgttagagacctattcagggaagataaggtctccttgggttattttgttttatctctgtgagtcctacttggagaagaagatgatctatgttatatatacaaggccttctcactcagggaggggcatcaagttacaaagccatagccaaagccatacccagaagtaatccaaaggaagccaacgccctattcgccaatagatcttgtcgggttgttctcgacaactacaagtcggcggattagtctagtcatcctattcctcattgtaaagtgactttcccacccataatacatataaactagagtagggttattactcatcttgagggcctagaccagtataaatctatgccccttgtcttcttcatccaatatcgcatatacgcttgttccaacgatccccatactctacagataccatcattttaattgttgatttgcgatagcatttatctctttgtacggcatacaatggattctcccatgataaactgaatggcatagaataaattctcgcaaacaaacatatgtaataagaaaaaagaacaagcttagatgcaagaacttgtttacgattgaaatttaggtatgcgatatatagtacttccaatcatatataagttcccatgtgagctcttgtttattagtgaaatttagacatgaggtatgcaatactttttatgattggaaatataggcataaaacaatcggcatgtgtcttgttttatcctaaatttaggcatgcgtctcatgcctaaatgagtcttgtttgtttttcatggataaaaaaaattggcgaggacatcaccacagtcctcattacccagatcgttggagtttcaactcaaaagtttgtatttcttataattagtgctttgggatcatttgacatcctgtcccaattaggatgtggtaaatgtagcccatgattagtaccaccttgctagtttagcaagagtggaaccaacttctaagggtgtgtccctccaaccatatcatctctgggttaatcattttacaaaacacgaggatggaactgtaagtggggtgctatatgtaagtggccctgcccattggatggtctgggctgcgcggttctagagagtgggctgttacatctgagtcatcatgccctggtaatctttgatgccaaatccttgcaaaggattactagaaccaatacctatacgcttaatatgtcatgacatacagagataccgtctattagtaaacttttcgaactgaaaatatgagtggaattgatagccttcgaaggagatctacaatacatattgtgtatatcgtacggcctaaaatatagatccttggcagggggatgtgatggcaccattgcgcgccgactactccatcatcatccccgcaaccatcttgtcagcaatggtgtgttcctcccaaatctgttgtggatggcgaaatatgaaattgattttggctcaattggggaatagttgggactccacaaggtatgtcataaatgccattatatatgctatcatgggcatttgtggccattgatctgtacttcttccattggttgttaatatttaaaagcagtaactttgtgacaacctttgcaagtgttctttcccttaatgagtaggttcattgggttttaagatatgcggagtataaatgctagcccaatttatcatcaatggatgataaacatgaactagatgtgaaaaacattaaaagatgtagccttttgttttcttgattgtgctatttcacggaagaccatgaatgatcgattaggtagtcacctccttctctgattgatataccatagtagtagcgggagatggagtttgcatgtcatattgggggcagcattggggaaagatattgcgaagcatagcgggaggtagatggagcttggcaagagtcctgacggcgcctaatcagttggccatggtgtccgatggcgcaacagagatcgagatttagttgttgtcgtctggtctccctcctcccccgttgcaaccggatttggctgtccctgggcaatgtgatttgctactcaaggacttgcgggatggagacatagcgagagaggatcaccacactcaggcctaggcttagggacggcggcggtggtatagtgatatggtggcaaccccctcctccctcatcttcttgtagctggcatcttagccgtaatcctcctctaaacctgcgcggtagtttctgcagacatgcagagcatagatcctcaccggatcataggggcacaatgcactcacgtagcactatgtgtatacggtacgcggcgaggtggcggtgacctccttctctatagggccactgccacatgcacgcctagatgtggtcaccaacgcctcgccaactactattctttgcgttttttattgaccaatgttctagaaatactctgtgcaaactatttcctaaaccaaatgtgtttgtagaatacacatattcataactataaaaatgggtaaatgacataacatatttcgatatattgtgctaaaaatgggcaaagcatttttagccaatagtgttggagtgataaatatgtgtgggacatatttggtaaaatataagatatagctacttgcattgtgtcatctagagttggtgagaacaaggataatgatcaatatactctagtttagtttgtctatggtaagggacgcctaactcattgtaatacgagaggagagtttgtagagaaaacaaatactggagtcatttgcaattcaccaaatccgttggcaagaacaatgtcatacacatatgatggtctttacaaaatcaaaaattacctaggaggcaaaaaaaatgtcattccaacgtgaaactatgtatgaactaggaactagattagctggggcaatgtagtttaggaaattactcaggcatggatggaaaactagtcctctagagatcatgttgcgcagtgtgaaccctgggaactggatggacttgagcaagcggtggaggtgcaacacctgtatggcctctatgtggtgcttggggttgtcgagtgccagcagtgcatcaaaccccatctgctgatagcatccctgcaaaaacaccaccccaagacgcagcactagtcggcagggatgagggtaggggtgtgtggggtgtgcgtatggaatctacgacaggggcaaggaaggcggagaggatggcagggaggaggtcaggatgcgggtcagggatgtcctccgcgcggaggttggtggaaggggcgaggcaataggtgtgaattgcctcaccgatctgtgttggcatcatctctaggatgaagaaatctaacatcatcttcaccgtcgccacagatctatctaccttcccctgcatccccaaaccaaatgtgagggagcagtttcaaaagtacgaaaatattcttgaaatgcaagcagttattgcctcttttcccgcccaagaaaatgatttgatcagcacaccattttcatgtaaagcatggtccacccgtggttttgatggaacacacaaccatgacaatataccttcatccttttcacccatgccaatacatattgattcataactcataagacggaaaaattacttaaccttttcttcatctctcctttcctcttcctgtactccaacagagtagatttagaaggaagctaagggtaaacacaaattgggcgaaagcaacttatgagaggaaataaaggaatccagtgagcatatgaaggtaggtcactcgtgtagaaattctagccacaacatatcgatgaatgatagtgagtttattaacatagcaatacaaactttctcaaatcgatgagcttgaatttgattcctcaaatttgtttgctcagggaaaacaagaagataattttgtggggacaacaaagaatggattccgagctagaatcctcaaatttgtctgatctaggtgtagaagagggattggaaaactctagccatggctaccaaggatgtacccgtggaggtggaaggtactcaaacaccaccttgaatctcctgaagatgaaaatgaagatgaagattaaatgattcacgcaaaacgaggtggtaataacatgtgattaattgagttttaattattacaaacttgaaaaatggattaatctgatattttagaacaactttcatatagaaatttttctcacgaaacgcaccgtttagcaatttggaaaacgtgccactttaatccaaaatttagtccccccatttcaggacattcgaacggggctgacaacaaaaggatgaacaatggaaatagaactcgacaagataacggtggaagtaaaacaaaggtgagtaacttcaggtctcatatatattttataagaccagaagtatatgctttcaatttcaagggggcaaaatggagttattttaatttatattaatgtcatttggtttggccaaggttcattactatataaaaagtgtgagagatgttcagaaaatgccaattttcttgtaagtatccacgtgtgacacagtgcctttcatatagcaataacttttttaattgaatatataatgactatatagagaataactctttgatttatcttttttttgaaaaatatattgacatatttatatgtgtactcatatgcagaaatcctctgattgtaatgtgcaaggtcatggtatgtatgaaatcagcttttgctgtttttatgtaatgaatcttatttgtatcattaagtttttaagtagcatgctaatatttgaactaaatatatttaacaaacttatagttgaaacaaactacactggccattaacaattcgattaatgtcgaataaactagacatttaaaccataactttaatgctaaaagagtaaaataatttaaaattttttgtatgcagtttacttagtggtacttaactcagtgtgaaatttgaactaatcaatacacaagtttgttgttctcgatacaaataatattttgtgatcttactttaatgtaaacaagcaataataggcttaggcacttgtgggatcaccgagattgggtctaggcatatggatggtggtggtgatataatgatctggtggcaaagccttcctcccacatcatcctgagtggtttccgcagacatgcagagtacagctcattccccgtggaagctgtaatgcggatgggcagcactgtaaagggtacgcgatcatctcctctgttgtgccgccaccgcacgcatgcctagatgtggttacagacacatcgtcggctgcctagtctacatgattttttttttaaaaaaaatatcaatgctatggaaatactctgtgcaaactttttactaaacgatatgtgtttttgtagaatacacatattcataactataaaatacttatattaatattagtgacataacctatttagatatattgtgctaaaaatgggtaaaacatttttagccaacagtgttggagaggtaactatatgtggagcatatttggtaaatataaggtatagctacttgcattgtgtcatctagattttgtgagagcaaggatagtatgaaagttatggagcgagaggtgtgctggatttggtgctaacaactgccaggctgacgggccattttatgataatgctacaatccaaccgttggctcacaaaaccagacacagattaatggatttcattggcataccgttttcatgtaagccatgagccgcctgtggttttgatagtacacataatcatgctagttaatctgctttgatccttatcacgcacatgtctatatatatcgattcataactcataagacaaaaatcactcaactttttcttcatctctcctttcctcttcctctattccaacagaactgatttagagggaagcagtgggtaaaaacaccttggtcgatagcaacttaccagaggaaacaaaggaatcgagtgggcataagaaggtaggtcactcgtgtagaaattctagttaaaccatatcgatgactgatagtgagcttattatcatagtgatccaaactttttcggatcgatgaatttgaatttgattcctcaattgtgtttgctcagggaaaacaacaatatagttttttagggacaacaaaggatgatcatgttgatcattcagagctagaatcttcaaagtttcttgatcctggaaataaagatgtaccataggaattgcaagctctggaactgcctaccaatgatgtacctgaggaagtggaagttgttgaaacaaaatccaataattttgtcaacaagacaacgaggtaacagtggaagtaaaacaaagattagaaactctttctctctctctctctctctctctctctatatatatatatatatatatatatatatatatagtaaatttgtttggtgctccatggtgcccgggcaccattgttaaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgatatcatggtgcccgggcaccatggtgccccatatgagtgtcctatatatatatatatatatatatatatatatatatatatatatatatatatatatatatatatatatatatatatatataaaggcggagatagaggcatgaggttaggccgcgggctggcgatgtcctccgtgcataggttggtggcagggggtgaggttgtaggtgtgttgtacctcggcgatctgtaccagcatcatctttgggagagagaaatttgatgccatcttcgctatcgccgctgatctcacaactttccctcaatcccccaacccaaacgcgagggagcacttcaaaagcaaaatatattccggaaatgcgagcactttttgcttcactacttaccttcggaaacggattaaaaatgaaaggggccaatttatgcggttgtgtagaggagttgttagcccacagcccatactcatcttactaaccgttggctcacaaaaccgaacacagatttatggatataatcagcacaccgttttcatgtaagccatgacccgcttgtggttatttctcgtcatgccggtgacggaacgacggccaattttattaaagccacccgtgtatttgatagtacacataatcacactaatatactttcatccttatcatggataagagtctatatatattgattcataacacataatacagaaaaattactcaaccttttctttatctctcgtttcctcttcccctattccaactgatctattccaactgatcagatttagatcattcatgtcaaaattctagctacaccatatcgatgactgatagtgagcttattaacatagtgatccaaacttttttggatcgatgaatttgaatttgattcctcaatttcgttttctcaggtgaaacaacaagatagttttgtcgggacaacaaagaatggtcatgttgatcattccaagctagaatcctcaaattttcctgatctagggttagaagaggaactaaaaaactctagccatggctaccaaggatgtacctgatgaagtggaagttgttgaaaaaaagtccaataatttagtcaacaggagaacgaggaacaatggaaagagaacttgacaggatatcagtttggagcaaaacaaaggttgataactttatatctcatagaccagatgtatatacttccagtatctgggggacaaaatggatgattttaatttatattaatgcatatggtttggcccaggtttagtactacttgaaattggaaaaatgattagagtgttagtatcagattaattgtcatattagtgaagagtgagtgattttcaggaaatacaattttgtcgtaggtgtccatatatgacacaatggctttgatataacaagcacatttttattggatatctgtatgatttatcttttcttggaaaaatatattgacatatgtatatgtgtattcatatattcaacaaattgtaatgtgcaaggtcatggtatgtccaacagtccaagtggctttaccaatatgagtaaaccggtctgtgggaatcatttcattccagtgggcaagatgcatgtatgtgatctacataagcacatgatgacgatagatatcttgtatttccaaatataagcattgaaatctaccatttataatattgaatagatttggttggccttctctctttttgcaaccagatctgtccattgtcactaggggaggtgtcatcaaagtaactcggttaccttacagaaaacaactgaaagtatcaacgtcccttgcgcacactaaggtgccttcgactcttcctcttactagattttcactatggtggctatggaaggggtagggaatgcaaaatgactaatgccttatcttcaagcccatgcaaataaattgttataacatcgtgtcgaattgagtctgcatattggtttttagccattgtgtgtgtgcacctagggtggggaagaagaaggttgtgaggtgaatggtggcattgtgcgagatggtagaatggacagagggataggatggagtggctatgttattagaaagctaggcatgcgtgcaacatttactctctaatgctggacaaattcaattgaggtataggtgcaaaataatagaaatatagcgtaaccaatcccacatttctacacatgcgtgagcaccatttctgattgtgttaagacatttagtgcaacaaaaaaaatagatgtgcgtttttggagtttgacacactagatttaaccatagctttatttaggacaaatctcttttctattttcttcttgtttgatattttgtggtgatttcttttaactgttttatgtaaaaagtgtgtaacatacactagttaccaaatatagatctagaagttatgttgttgacacttataaaaatattttactcttttgttgaaaatatgttgtttacattttttttgagttgttctattaactggtattcaatatattgtattaggtatgtgccattgagggcggattctgatcgcataggtggatgtccacgtacactatctgccgttgatcatgtcgccaagattcgcgcgcacaacaggcagtatttcgtgataatttggccgtatactgcgatatacatatacatttcaatccccgtatagtacggattgtactttttaaattcgcaaaagccccctatcgagggaggaaaagctacctatgcctttttttcccgtccaagtctgcttccggacaggtcacgggctcttctctagcatcccacccatgtctctctgctgctcagcaccatctctgcattttcttccatagtagggcagatctggcttgttcttgttgtgttcctcgctatttctcccatggaggatttacgtcctactcggtccttcttacagttgatggctaatatgcagccccgtggatcctggtctgggaaggttagtctttactaatctatagtgttgcagacttgcagttgcaacaaacagtccttcgtcgcccctaccctctatcgatccgtgctttttttttttttttacgaaaatgctctgattttttctctccatcaaccagcttggaaggcgcatgttatttccaaggagtagggaaatgcccataccctccgggacagagctcaacactttctcctgatgaatttttaccagcatcgtgagttttctagtttttttcctggggttttatttttcaggtttgtttacccccttcctcagagattgtgttacctttacagtcctattgatctggaccccgtcccaagttctatggatgttctgccggatagcacaaaatactgctgaccaagatgcattgtaagcaactctattccgcaccaatctatttctcttggtacatttcgttgaaaaggttttattttttctacattccaggggagatgaggtgtacatgtgtgaccagtatgtagcaaacatggattctgaaacggcggaaaacacatctgattccgtgtgggcagacatcagcgggtactcatcttgttctgggcctagctaaaggtaataaatcagcactgacatctttcgtttaacctgtactccatgttcttaactttggttactgtagtgctatttgccttgttagccacgatagtagtaccatgaatggattcacttatttgtatgttttttttgggtataaaactagtctttttgcgcaaagatgttttggttacttgtatgtgctcttaactttggtaactatactgctattgaattcctgatgatgtgcttgttgacggtcattataggccaattttgaccgccaatatatctacattaaaggagaattagctatgcttataatgcatatttgttttagaataatatagttccacttatacttggagaataatgttgcatgaattgagcaaataaataatgaagaaatgaggagaactcactcctaagcaagcatatggataaggagggcccacatgttaggtgtaaccgtccagaaaccaccttaactgtcacaatcgactagaggacccacctgtctgtaccatgcccgaagctggaggcctgctgggctagcccaggggccgaaccctggtggcccccaatcagcctggccctccatgtggacgtccaggatgcactctcaatgacggttgtggggtaggaaggtcatttcgcctttcctaccatcgtcatgctgaccctataaaaggaggagcccatttcactctcaaaacactcaggcaagctcaagattcctcttcatactttattttagtagttttagtactaagtggagtagtatagaatagttctcgcagtcctcggagcttccagaagaatttcggtatggctttagtagctttcttattttcttctgtaagactctcggaaataataaagatactcttcttcttatattctcggtactttacttagtctgagtgctgctcttattttatatttgtgtagtcacaattgtgtgggtagcctaccagagaggtgcaatggtgtgggtttagtgtccgagttatcggttgctctatatcatctgcagaggagtagtatttattaatgtaagcatggtgcttagattactaaatatcactatctgggcatatatgctgcgggatagtagaggtgggctgctgatggtgatagctcagtacgggtattcttccacgttagtatatattcctaatacaaattcctagggagggtactcctccgtatttagccccggttggacagccatgacaggttgtcataagaaactcagcaaccaagggtggtctctcgaaacaccaggagggcactgttagggggtatttgccacataattgtatactagcaaatgtagactagagtttgagtgtatattagaagtataggaaatgagttcttcctatctcttcttccactcagttagaattatttatttgaggaaatccaaaggcttcgcttcgtgtcactccatccttatattaaattaacctctacttagattttgattaaagcaagtaatatatgtatgtatatattagcatggttctctcttttacaatcttcccttgggattaaataaatatgataccttcgaatacttccgggtgaaatgctacaatggtatatccatgcgcttgcggattacttctgtaaccataaatatatcaggactatttctgtgccattgctagaaatgaatatttctattaatgttgttaagaaataccaacagtgcctgtaattgtttttgggtttcaattttgtgtgagaatgagacagtagactactgattaagagcgatgtgcatggattagaggcgtttcaacagcacttggacaagtttctcagtttgattcactggatccatatgcatgtatcatttgactgaactaattgttgctgatgatgtgaacttggacaagtttctcagttcgatgcacgtgctaacgctacgacaatatttgataatgcaaaattaaaaaaaaatcaaaatattttatatatcttgaaagtataaaatgagataaattttaaagtcatgaaaaaaagttcagtttaaataacaaattttaaatcatgcagaaaaaaaatcaggtccagagatggatagcaccagtagctataccgtgttactctaaaatacaaaataaaataattttatctcctggatgtaaatctatatttttgtttcataacaccacatttttcacaattacaaagagggtcgcctcaagcaatcgaaacatcaatggtcactacatgcatcgctagaaagaacatcatcttgatgtaaactgctggacctgaatagattggcctctctaacagcaccaggatcagctccaacatcatcttaagctagaaataacttcgatttctgaaagctcaggaagacattagcatgaggcatgtttgcatggttccaactcctaaactcctgagaaaccaaatgccttaaaaaattttctcgtttagccacatcaaaaatctttcaagcaaattacatccaaataaaaagaagtaacagaaccggccatagaatttatgcattgcatcattattagtaattacaaagtcatcagcacacttcaatattcaacatgccagagaaaacacatctttattggattcatccaatagcactttttcatggatatgatgaagctatcgtttcattgtctggagctccaaaattggttggtgcatacaaaggagatactccacttaatatcaagcaattgacaaaattaacatattttcaaagttatggcacctcacaaaatggaaaattgaccttctgctgcagcctacataacacatatcagcagcacaacaattgcagttcaaagagtctacactgatgaataaaaattgatttggttgatagaaagaaccacccaagtactcaatacaaatagaaaattgcaataattgttcagtatttacagtgaaatctaaatctacaggaaataacagcctcgatctgccatggagaaacttttccaatatatttccactaagttaggcactcaggctagcaaaatgaatacaagattccaactaatcaatttctgaaataacatggtgtctagaaatgctaatcctaattttagtgctgttctacttactctggagagatcttggtcgatgtcaacgattatcatggccatgttggtggatggggacaaggctctttgaggcggtcttcctcctctcattggcaatgcaaacacagttctgcaccctccaactcctactctgagtgggcctcacaccgccggcagaattccattagtatataatataattcaatctgcattcaacaaagaccaagagttattgagccctcccaagtatttgcaataaaaatggaagataactgcatgaataattgtcactctaatatcaatttacaagttcacattatacctctttgtcgacaaggccgaggaactcttgatgctccttgctaacggactgcaatataaggaagtcagaaaaagataacatcacctgttgttttctcaacgcaatgttagcgctcctttcataatataagcattcttcctagagtaacaacagtattcatgctcttctctaattgaatatgcaaagaacactgatttttccttatcaaacaaaggatgctaccatataacatttaaaatgagtagaatcatcaatacaaatttatcaatttatgtgccaattatgatcatcaacaaataggcgattagcctaatgaaatactctacataccagcaaagattgccatctgctaaatccttactgaagcatactgaaaagccaaatctcctcctggataaaaggaaactatagatttagtcatatattttttcagattatcaagctaaaagagtgccataagagatggcaaacttcaattgtgaaggaatgcagtgtggaacagtaagcccataaaaaatttccagtgtgttctgataaccatttagaacaagtattccctctttcactactattgtcattattatcatacgctcctctcaatggccacttataaatactttcattgtttaattgtgtagaaggaacagaaccagaagaaccattgcaggttattccacttcatttaaaactctatgagcgtgttgcacaaattgattgaccctcttagtcaatatttcatttcatttgtttagcataatattgtttagtataatacaccattattataggataaggagtcaggggagcatgtaggatccaaagtcagcatgcccaataatggcgtaccatcgaacttgatacgatctataattggccagacttacgactacctccctcaaggtacgttattgtatgacatgtgtttagtatcatctatctataactttttgtcatcagtaatccctttctccctttttattttacagattatgtattaaccaaccaggatgttactgctcaagacattattctggtatcatctgaaaatgagacgctggtgaacatgggaggtttttctgtcaaaaaacatcacctatcgtgccttctcactaaagatgaatgggtgaacgacgacgtaagtacaactgcacatgagtatacaacgttaatatttatttaattgtcaagttcctaaatattttaaattgaatctataggtcatcagtgcgtacatacactgaataaaggaggcgcaatcaaagaccgataagaaagtgtattatgaaaacccctttatcattgccatgttacaacgagatgcggtctacataatagatgaacatatagacaactttattacaaatatagtgaagaactatctttttcatgaactggtaaagtttggctctctaaatttaataggatttaagtttgttattatatgcattattgtgtactaattcgatgacttgtttagatttttctaccaataaatagaggaaatattcattggtatttagctattctcaacccccaaaaaaaagtgatacatgtacttgattctctctgtgaggacttcgatcgtgttgacctccatatagcggtaagtgtatatggcatattcaatcttttgtttatttagattgcaattcatttttctattgctaatcgcaaatgtaataattgaatagatacaaggagtacaaaaacatcttgatatcattacacggcggcaggacttacctagccatgaatggatagatctaaatgtcgtgacatggctgatcatagaacaattacaagtcaaaattcaactagatgggtatactacaaatcatatctcttggaatattaaaataagatacatgatatattttttactggtgcattcttgttttatttttaattaatgtttacaaaattgtagttcttcttgtgggctcttcatgctcaaatttatggagttttttgctggagataaattttctcatcctgttacacaagtgaatttcttagcataataacaaaatattagatcatacattttatctaattttcctattaaacgaagttatgtttactatgcagaaagatattgaactttttaggtacaagttagccggtatattactgtgttggaaaacaaatatggcggccgaggcttccaatgttgaacaagtcgaagatacagacaatgaagatgatgttgtgatagtgggcagtcgtcaaagagaaagatgggacatgaaataatctaaagtacgctcggcaaccaacgatctcgaatatagttccctcctctcggtggtttcttgtaacaccctgaaaattcgaccaacaaaaatcaaaactctaaaaacatgggccttcaaaaactttttaaataaattgcatcatgccgattttattcgcccatttcattggaatttggtttcaaagtttatagatcacgaagaaggattggttggaaataaataaaatattatcgcaaccatattagtaacaattgaattctagtgcaacggaatcaaaaattagcccaattaaaaattcaaataaattaaataaattaaatatgggtaatattaatcttgggtgaatccattggttggaataacataaatattgagtaaacctcatttatgcaaaaattaggatttatagaatagaaattatataggaaataggctaaaattgggataaataggaaaatacactgtttattgcactctaggtgctcgacgaggtccctagccctacccccttctctgccgcgcgcgcctggccgccccgagccccgcgccaccgtcgccgtcgcgaccgtcgcgccctgtcgcctctgccgcgccgcgtgccgtcgccatcgccgcccgtcgccgtcgcgtccgtcgcgtcgccgcgccgccatcccatcgcctcgcgccccgcgccgcgccgcccgccgtcgcgtcgccgctgccgcctgtcgcgcgtcgccacgcgtcgtcgccgtcgccgtcgccgtcgctgtcgccgtcgctgtcgccgtcgctgtcgccgtcgccgtcgcgtcctgtcgtcgctccgagccgtgcgccgccgctgccgcgccgtcgccgtcgccatcccgctgccgcgccacgcgtgccgtcgtcgcctcgagccccgtcccgcgcgtcgcgtcgcccgttccgtcgccgcgcgcccgtcactcgccgcctcgcgccgccgtcgcgtcaccatttaaccgcccccctctcttccctctcccctttttccccctctctcccctataaaagccccaccattccccactctccccaccccattccctcctcctctcctctaccctctccaccgcgccgccgttgtgccgccgcagtcggtaagccgccgccctcccctcgttctgccgctgttgcctccggggagcaagagccgagagagagagggaggaagaaagaaaccggggggggagaaaaaaaagaaagaaaagaaagaaaagagagagagaaagaaaaagagagaaaaaggaagaaaaggaaagaaaggaaaagaaaaagaaagggggggaataaaataggaatttgagggagattaagaagtttagaaaatttagaataattagaatttaattataggttaattatagcctagaattgtaaaatgttaatgtgattataattatttttggtaatctctgtaagaggtcgattcgcggtaggaatttagatttatttaagaagtaaataattatgtcgaatttctatgaatgtacttccaaatcccaaaatgacttaggttaaatgacccaacaattcgaataaagtggttccgcaaactttgtagtcaatttagaaagatcgatttgcgttcgacttttatgtgagtcatttggattttatttgaattctaattgaattcaaatcatttcttcgcacgtaattttagagcccgagggagttgcggatccgagcgagggtcaagacccgcaggacttcgagcaaggcaagtcatcaccattctttgaacatgttgatcccaattgcgaaattattttatttacaaataagattgcatgcaatgatgaacatcctacttgtgattatgccatgtcttgattattgtttacctttaaatccatgtaaccataattacgtatgagtccttagtcaattatgacacatccttagaaatgctactctagattcatgcacgctcatattttatcaaatgctatatgcttgggaaattacctttgggaaggtaattgagatgcggcatgtggagacatgagcgccacattgccatgatgatgatgacatgatttgtgaaagtaggaatgaaattaaacacttgttttagactggggcagacggtggatttgggtggtatctgggaaaggctagtaccgtccccgatcaattaaggaccgagccatgaagttaagcatgaaacgacccccgtacaaccgcacttctcgtatgggtatagacctagcagattaaatagccgagcggaggcagtatccctgcatagatggttcacccctgagtgaggcaggtgcgctaccgtgggacagccgttgaggtagggccgagaggcgtgccctacatcggtgtcgccatgggtaggactgccatgagtgcgtgagagagagaacttaacctgaatcataatttaatatgtgtgagacgtctctttcccaggagcgccagaactcctctcactgctagaaatgtatgacgcctagagtgcatgagggctaaagttcatggagcgggtactgtcacaccctaaaaattcaaaatatataaattgttgtttaaatggaatttttagaaataattttaaaagtcttgaagagaagatctaatttttaattaataaattccaatataaaatggggccagataaaatttcattaaatactttgcttaattctataattcctagatttttctaggatttatttgagctaaggaagtatttttaataaatggaattgcatttaagaaataatttaaattgaaaaaggttttaaaaagtcttcttttggctttgggccaaaagtcggcccaaaacctctctctctctcctcggcccagccggcccagtccgccgcagccgcgcgcgccctcactgtcgctgacaggtgggtcccgcctgtcaggttcgtcttccccgagccgccgtcgcccggccgaaccctagcgcgccgccgccgccgttcccttccaaattcggccgctcctttccttctccggccgaatcaaaagaggggaaatgatccttgagatctcctctaccttttctcctttggaaacttcggctaaatcggtttggaaatcgatggattcgagttcgaatcggatcggcttttctctctccgagctcgagctttcgttctcgtcgccggccgccgtgggccttcgccgccgcctcctagcccctttaaaaggacccccggtgtctcctctacccgccgccaccctcgccttcgcctctcgtcgtcggaaacgctctagcgccgtgtgccctaacgccgccgtcgtcgccgtcgctccagccgtgcgccgccgtcgctccagccgtcgctgtcgctcgggaagaccgtcgtcgtggtcgccaagtcatcgccgtcctcgtccgccccttcgctgtcgccgaagatcgccggagcaccatcgccgccgtcgacccgaagaccgccgccgtttcttcgtcgtcgccgtcgccgtccgttgatcttccgccgctcttttggtcaccggtgagttcgccgcgtcgcgctctacccgttggtggcctccgttcgtgccgaagcgccgccgttcgccggcgagcgtgcgccgtccgagccgccgagccgccgccgccggtggtgacgtcaccgctgacgtcatcgtggccgtctgccgtgagccgccgtggacccgatcgatctcggccgtccgttttggatgggttgatctcggccgtccgttcgcgtgaaccgtcgcccgtgcgcccggtccaccgaaaccctagcccgctgacgcaataaatcccttttttccttttcaaaaataattcattattgcgtcataattcaattaaaatcaatttaagtgttttaatccgattaaatcttcaaaaattcataactaattcatcttagctccgatttagttggttcaagtctctaaatttttctaaaattgagatctacatattaaaaatatccacatgtactgttcatgcttgtttatgtgctgttttggtgattttgcttctttctgcttagattccgtcgtttccggagagtccgttttcgtcggagaagagtttgaagagttccaaggccagcaaggcaagtcacacagatcccaaacaaccctttgagcatgttgatcctatttaaagctattgtttctattcaactattgcatttattttcgaatgtcattgggcggaattaacctattgtttgttatagcccttttggttcttgtttaccttattccttgataccttgggttgttataacttgactagttgagctttatttattggttcaactagatattagatataattgcttagccctccttagaaacattagcacactattgggataacttatgactcactgttatttaatgatggcttaatgataattcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccagccacacgccagcatgggcaacggctttaccttttgtatagcatggttcattgcggggcaccagactgagaagtggcagagataagcccacgggggtcgctggggagtccatgccttgattataagggggtgattatgatccaggaaaggtgcgctgtaatggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgtggttatgggcgggtctaacaatgtctttcgtgattagtctcacccttctcaccataatagaagatgctataactggtaataatttgattagctcctggtttggaatggtatattcctggtttggagatagaactgtgcagccgggatggttgttcaaaatggttgggcctatacaacagggtatgttgtatagcgttggattaatattgtttaattacttaactgttttattaaattctcaaatgtttgctaaatgctgcttttgcaaatgagccctatactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcccgtggagtggagccgtctgcgccgtttatcttattttccgctgcttagatctttattgaatgagaggaactatctacctctgtaatgacatttgattcgcttattaattagagtaataattgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttacccatagaagccctctaaaaagattggaaaagtagaactgttctcctccctttctcttctaattaaaccaaactaatggcacatgcctttcataatctcttttaatggttctcactcaaaatttattccagtgttattagtactgtacatctattactgtactaatggctcatttaccagcaaaagttttacaatgttgttttatttaatcttgctgcaataaaataaatttagcatgatgattttataactttcttttatttcttttgaaacctgttgttcaaaagtacaaaaattgtaactttgtttccaactgtttcaacttatcttgcaagtttggtttactttatttacttaccttttactttgatttcctaactttattcaaattaatccaaaaacttgtgctattaattggataaatgtcttaactccctcctttcacttgtctttagatgccgcgctacaagcctgagtacttgtttggtgttgagtgttttgtccaggagttgtgtacgatgtcctttgtcattggatttgggactgcccctttttatgcccagattcctcatgatcgtcacgaagagaagtgccgagtcaaagtcaccttgaacagtaatagtgaagatatcccctcagtaatgttcgaagctggaggaagaaactacatccatgcatgtcaggaggtggcaaggatcgccataggagagctccgcgatcattatagtgatcagttggccgacactgagtatcgctaccatcctcgtcaaccccagggaagtgaccgtggcagttaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagttagaagacaaggtggatcgtttggagaaggaactagccacattgaagggagaagcaccaccgcagaaggccaggattcgtcttaccgcaaggaagagagctctatttgtccctcgctatcaattggcgccaaaggttcgtgtggtggagaaagaagttaccccagccttagcagatcctccggtcatcatcataagtgatgatgaagaagaagaatccaagcgcaaccattccaagattgagtgggtagctacccaagatgatgaagacgagccgaacgaaccttcaatcgacctccgatgctcggaagaactagagtgacttgttaagtcgttgtcttagatcgttgtgttagtttgcttgttttaagtttggttgtgtgtgcctcgcatgtgatttacatcagtggtgggatgtaagtgcatgtgtttgtttgcttttgagtgttaggaagttggtgagtttagtggtgtaagagtcttcagttttgtaataatgaaactcacttaagatcaataaaagttaaagtaattctctgtcctaagtagtttcccccggtttctcttcttgtgccctgtccatgccagatggtgaacactcgcagcaacgggaatggccccaacaaccccaataacaacaacaatggagagaatcccacacttacccaagttcttgttcaacagactcagttaatgaacatgatgatgcagcaactccagaatcagcaaaaccaaggaaataaccatgcacctccccagaacaagttagcagaatttcttcgtgtgaggccgcctattttctctagtaccactaatcctgttgaagctggcgattggctgcatgccatagagaagaagttggatttgcttcagtgcactgatcaggagaaggtctcatttgcatcacatcagttgcatggcccagcctctgaatggtgggatcacttccgccttaacaggactactgctgaacctatcacttggcttgaattcaccgctgctttccggaagacgcatataccatcgggagtggtgtctctcaagaagaaggaattcagatcgctcacccagggatctcgctctgttacggagtatttgcacgagttcaatcgtttggctcgttatgctccggaagatgtgcgcaatgatgaagagcgtcaggagaagttcttggaaggacttaatgatgagctttcttacccactcatgactggggattatcatgatttccagaagttagtggataaggctattcgtctggaagacaagtacaaccgcatggagcagaagaaacgccggattgctcaattcaagacacaacaggggaataatcagaagccgcgtcttactttaggaccccagaccatgccacatggaggttcttcatctgttgttcgtccgcagcgtcagttcttcaacaacaatgctggcaataacatccgtaatcaagctccacgccctgttgcagctccaacacagcaacaacctgccaagagggagcaaggcagcaagcccgtggtgtgtttcaactgtggagacccaggacattatgctgacaagtgtccgaagccctgacgcgtgaaggttgtccctgcccagaataactctgctgtaccagcatcaaaggcccgtgtcaatcatgtcgctgctgcagaagctcaagatgctccagatgtgattttgggtacgtttcttgttaactcagttcctgcaacagtgcttttcgattctggtgctacgcattcattcttatctatgagttttgcgggaaatcatgggatggaagtagaagatcttagacgtcctttgatggttagtaccccaagtaatcaagcactctctttgcaacgtagcccctctgtcagaatagaaattcaaggcgtaccatttctggccaatcttatcctgttagaatccaaagaccttgatgtcatcctagggatggactggttagccagacataaaggtgtgatagactgtgccaacagaaaagtaactctcaccagcaatgatggtcgagttgtaactgttcatgcattgtcttctgagtctttaaggtcaagactgaacccaataactttggaagagattcctatagtccgggagtatcccgatgtgttcccagataatttacctggtatgccgcctaaaagagatatagagttcagaatagatttggtacctggaacaactccgatccataagagaccttatagaatggcagccaatgagttggcagaagtcaagaggcaagtagatgatttgcttcagaaaggatacatcagaccgagttcatcaccatggggagctccggttatttttgtggaaaagaaagatcatacccagaggatgtgtgtggactatcgtgcattaaatgatgtgactatcaagaataagtacccgctacccagaattgatgatttgtttgatcagcttaaaggtgctactgttttctccaagatagatcttcgatcagggtatcaccagttaagaatcaaagaggaagatatacctaagacagcttttaccactaggtatgggttgttcgaatgtattgttatgtcttttggacttaccaatgcccctgctttcttcatgaacttgatgaataaggtgtttatggaatacctagacaagttcgtggtggtctttattgatgatattcttatctactctcgaaccaaagaagagcatgaagaacatcttcgccttgcattggagaagctacgagaacatgaactatatgctaagtttagcaagtgtgaattctggttgtctgaagtgaagttccttggtcacgtcatttcagccggtggagttgccgtcgatcctagtaatgtggaatccgtaaccaactggaaacaaccgaagacagtttcagagatccgcagtttcctaggcctcgcaggatattatcggaggtttatagagaatttttccaagattgctaagcctatgacacgactgcttcagaaagatgtgaggtacaagtggtcggaagaatgtgagcagagttttcaagagttgaagaatcgcttgatatcagctcctattttgattttgcctgatccaaagaagggtttccaggtgtattgtgatgcatccaaacttgggttaggttgtgtactgatgcaagatgggaaggtggttgcctatgcatctcgtcagttacgtccgtatgagaagaactaccctactcatgatcttgagttacctgcagtagttcatgcgttgaagatttggcgtcattatctcttcggtactcgtacagagatgtacaccgatcacaagagtttaaagtatatctttactcagccggatctgaacatgagacaaaggagatggttggaattaattaaggattatgacataggaattcattatcacccaggaagggctaatgttgtagcagacgctcttagcaggaaaggctattgcaatgctacggaaggacgacaattgccattagaattatgcaaggaatttgaaagattaaatttgggaattgtcagtagaggtttcgttgcagccttagaagcgaagcccactctaattgatcaagttagagaagcccaaattaatgatcctgatattcaagaaatcaagaagaatatgagaagaggaaaagctatcggtttcttggaggatgagcaaggaactgtatggttgggtgagagaatctgtgttcccgacaacaaagatttaaaagatgcaattctgaaagaagctcatgatactttatactccattcaccctggtagtaccaagatgtaccaagatctcaaggaaagattttggtgggcaagtatgaagcgtgaaatcgcagaatacgtagcagtatgtgatgtttgtcagcgagtcaaggcagaacatcagaaacccgcaggtttgctgcagcctttgaagattcctgaatggaagtgggaagaaatcggtatggattttatcactggtttacccagaacgtcatcaggccatgactctatttgggtaatagtcgatagacttaccaaagtggcacatttcattccggtaaagacaacttattccggaagtcgcttagcggaattgtatatggcaaggattgtgtgtttgcatggcgttcctaagaaaatagtgtctgatcgaggcagtcagtttacttcaaatttttggaagaaacttcaggaagagatgggttctaagctgaactttagtactgcttaccatccgcagacagacggacaaaccgaaagggtgaatcagattttggaagacatgttgagagcttgtgctttagatttcggtggaagttgggataagaatctaccctatgcagaattttcgtacaacaacagttatcaagctagtcttcagatggctccttacgaagcactgtatggtcggaagtgccgcactccgcttttgtgggatcaaacgggagaacgtcaggtttttgggacggatatcctaagggaagcagaagaaaaggtgaaaatcattcaagaaagattgcgtgtggcccagtctcgtcataagagttatgccgacaatcgccgcagagatttgagttttgaagaaggagattatgtgtatcttcgtgtcacgccttgtcacatcctgattttcgtttcaggatttataaattatttaataaattaataatagaatttatattaagtgttctttaatttacaagtgaagttaaatgtgggaaataaaatttcctaaatataaagcatggatggatttaatttttgttaaattctccatggttaattatactctctgaaattttctcggatttttcagagctcaattcctaaatgatacaaagaacagttcagtaattatttgatcattaatgatctaattatttttgttaagtgcttttcttgtttaaaatccttaaattataaattgttgtttaaaaggaataattagaaatgattttaaaagcctggaagagaagatctaattttaatttgctaaatctcaatataaaattgggctagataaaattttgttaaatactttgcttaattctataattcctagatttttctgggattatttgagctaaggaagtatttttaataaatggaattgccatttcatgaataattttaattgaaaaaggaattaaaagtctttttttggctttgggccgaaaaccggccccaaaccc

SEQ ID NO: 71007 - DNA, 3221 bp, Oryza sativa
tctttcgtgtgatagatcgattttttgatttagacaaaatttgacaaaattttgtctaaaatcaaaaatagtttgtgactaaaaatagtgcatacaagaggtgtaaagccaagcaaaggtggtaagaaagaagtacgtcatatattcagttttatgtattattttattttatgttatgcgaataaatattctgaaatttgtttatgttgttttaaattttcagaatggacgaatcaaacattccatcgttcacgttaggtgatttcgaccctaactacgtgtcgaggtcattcccaactagtgagtatgatgccaccggatcagctccaacaccaccagttatggagccaccggcgggttcagaagcatccggcactatgagtgggagtgcatcgacgaacaccggctcaaagagatcaagaacttccggtgtttggcaacatttcgatgaggtggccatgacaggccctgatggaaggcatgtaacattcgcgagatgtagaatatgcaaaaataagttatctgcaaaatcatctggtggaacaggacatttgaagcggcatgccgaggcttgtgcaaagaagcaaggaatccaactacgacagcaacaactactactaaatcctgatggtacggtacgtacgtgggagtatgatcctatggtagctcgagaaaatcttgcccgtttaattgctagacaagatttacccttgaactttggtgagagtcctgcatttgaaaattacataaaaaattctcataatcctaggtttcaagctgttagtagacaaaccacaacccgtgatttgaaaaatgtctatgacaaaggttatgaatcactgaaggaattatttagtacatgcaccttttctgtcagtgtcacctcagacatatggagtagtagggctaaagaggattaccttagtgtagttgtacatttcattgatgatgattggcaaatgcaaaaaagagttcttggcttaaggttaattgatgtttcacatactggtgaaaatatagcagagagaattcgagaggttattgatgagtttaaccttgcagataaaatttttgctgtaacaatggataatgcatctgcaaattctagggccatggaaattctacaaccattattttgtatttatgctcaatcatttcttctgcatcagcgttgtgcatgccatatcattaatctaattgttaaatgtgggtttaagagagttaatgtacacatcgacgctgttcgtcaagcaatcacgtggttaactgcttcaaacccacggattgcacagtggaaaaggtattgttgtgcatcgggtgagcccccacgtaagtttttaaccgatgcagaccatcggtggaatgccacttattttatgttaaaggttgtattaccttacaaggatttacttactgttttccttcaaacacgtaatggcccaaaaaacagtgacggccagccaatactgactgatcatacctggcacattgttgaaaggttcaatcaatttcttgaaacgtttcatgactgtactcttctgttatctcaagtatattatccaacagctaatttaattttgcataatattcttgaaattgccactttgttgaaagagtatgaaaatgatgaccttttaatgcccgttgtctttaatatgaaacaaaaatatcttaaatattggaaagacatccccatgttgtattcttttgcatttattcttgatcctaggggaaaattacggggattcctcaatattctttcacttattggagatattattaatgttgattattctacctattatgctgatgtcaaaactaaattctatgaggtatttcgaaagtatgaattaaagtttcagggagatcgcttgtaaagacccccacctgtccctgcagcaggtaagaaaaaattacagtggagcagaatttggggcggttcatcttctagccatggtggtggtaccagttcatcagcagcaagtggggacgctagatcgcatggtcctgctgaagagttgtccaactatttggatagcgatgccatcaggcatgaaacgtcagacttcaacgtactcgggtggtggaatgatcataagatgtcatatcctgtgctatcaaaactagcacgggatgtgttgacggtgcccgtatctttggtatcctcctaatcagccttcagtctatgcggaagaattatcgaggacaggagaacaagtctgagcagcgatcatgtggaaatactattaagcgtcaaagactgggaacttgctgcagaacatgcccaatacactgctgacaaccaagaattggccgcacagttcgaaaacctttatttagatgacgaacaattagggtagctagtttatattttttaagtattgacctgttggctgtactcttttctttgtcatggttttctcaaatatgagtttttacatgacaaagtttttaacgaggcagcatgtatcatgtaaacatcaataaaggtcattactcttttttccccatatttttctaatatttttctaagtctaattatttttctatttttctccaactatccattaattttctcttagcttagttaactttcggacctttctctttgatttgaattgttccactgacagagtgacaggcgatagacacacggacagaggcaagtcactgagtcagcattcagcaagtccagcgccacgtgtctcccttcggccggccggtcccgtggccccggccgctcgctcccgcgtgccgcgtccaaattttcatccgcgcgcgcgccttgtcggcgttgtcgccttgccagcttgcctgcagtcgatcgtgccaacgggccgaccacgacccatgggccattgacgtgcccgtgccggcacggcacgacacgacgttccctcgggccgtgcttgggccggggagtaggcacgtgggccggcacggcacggcccgctacaggagtcgtgcctaacgggccgtgccctagcgggccgtgccgctggcgtgcccgtgccgtgctgggccgggccgcccgtttggccaggtatactctcggcgcatcgccaccctctttcccgaggtttttacttatcttccggcaggatttgggcacctgacgcggggctgcatcggttcagttcgatctccggcgaaggggtaagtcctacgttccgtcgggccctggtgaatctgtcatctacgtcggcatcgtttaaggctac

SEQ ID NO: 71008 - DNA, 688 bp, Oryza sativa
tggagaaaatttagatcattggtataggatagatgaatacatcattggtaagatgtaaaagtgtacggatgagagatgagtaaattgaaacggtgaattattatagggcagatgggcggataatcactcagttcaagtcctcctcaattccggatcgatcgggagatgacgacggcatttctcgaaagcggcaaagatggtggtcaagatgggcttagcacgctcccagacgacgtcattgtcggaggcctaggcctgcgggacgttgtcagagcgagcgtcctctcccggcggtagaggcgcgtccctcatctgctctcccataggcttgacatcgatgtcgcagacttcatgccgcatgaccatggcgactcctcctcgtcggacgacagacaccggatcatgtcggcgtatgctaacgcgacaaggtggttgttggctccaagcgcggagagagccatcaagagcgtgtccctcagcttcctcatcgcggagccttacctgctgcacgccgtcgcccgcgccgtcgacgacctcctccttgacggcagcaacagcagcctggagagccttgagatggacatgtggaccgatcgggtcgctgccggcgccgcgaccctcgaacagaggcgcctcttcggacaacgcttccagtcactcttcgacgcttacccggccccgttcaggt

SEQ ID NO: 71009 - DNA, 1206 bp, Oryza sativa
tttttttggcttttatagcttctttgtactgtacttgttaatgcagttttatattcccatgaagaaaacattagcttaaactggaaatatacaaagatggaatgtgtttaatttagtagaacacaagttaaattcaatatagagcatatgcaaatacaaatttacctccaaattttcaagagctttctcaaatttaagtgccaattcaggtatgcagcgcatatgcatactagttactaggttttgtactggcagtacaacctttacaaatcctggatgcgacgtggccttcgtcttcttgggccatattctttatagtatagcattatatatttatgctcccttttggatttccaacctgtacttttttcaggctgtgcaaattaccatacaaatcctttttttttatgatttcaggagaacaatacgattgaaattaaaagattcgataaggataggcgtcgagattttgtgcagatgctgaagggatttattgtaaatcaggtataagaatgctccactagtatttggcgagacaccatgattattacactgtatttatccgtagtgaaagaagaggtgtatacatgtcaataacattggtatatattactgtgtgcaggtttcatattcagaccattatgctaatatgtgggcaaaggtagcagacgaaactaaagtgtatgcaaaaaggagcaactgatgcggcttgtgtatagctagtagtaggatcttggtttattttgatttgctgactataacacttgattctccccagttttgccaccatgcggttcattgtattgctacatttgagttagagagagtttgggcgaatgggcttctcggtgacaattgacatacacgacatatttttccccttattttttttctcaaaaatccatttccctcttctagaaatctcttgtgcattttacggtcctacctcgtgaaactgatgtatctggtttgaattttgccatggacgcaatccatggtatatacaacaggcactttttcacacgtttctgactgtcaaggctgaggcctgaagatccagtggctggtatctttgcttatccacacacgtaagcattgtttcttcagtctacctgttgtctcgttgtatgctgctatgcatatgcaatcgaaatctcaatcttatcgatgtattaccacactgggagctacataatctggtcgatt

SEQ ID NO: 71010 - DNA, 2855 bp, Oryza sativa
ccatgagctgagggaacgcgaccgtgtcgccggcctcctcgaagcagaaatcgtggcccaagctcaccgtgttcaccagatggtttactgcatgcatcaatattaataagaaattcagaggtttgattaattgcaagtgatgcgtggtacaggtgactgacactggccgaagaagctgatggtgtcgccgacgagcctccggcagtcgtcctccttgacgacgtcggcggcgatgacgaggacctggccggcgccgagggcccgcgcgttctcccgcaccgcgaacagccggtgctcccgcctcgccaccagcaccaggttcgcgttcctccgcgcgtactcgtacgcgatttgctgcatgcaaacaccacaccgatgatctttgacgttcgccgaccgggcactggttatatgcttagcttaattacctctccgatggcggaggaggcgccggtgatgaggacgaccttgttgtgcatgttctccacggtgagcgtcttgacgacccactccacgccgcgcaggaaggagagcgtcggccacgcgaacgccagcatcaccatgctcgccggcggcaccaccaggtccagcaccgcgttcaccacctgctccatctcgatcgatcaatcaatcgatctctcccacactatacagttcctcttccgatccacagctcaatccaatccaattgaaagaatggatcaaccagcccgcctctggtttctggggttcttgggaggtgaagaaccgaggaggaggaagaagagggatcaaagatcgagtctctcaatgagtttgccaatttggtgaggacgatgagcagataaggacaggagaggacggacgggtgcaggcgtgcatggatggcagctgcgcaggcatgccgccatagacacacgtcgagcaggacgggaggcgccacggtgagaccacggggggaagaggcaagctttggccgctttcaaagccttgttccatatgcctttctcctccgatcggctgcatatattactcctccaccttaatccgcgcctactacaacatttacagttctgatcagatacaatatgcatcttgatgtgaaatcagagaaagggcctgtagcctatggttaatctccataatttgccttagaagatgttgtactgtgtaatttttttttttaaaaaagtcaatctccaggatttgacacagtgacgaagacctgctgagcggtgagtgactcatgcatgttagtcctccctcctttttttttaaaatagacgatgccgtttatcattcggtctaatttaaaatttttgtgcaaatacatatgatatcaattatgcttaaagtatttttagtgataaaatatctcacaacaaatatttttttaataagacgaataatcaaacgtgtgcttaaaagtcaaagtgtcctttattaaaaaacaatggtagtagtatttgcatgtgactaaaataataataaaaagaaattggtaatatcaattaggatgatacagacaaatatacaccaataaatttgatctacaaataaagaaataaaagtaataagatcagacattgaacaatacctatacaacgtaaataaaatttattatttttaattttttatgtatagatcgaatttagacttgtatatttatacaatatcttatatcttatatcgcgtgcaggcgataacagttagacgtagaaaatatttccctgtttacacagtgtgtaaactgtaaagtaattttgcacagcaacccttcgtttaccccgtattattattttcacgcccgtattctggatcgctaccactcgtcccgtttaaccgttggattttacatgggcggcctggatcgagaaggaggagggcggcccacgcgtatttctacgtgagcccttcccttttggaataactattatctttcacgctcctcccaagctttcgattctgaaccagaattccacggtgaatcgatcttccgacgccagatcgacgcgagttgagagacggccgtgctcaggacggcggagcgccggcgagatgcggaggcggcggcgccgccaccacgcgcgctcctaggttactttcctcttttttttttctctctttttgatgcttgtcttcagatgttcagagttcagaggagttagccaggtagggctcttgtgctacgtctgtgagagcttgtgtttagaactttagatcaaccattttatgtttttttttgggtgaaacaattgttgtagcagggagacaacgccctctctcctatccggtcgaaacatctaagatggtttatggaaagttcctaagtgtaaaacaaggaaaacactctcgagttggaaaacactctcgagtggaaaaacactatcgagttggaaaacattctcgggtggtttcttatcacttatatgtaactcatcttgtttggagatgatttctgaatacatggcaggtgaatctggcgatcgggaagttgttgaaggatgtgcaaaccctcaatcatagaagacattcggctaagagagctcgaaggaaaaaacctgctcgagtaaagatccggtcgaatggaagattctgtgggggccgtttctcaaccactcttgccagctggagccaaaagactagaatgaccctgagaatgtactaaaatacccctagggttgctgacatggcaagggcattataggaagatcactaaagcccatgagggtagaaatgtaacatcacatgtaagaccgtaggctataaaagccggtcaagtccctatagctagaggagacattttttaatacaaaaagtaatcctctaaagtggtgtttgctgtttgagcttatttctaaggataggtaggaaaa

SEQ ID NO: 71011 - DNA, 1723 bp, Oryza sativa
atctcctgaatgtaatcctttattcttgttgcatgacaccacattttgacaattacaaataggatcacctcaagcaatccaatggaaacgatatcgatggccactagaaagagcaacatcttgatgtaaaactgctggaatctgtcgcggagacttggatagattggccctctctgacagcaccagcaccagctccagcctcatctgcagccaatgccttcttgctgatgatccggtagatctcagtgagcactgtctgaaaagctttatccacattcgtcgcgtcgagcgccgaggtctcgacgaaggataggccctccctctctgcaaagcttgttgcgtcctccaaggacactgaccggagatgcttgaggtcgatcttgttgccgatgagcatgacgacgatgttggagtcggcatggtcacggagctccttgagccacctcttcacattctcaaaagttgtggcctttgtgacatcatagactagcaatgctcccactgcgccgcggtagtatgcgcttgtgatggcccggtaccgttcttgcccggctgtgtcccatatctgtgcctttacaatctttccttcaacctgggtcacaaaattgaagcaatttaacaatggacctttggggaaacaatagtactgaacataaaaataaaaatctgtgatatcatggataacagcctaacaggatcataataaaaatctgtgatatcatggataacagcctaacaggatcatgtattcatttgttgtatgcagctaattaggttctctgattatgctttaaagcaagtgagccactagccagtgttagtttcctgtcaatctaaattcgcgtgtactgcaattcagtttgtacaaaatttcaacaaagaaagaactatcctttggccattttatttttttttttaaaaaagaattctgctttggcgtaagcaattgcactgtacccatcgatgaaaaccaaaaggagggactgatttccaagagaaagcgaacaatagttagcaaatcaaatagagaaacttgctgaattcctctgtcttctactagctctgaattctactgtcaagcatgggtgtcaaactatcaggtcagtcggcgatcgtggtcaagcccgccggcagcacgcatgcacaagggcatcatccaattcgagcaactcaagaaacattcagagaaagcagtaacagcgaagcaccgaagcagaacacaaacagagcaagcactagtaagcagaggagatcaggagaagcagaggagaagctagcactagcaggcatggtgacctggatggtgcgggtggcgaactcgacgccgatggtggacttggagtcgagggagaagctgttgcgggtgaagcgggagaggaggttcgacttccccacgccggagtccccgatcagcacgatcttgaacaggtagtcgtactcgtcgccgccctgctcccacggcgccggccgccgagccatcgatcgatcgattcaacctcccttctccttcctcctcagattttcgcactttcttgctgctttcttggagcctccgcctccgatctccgttccctcctccttcccgagaagctagctagcttcttcttcttcttcctctggctggctacttgcagctttggtttcttggctttggacgggaagacgcggaggctgatggcgacctgatcgatttttattggggaagagagagagagagagagag

SEQ ID NO: 71012 - DNA, 5424 bp, Oryza sativa
atgtcactagaacagtggattatgtcactagaacagtggattaagggctcatttggtttggtgccctaccaaatcattggtagtgtcaaatcatgggcaagatttgatactaccaatattttggtatagttggtttataggagttgtattaactttgttaaattttgacatcaatccaaacatctataaggtactattcaaagtgctaattatttggtagggcaaattttggcatcaaaccaaaacagccctaagtactactccttccattccaaaatgatcaaatttgaactaaaagagtgtacttatttcaagacggagggagtagatcagtaaccaaataaattttaaatcgtaaggtttattagcgataaaaaaatactttgtaagtaaaacttttatatatgtattattagcgtcttaaaagctaatgttaaaaaataaattatgatgataaaaacatcaaaatcaatttaaagttaagttttaaaatataaatgttagttgcggctagcaagccgaagagcaaacgctggtgttattgtgtgaatcaaaatgatcaaaatacagtggcggagccagaatttttccaaacctagggcccaattagttgagtgtatatgattttgcctttatcttctagtttttgaagttttaaaatggaatttcaatgaatatttagaatcaggagtagggagtagggctgcagccctagctgccctactcctgtctccgccccctgtcaatatagcaattaaaatgactagagatatgaaaaaaactatatataggtactgtcataatggccatatgttgaaaatatttatctcgggtgcatgtaacattttttttctagaaaaagatgtagttactatataacaatttacacctatggtataatgtgttttcagagtagtttcgcaactttctaattcaattttaactcccaaatagcattgttgacacggttatcccttgcaccagtaccatcaaccttccgcactaatggcaaccatggtaattggatgtggacacatcagtgtaatcctaccaatattccactatgaaaaagaaaaaaaaagattccaaaaccaaaggcacaattttgagaccaccctatcaaggataattctgccattctgctgagctgggaagaagatttgatcagttggaatagggaagatggtattggaatcattctaacttccaaacagaaacacacaggctctataatattaacttcaatcatgacttgacctcaaactaacaattaaacaaactcccttctgcctttgtttccgtgattgaaagagttatggatggtcgatgaacaggcaggaagaaagaaagcaatggaaaagagcaagagaattaacggctggactggaagagaacttttaaagacacgctttcgatgagaaccacacaaattgcccggcttctcacgagttaacaatctgcagcttgcgtgtaaataaaaaggggaaaaatggaaataagaagaggggaagatgccaccgtgtcaacccaagtatgcataaaaatggcgagggctatcatgcacatgaaaagtcaaaaacacacttgcaatagcattatccgacacaactcatcactgattattcgttcaataatagcatcactcacaagcatacaagcatacgtttgttcctttaataatgtttgcataatcatagggtatgtttggctagccaatagagccgctgcacgcagccataactgttgcagctacagacacaaacagtacactgtttgtgttggctgcacaacagtgaagttaagtgcagccgaacagagccaaaatcaacaattaatagtatcattttttaaaagacccaattactccgtcagacagacagtagcatgaaacggaccaaaggaagcagacttgcagaatagtgacattagattgatgaaggccaggagcagaagtgcgtgtgcgtctgtggtccgtccgatcgggcatcggacggtccagatggcgcgggaggttatggctggcgtcttcgtgcggcggccgcaccacacccacccgttgcgttgcggcggcctctctctctctttctctcctctctctctgcggctgcgcggtctccacggcgcggcgaggcagcggcggtagggatggtgggctcggccgcgtactccgcggcgtcggccatcgtcgtggtgatggccaagggcaaggggcggggcggctagtatgcggcctcctctggcgccaacaaggtcagctcattcctcctcccctcaggtaccaacagtttgggtaatgggtacagtatgatcgaattcagcgcggggagtttggattgaactgaatgtgcctgtgaatgaacattgctgcaagggattagaggaattatcagttacgaatcattgcttcacaaaattctggggcacccacatggaaggggaaaaacggctgctgtgcgtgctcaaccatgcaaaaaaaaaagagttattcatgaggattgagttatgttttttttgttgttgtattaatcagaacatttagtgtggtacattctcaatttaatagcacatttgttggattatcaacaaatggaagatcttgtattggacccatgggtaacaggtcggctttatggctttgcgtcctcacacatgacacgctgcctatttatgtgtaggtttctgagcgacggcctcctaggataacttccaatgtgaagcagagcttgaggattctaaaattttggaaggtgcaagctttgttgcattaccttttctctcatatgctaaaatctgtgatctactctgctgcactttgtataaagtcgtagaacagcatgtaccgaattcatcaggtgggtatggccaaacaggggcacccgaagcatccaagattaatcttagttctaacagttatttacccttgtgtgtgccttttgtattcttaagcttagttctaacagttatgcccttgtcatcaggattatgaaaggaggcaaacaagtggacctcagcctgctactcggtaccgcaaaaagaaagtaataaaagaagtgcttcctgatgacacagacttctacgatgatgcttcttccactcttcactagtcaggcttgcctctcattgcattatcaggacctcactacattttttgattggtggttcaatgaaatgctgacattgttttgtcaattaatctagcacaaatcagggtttggaaattgcttccccggttattcttgtggacggttataatgtatgtggctactggggaaagcttaagaaggacttcatgaatggaaggcaagagattgcaagacaaatgctcattgatgagctagtatctttcagtgcagtaagaggtttgtttgtagtaggaaattagatccgttacgtatggtctcaagcatgatttccttaaaactcacttatgctgtttacttaagctgtagctgttgaagctgatagatgttagtatactctgattagatgttaggtacttcttatctctattagagcaaacaccagttcaatagtggcttatagtgaaaaaggtagtcatggcttacaaatgtatcatcttgccaagtggggagcataagtagatgatgatttgtttttatctgccggtggtgcgtaatttcttctcaatagctatctgatgttctcccattccagcattcttatatcatttgtcattgtcatgcttgcagagataaaggttgtagtagtatttgatgctgcagcctctgggctttctacacacaaagaaacctataaagggtgagataatattgtgagctgatatatctgtgggaattgttacttcaagcagtttagcctgtagcgaaacttaacaaatagattttacttcatggaatagggttgatgtggtatattctggtgacttgtctgctgattcttggattgagaaggaggtaatgctgataaattcttattcagaacaaaggatacccctagttgaccagacatgtgcatttaccgcagtgcaaaattcacacgtagatttaaattaagcaacaaaagcattgatttatgaagcatgcataactggatgtctttatgccagaaaatagttgggtccgtttcaccagcagtaaggctccagtggtgggccttatactagttatatttttataccaaccgttcaaatacctggtgcttatgcaaaagaagatcggtagagcaagcataatttattcaagggttgtacactaatactgatctcaagtgatgcactcttggctcttacctgctgtattttcatccatgggcattaatttctcatattaacatggtaacactaaatttccgcgcctgtgacatttgaattttgaagcaatgagcttcaaatttctgtatgaaagcaagatgtttctttctctgattctttgaccaacacaggttgaagctttggtggcagatggatgcccgaaagtctgggttgtaacatctgatgcattggagcaacaattggcacatggagaagtatgttgtcacccttttggggattagctgcttctatcatatctgcctgccgttagacatttttgaccggtttatggtttagaacttttatctttttgtcatgttctgcaacatattctgaactcacagtagcagaaaacacattttgtatcctatgcatttaatcaccaaaatttcccaacgggggtccgaaaaacacaagtactggatgttatatgtccaaactgaatatttccttcaaaagagtaaaggcaggaaagataattgataattgatatcttgacatttccttcaaaagagttaaggcaggaaagataattgatatcttcaaaagaggaatgtatcaaacatgcataatgtgaatctcagaagtgaaacttatatctcctataggattttgctttgtggttttatcatcaaatgttttattcttgatggttaaaaggttgttcccactgtgtagggtgctcttatttggagctctaaaagattggtcaaagaggttagttcttaatcttttttatcctgcacacattacttgctcaaatagatgctcttcacttgaatatctgattacatgcattgtgctggtatagcatccttatttttggaccaaatgtcttgttgtaactatggtacaaaatgttttatattgtttaagccatgctgagtaatcaacaagatacagatggctgacctaggactttcaccaccagcctgaggcctgggactaaaagtccaatgcgttgcatttttttcactgtgatgctctaaatgtgacccaatacatgctgggctgcccagggcttgacgccaagttgggtctgcctgagtaggcttgaatctccaattcaaacagacatactgtaaatacgctattgaaaattaagcataagctgaaaacattactttgcaaaa

SEQ ID NO: 71013 - DNA, 1291 bp, Oryza sativa
tgggcaaacaaaggatcggggaaacgaaagcatatatgcaaacgaaaagtaatatgtgaataaaacttttatatacgtgttcttagcgatataaaaacaaagaataaaaaactttgataaaaaacctcaaaatattggaagtataaaatttggctggtaaacgtaagcataagaagaaagatgaggctcgagggggtggacgtgccatgatctcggacacgacgcggggctgcttcagcggcttgaggaggaagtagaggacgcgggtgacggcgacgatgaggacgagctgcacgccgagcagcggcagcgacgccgagagcgggctgccgccctggaagatgttccggccggtgcccgtggtctgcggcacgacgtagcagtcgatcttatccattcccaacgattcctcggcgtctgcctcctctgcatccgcgccccactgcgcgcgccggcaatggcgcggtcgccgcgccgctggctcttcttgccccccgcggcccgcccgcctcgtcaggctgctttggccatggcggtttgctgcaacgtggaggggatgagtggtcggagggcgagaagagaggagaaatcaatgacatgtcaaaaaggttcagaacttggtatcctcgagaatatattaaactcagtttgtttagctccatttttgtggctgtaaattgctgatgctgtagagagttcctgcaggagaatctatgttgttaataatagtaaatctaaaattggtgtagtgtacttttactgtggcttatacagatatgaatcaatgaacatatccatagaaatatggaattaacacaaaacagtctatgcttgatgaagataataactggataaattacactttgaactacctctagctcactttacatttgttgtactttgaaacacttctctcttctctagctaatcatatttatggtatccacctgaatattctctagccatatttatcatatatcctcccgtaaatgacagtatgtttataggttgacagtatcacgatttgtatcctagcatcttagaatactacgattctaccatgtcgaaatggtaccgatcccacctagtatcctaattttcatagtatctcaattctactattcattactatacgatcctacaaaatctttggtggtatccagattctacgatccttacgatattacaaaatattatttaaaataagatgggttaaaaataatgtaaataaatatgcttaagtttatataaaagtccggtaaatatatcaaaaccaacgtggcttctcttg

SEQ ID NO: 71014 - DNA, 1655 bp, Oryza sativa
gtatgagaataagttcaccatatcggatttatgatgtgattcaattctttttttcttgttgtttctttttgagagaatctattttataccactgagcttgctcaagttcaacaatttgccatcaacattgtcgttttctataatataccgacgactttattaattgttctacaatacgccattgggctaagtattcttttcaaaaatacctaaaatacccctatggatatatgaggttaacaattgatttatctaatttgaagtttcaaaaaaaaatgaaaactttcatgtggccttcttatacaacatggaaatttgtatagaagttttaagttttttacatttctattttttaaaaaatatataacttatttgttatatgctatataaaaatacttttttactattgtttttaatataaatcatctttcatacactacataagatatttttattctattatgtcttatataagcaaattctctttcacataccacataaaaatattttttctaaaaactaaatataccagaaaaaaacttgaaacttgtatacaaacttccatgttgtgtaaggatgccatttaaaaattttcattttttttgaaacttctaatgagataaatcaattgttaatcttgtatatttctaagggtattttgggtatttttgaaaagaaggcccagcccaatgacacattgtagaacaattgataaagtcgtcggtatattgtagaaaaagataatatcgatggaaaatcattaaacttgaataaactcagtggtatagagtagattctctctttccttttttgtttgaaacttagatccttttcatttgaaggtatacacgttatgtgatgtgaatggtagatacgtgattccatgagatttgtgattcagatatgtcttttgtcttttaatttgtcatggtagatattcttttgtcttgaagcatttccgttttgtgagtagtcccacactcccacatgaagcacataaagactgcatgtaatttacagagtttatagtttctataatcctctaactcaaatccggctcagcctgttttttttttcgagagctcagcctttttttactcgttcgtcacagatgagcccttttcagtgccgagaacatagagccacggtgccagatccaaatctagcactgttggcccttttggaaccgacactgaattagtgtcgtgtggtagtgaaaggaaaacacatacctgaacaatgcatcctcccagccctatcccttcgaagaactgatgaaatgttaacgcggccacgagcggtctgatcgtgcttgggctctcggatgcacctagtgatatcccgatgataatcgaatgcactatgatacccagctcaaacaccttcatccacacatgcaaattcatatcaaaccaagaaacgtatgaacattagcaaatttaaattaattaacgcgcatccatgttcatctcccagctatatatatatatatatatatatatatatatatatatatatatatatatatatatatatatatatatatatatatatatatatatatgacactcatatggggcaccatggttgcccgggcaccatggtttcaaatgcacaaaatcactcaaatttttcaaaattttcaaattgtgagt

SEQ ID NO: 71015 - DNA, 6897 bp, Oryza sativa
ttcctggtttggagattagatctgtacagccgggtatggttgttcaggatggtcgggcctgtgcagcatgggtgtgtgttcagtgttgattaaaatttctgataaactactctactgttttatttctcttaaatattttgctaaacgctgcttttgcaaatgagcctatattatgccatcctttggtatccttgtgcacttgcatatttgctgtgtggcttgctgagtatgtcatatgctcaccttgcaataatcaatcaaccttagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatcgttgtaattaatttgatgaatctgtatattaaattgtcagtttgtgtacctcggctgattcctggacgaggattttatgcacaaataagttcggaaattactagtgaaatttcgggcgtgacaagttggtatcagagccatctcgactgtaggataagccaaatggtcaaaccttaaggactatttttccgacaaaaaggatttgtgaaaatttctcctttcttccttatctagaattctttgcaaattgtttcattgtctactctcctctctcgttcaacttgagtagttctaaaactagttgtggaaactagaagacattgatgtggtcaacttatggaggtcagtcaagtggatcgaggaaggaccgaagtgccaagtggtcaagatggaatgaagtttgcatcctaccttagaacctatgccgccaaactatccttgaagaatagtcagtaggatagaacgtttgttgcttgcttgtgtgtaggtatggttgcattcccgtcattggtgtggttcaatgatgagtgtgtaactatactaggttgcttgcttaatcaacttaaacaatataatggtctacacacatcagatcagtgttaacctagttaaggtcttgtctttagtgtaacccctctccttctatcttctctaatttgcaatagatggtgaacactcgcgccagtggaagtggaaacaataacaatgaagggaacccaactcttgctcaagttctggctcaacagactcagttaatgaacatgatgatacagcagatgcagaaccagctcaaccaatggaacaacaatgctccaccgccgcagaacaagttagctgattttcttcgtgtgaggccacctaccttttctagcactaccaacccagtggaagcaggcgattggctacacgctattgagaagaagttggaactgctccagtgcacggatcaggagaaagttgttttcgcttcacatcagttgcaaggacctgcatcagaatggtgggatcatttccgaatgaacagagcagaaggacaaccaatcacttgggcggacttcacggaagcattcaagaagacacacatacctacaggagttgtttctttgaagaagcgtgagttcagggcattgaagcaaaaggatcaaaccgtggcagagtatcttcatgagttcaatcgtctggcacgttatgctccagaagatgtgcgtactgacgaggaaaggcaggagaagttcttggaaggtttaaaggatgaactgtcagttacgttgatctctcatgactatgctgattttcagcagttggttgacaaagcaattcgacttgaagacaagaagaacaggatggataaccgtaaaaggaaaatgactgttttccaggaggcacaaggtagtagccagaggcagcgtatcaagcaactccaaattggtgaatcttcttctgctggtcaaggacagtcgcaacagttgaatatcggtggtgagatcaaaacagagactaatgaaagcaatgaagttaacatcgagcaagctaatcagctggtgccagttcagcaggatcagtctcaagagaataacagtagtggacgggagcagcaggtatgtttcaactgttacaagccaggccactttgcaagagagtgtccgaagccgaagcatcagcggccgcaaggtcaggtcaacaacatgtcgtgtgctgagattcctgcgaccagagataaccatgtttcatatcaatcaagatgattgctaaccatgtctaccacgcggacaagattgctaacaacattgtcgtcacaggagccaatgcagtgccagttgcgtcttcaagagttgtgtcttcaagtgttacaactcagccaccagtttcaaagcagcagtagttttctttaaagccttagaatgattatcggagttatggaataagatagactgcagtttgcctattccctttttctttctagctgttccgaatctcgggacgagattctttgtaaggggggtagtttgtcacatcctgattttcgtttcaggatttataaattatttaataaattaatagtagaatttatattaagtgttctttaatttacaagtgaagttaaatgtgggaaataaaatatcctaaatataaagcatggatggatttaatttttgttaaattctccatggttaattatactctctgaaattttctcggatttttcagagctcaattcctaaatgatacaaagaacagttcagtaattatttgatcattaatgatctaattatttttgttaagtgcttttcttgtttaaaatccttaaattataaattgttgtttaaaaggaataattagaaatgattttaaaagcctggaagagaagatctaattttaatttgctaaatctcaatataaaattgggctagataaaattttgttaaatactttgcttaattctataattcttagatttttctgggatttatttgagctaaggaagtatttttaataaatggaattgcatttcatgaataatttaaattgaaaaaggttttaaaagtcttcttttggctttgggccgaaagccggcccaaaacctctctttctctctccctccccggcccagtcggcccagtcggcccagtccgccgagccgctgctctcctctctctctcagccgctgacaggtgggccccacttgtcagggtcgtcgtcttcgtcgcgccgctgccgcccgaaacactagccgagccactccgccgccgctttccaattcggccgcgtctttccttctccggtcgaattgatagaggggaaatgatcctcgggatctcctctaccttttctcttttggaaacatcggctaatttgttttggaagttcgtggaatcgagttcgattcggatcggcctctttcctccgaaccccgaagtttccatctcgtcgccggccgccgtgggcctttgccgccgcctcctagtcgctttaaaaggctccccggtgtctcctctacccgtcgccaccttcgccttcgcctctcgtcgtccgtagcgccctagcgccatgagacctagcgccgccgtcgccgctgtcgctccagccgtgcgccgccgccgtttcagccgtcgtcgttgctcgggaaggtcgtcatcgtggtcgtcaagtcgccgccgtcctcgtccgctccttcgccgccgccgaagaccgccggagccccgtcgccgccgttgacccgatctccgccgccgcttcttcctcatcgccggcgccgtccgttgcccttccgccgttgttttggtcaccggtgagttcgccgcgtcgccctctacccgttggtgccctccgttcgcgtcgccgcgccgtcgttcgccggcgagcatgcgcgcccgagtcgccgccggtggtgacgtcatcgctgacgtcatcgtccccgtctcccgtgagccggtcgtggaccgatcgatctcggccgtccgttttggatagggttgatctcggccgttcgtttccgtgaaccgttgccgtgcacccggtccaccgcaaaccctagccgctgacgcaataatcctccttttccttttcaaaaataattcattattgcgtcataattcaattaaaatccatataagtgttttaatccgatttaatctttaaaaattcatagctaattcatttgaactcagttttttgtggttcaagttgcaaaagttatataaaataaagatctacatattaaaattgtccataaattgaattaaatttatttaattctttttaaatgggctttaaatagatttaatcttgtaaaattcataataaattcatatgaagtcagaatgaggccgttcaagtctcataattcatctaaaattatgatctacatgtttgtttactttttatgtattgtttatttggtttttattagtcttttccttgttttgcgtgttagcttatcgtttccgtcgttgtgaaggttcgcgagtgcgtcggaagtgttcaagaagattaattgaagaccgattattgcaaggcaagtcacacagatcctaaacacaatcctttgagcatgttgatcctatatttaaattctatatttatttcaactgtgtatttattttcgaatgtcactgggtggtgtgaacttattcctttgttatggccaatttgcattgattattttattccttgataccttgggttattataacttgactagttgagctatatatattggatcagctagatattagatatgattgcttacccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcacgagctactattgtgaaacattaaccgtgccaaccacaagccagcgtgggcaacggctttatcttttgtataacatgattcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacacatggtagacatgatgttgaggccgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggaatggaaaattcctggtttggagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatcattgtaattaatttgatgaatctgtatattaaattgtcagtttgtgtacctcggctgattcctggacgaggattttatgcacaaataagttcggaaattactagtgaaattccgggcgtgacacgcctcttcgaggagttcatcgttttcacaccaaaggaaaattggcaccgcgttttgtgggaccttataagattgtcagtagaagaggagaggttgcttatcagttggagttacctcaatctttggcaggagtccataatgtgttccatgtgtcgcaattgaagaagtgtttaagggtacctaccgaagaagctaatcttgaacagatagaagtccaagaggatctgacctatgttgagaaaccaatccgtattttggaaatagatgagagaagaaccagaaatcgagttatccgtttttgcaaagtccagtggagtaatcactcggaagaagaatcaacttgggaacgagaagatgaattgaagtcagctcatccgcatctgttcgccagttcttccgaatctcaaggacgagattctgtttaaggggggtaggtttgtcacaccctaaaaattcaaaatatataaattgttgtttaaatggaatttttagaaataattttaaaagtcttgaagataagatctaatttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaacccctctctctctctcctcggcccaaccggcccagtccgccgcagccgcgcgcgccctcgctgtcgctgacaggtgggtcccgcctgtcaggttcgtcttccccgagccgccgtcgcccggccgaaccctagctcgccgccgccgccgttcccttccaaattcggccgctcctttccttctccggccgaatcaaaagaggggaaatgatcctcgagatctcctctaccttttctgctttggaaacttcggctaaatcggtttgggaatcgatggattcgagttcgaatcggatcggcttttcttt

SEQ ID NO: 71016 - DNA, 4711 bp, Oryza sativa
acatatataaaagttttacccataaatttagcctttcatatataactttcattggtaagggatggcaattttgcccatgggtcgggtacccgcggatacccgacccaatgggcatgggcgtgggtgtgattttttacctgtggacacgcccgcccgaaatccgtagacatcgtgggcaacagccgggtttcattttttgcctatgggtaacccatgcccgactcgatacatatgtattagctaatttcgacttatctcttaattcttatacccccttctcttgattcatttgtgatactaactaatactaataagttgtgatgtaattcaaattattgttgataactgataaattggtaaattgttgattttatttctctttgttaaattatgtatctttcgagttactattcatgtgagatccattgggtacccgtcaggtataccagtgcccgtcgggcatgggtgcgggcacagagttttgcccgctaaccctagtgggtagggtttggacgggcgacgacgggcatgggttcaggcatggttttgctctacccgtgcccgacccgacccgttgccatccgtaaaggccgctaaaaatttaatacattactacgcaagtattttcttgagacaaatgtacgtgcatacgtcctatccaaatattcaataagaacgccatcaatcaaactcctccatgaatcggtagccagtaatcaccacaggattcacggctggtgtacatcaaccataactatgatgacagcttccataaaaaatggagtggccagctatttaccaattttcttttccagttgtgcctacctctacatcaataattaccgcacatcttcaggatctgcaacgattatgatgcataacaatcacaataatgggaggtaacaaaatatgcagaatgatccccaggcttggtcttttctttaccttcaatgttcaccgctcgggtatttacacaagaacaaacgaaagaattcacatgtcaatggaggagtactcttgattagactaaatttcaagctaggtcactgcttacgagaaagcgaccgaattttagctgcttcaagatctgagatgtaacatgactacattcctagttttctatagacgagacaaaatgaccagtttgtgccacattactgtgttccgattattctgatgttagatctgctctacatccagaggggaatgcctcccttgagtttgttttcttgagaaagagttctttccttctgtatgtctgatgaaaacctgcggcgtgaaagataatcattagaaattagtctcagaatttggaaatgtcccagaaggaatgctatctcctgattagaaacaacatagcttccttatccagtatatgcaatgagcttagtatttgaaatgctgaaatttccagatagccaaactagttggaaggtgtttctctgtatcttctctagcgaggcaacagttaatgtgttgaattgcaaaacaaaaggctataatttcaatatatgttacacactatcaaatacaggaactccaaaattcacattgattcagacggtgcagttgcaggtgccttaagtaattttcctatacatgcatataagtgaactccgtaagtaattattatgctgataaatagaaaaggtaggaatggacacaacatataaaaaaaaaaagatgtacagccattcaacagatgactgcacatgacgcagatctattaacacttgatatatgttatggtcagtgccaagttatggtgaatcatatattagtagagaacatgatgccgtagtcacagggactaattaaattcagaatttcctgggtttatgaaatatttctgcccctacaacatctcaattttatccatcaatgtttgtgtgcccaagagtgtgaatgtgaactgtgaagtatcattaccattgagtttgggggtatctaactacaaaatacagggttcctgaatttacagtgtagaagacttgcctacatatcgtacaattttgagtgtatctgtttgtttccatgctctgctcatcaaaatttgcaacattcaatcgtgatgactgatgagctgatggtgggactgcttcggagttagagctcagaagtcagaaccctaaaatggtacagtaactaaaatgagaaagaaacctgaaatggcaccatctgaacccagtatttgattgctgtcatgtccgtctgccataaggcacttgatcgtcctacatttattataacacataagtgcatatacaaatcacattactacagtaaaatgttgattctggcaaactctacaaaagtactagaaatgcaaagtaagcatccacctgaaatatattctggtacatccactggactctagagtgctctgctgttgatgtagtttggccaaactatccaattttaagaaattatttacttctttttgtcagttgcacatgtgggagaaaaatcataaatggaaatgcaagcttcttgttgaaaagaaaaaaaaaacctgcatagtgttgcttggatgcagctgattgccataatggtgtgggtggctagactgcaccccataacggctatcaaaagatagctcatttggattaacttcttcctggaaggtacacaataaaaagtaactacatagtcaagactatcataccaaacaatgtacggaacaaaacccagcatcgatcataattactaccataaggtcaacaacaccatttgtcctgacatgagtaccaagatttgaggcagtagaagaagaatgaaaagcatccttctgactaacgtccgatgataccagtaaagaatccttcaatacaagaatgaactcgattagtacaaataacaaactagcgtaaagtacacatagtcgacgtaaggagataccttatgggcatattgatttgacacggactccacatttgtatctttactctttttgggaggacggccacggcgcttttttgctggccctccctcagatgagccagcttgcatgtggctgtcaccattaatagcacgttcagatggtgtaagttcttgctccaattcccggcacaaattatcatcaagaagggtccgtcgtatgtctcttattaattttaatgcatgctgatgcttctcatctgatgatgctccaatctcaacaagacggaggcactgcaaagaaacataatcatagcgctcaatatgattacttgttaccaaatccttccatggattatctaaggcgtgaagctgcttaaagtcattccgccacctgttaagcacataacaggggggtatatcaaaaacatgctgacatttaagcaccgataatgtatgccgacaaacaatgccactgaactggaacaggccacagttgcattccatcctgtcggtctccatacagtgaacgacttcatattttttattcaccatttctccgcttgactcagctagatcaataactacaatggaggatgttgaatcatccaactgaacttcacaattcatggttgcgttcagctcattctggagtttagtgaacattttaaaggtgtatagtctagatagctgttcttccataggaaacttcgatactagcaccctgcttctactcaatgactcaagatcatcatcttcctccattttgtatttgttctgtaaaagattcacatagctgctaaggaatgtcaccaatttggtctctgggttgattgaatcttcaaagaaggcatttggactctcatggtggttaacagtagataacccagcccagaaggtatctttcagaaaggcggggacccagaaatggcgattttcatacagaaaagtgatccattcattatcctgaaggccaaatctactgatcaagttattccaccttgcctcaaactcgtcatccttcaaggaatcatatattacagtttccaattcggtcttcattccttcaaattgtgctgattctcctaacttttcagagatacttcttaacacatgccaatcacttattcgatggcgtgcatttggaaatacttcacgaactgcggcttttatcgcggcacaatcatccgtaactatggcattcggaggccatcctttcatacaagtcaaccacgacttcagcagccataagaagctttccgtactctcatccgaaaacaagccacagcctaacagaacaagctcaccatgatggttcacccctaggaacaaaacaaggggtgtatcaaacctatttcttaagcaggttgtatcaatccaaacagcgtcgttgaaatattggtacgctgccctggacctcgaatcggcccaaaaaacactcctcagatggccttccccgtagaaatccatgagatagaagaagttcgcctgcttcgcctgcatatccgcgaaaaagccattgatggccgctacatcatcttccccaatcttgagcctcccccaatcatcgaatatcgggacctcgatgtcgccggaggtcgagcattcccctctggcagccctcaccaccagatctttactcatcccactaggcaacgtcttgtagcacctcaggaaccgcgccgcggagggattcagcgcgtggttgtgctccagattgacatccatgaggtgcagcaggccatcgctccagagcctcgcgacgacggtggcctggcagttggtcttggccgtcggcctcgcctggtagcacgcgtcctccttcccgtccccc

SEQ ID NO: 71017 - DNA, 566 bp, Oryza sativa
tggacacggaaaccagggtttgtcttttttttttgggacggagggagtacaccttaggaatatggcggtacagtgtgcacccaagaagaaaatatctcccctttatgtcagatcggttttctagtagttgtctctcttttatctcttctagggctgtgtttagatccaaagtttggatccaaacttcagtccttttccatcacatcaatctgtcatacatacacaacttttcagtcacatcatcttcaatttcaacaaaaatccaaactttgcgctgaactaaacacaacctaggctttgttcggttaatccctttcacaaaatgattgaaggggaattagagataacttataccactcctattgagatgtgaaattagtcccccttcaattcattcattatagggatgaaccgaataaaccctagctaggcgtgatttgatggtgtgtgcaattatcaataagttattattaaattactccgattccattatgttccgccatttttcgcgtaaagataaataaaaaatggcgtcaactacaagtcaattagtactactagtacca

SEQ ID NO: 71018 - DNA, 1901 bp, Oryza sativa
gatccatgaaaatgtttagataggcccacgtgtgaaattctaagcctccgcgtatcctattttgaactatttccttctttgtttcgaacatctatttgaaaggcaagctcatgtgttgacttaaaaagtttatatatagaatttttctataaaatgaaataagtgtttgtttgttagttatagccccggctcttttggctctacccaaaagggactatagtggctagagtgggagcggagtttagcttgctccaaaacttcactgcgtacttatttttttagttaaatttatgagttcgagctctatcaaacataccataagaataaaaaaacaatttatcaaaagattgaagtgtgtggtcaatccctaaactcgttgatttatatcatctagatcctaaactctcaaatacatttgtcattccggtcctaaaatgccataacccttccaagatcctacgtgacatatcacacgggtgtttgctcttttttttttcttcttctcccttttctcttctcttcttccttcctatctgtgtggcaaaaaagaggaaaaacaaggaggaaaaaagagaaaaaaaagtagaggagaaggaacaaaaataaaaagaaaatttgggttccgaatgtttatggagtgatgctatacatacgatttgccgtttacaatatttgtacgatgaaacaacttgtgtttattagcgtagatgctggtatgcagccgttaacccagtgccatgaattcttgtcatccgcgttagatcgtaccacgatcgtaagttcaaatcgtacgcatagcatttttcaatgtttttgtgctatgccatgttgtggcaatttataattgaaagacacagtttaataagttcggatgcctaaaactacattttaaaaattcaaaaactagatgacatatagggcctgtttggcacaactccagctccagctccacccctcctgaagctgaagctcaaccaaacagtttcaactccaccaaaattgggagtggagttgggtggagctctctcacaaaatatactagagttagacccaactcctagagttatatttaggagttggagctgtaccaaacatacccatacaagcaactgtgcaattttcttaaaaaaacaaaacacccatataattcggtcaagcaggccaccactcagattcggcctttcccagcacgacaagctcacaaacgttcgccgattagcctttccaatatagtactcccttcgtttcaggttataagatgttttgactttggtcaaagtcaaaccactttaagtttgatcaagtttgtagaaaaaagtagtaacattttcaacccaagacaaatttattatgaaaatatattaaattattgatttgataaaactaatttagtattataaatattactatatttgtctataaactaagttaaacttaaaacagttcttgaaacagtttgactttgactaaagtcaaaatgtcttatgacccgaaacagagagtagcatagtttatatagctcggtgcatggcgcgcacattttgtaccatataaaatttcaatgtcagcagtatgaccaattgtaccaggttactttgccatcttttgtcatacattagtgtaagatacgaatttgttgttcgcgtgtacagcaatcggagccaacggagtatttggaagtttctaacagagtacacaaaaaagatgtaatactatacaataaacaggatcgaagcccctctctaaaaaaacaaaactgatctaagcaaatcgtgcttggtgtttctcttctcatcctttctgcgcaatggcatggatcattcccgcacttatgtacattgcaattggcaagtcatagcccgagattgatcccaaaatctggttatgcattgctctctcgc

SEQ ID NO: 71019 - DNA, 1898 bp, Oryza sativa
aatcgatccaggcactacactaaatgttgttttcttctctctattttcttttttttttaaaaaaaaatctattttcctagcttttttatctcgttttctatgtgcacgcttctaaaactggtaaacgatatattttcacgaaaaaattatataagaaagttattttatatactttttttttaaaaaaaaacctaataattaattaatgatgcacgagggattatccaactacaagagccaaacacagcttcagatgttgtatcaaatcatagtgctagaccatttggagaaggagaattaatttcacaagcacaagaaacccatacgcaagttctgttgattttttgtaaaaacgaaatcgttgaaagaggacaggaggcaagtagtgtcagcgacagatgggtcccactaaacggtaggtataagcgtcatccaaaacccctcttcccttttcttatcccctcccctctcctctcttctctccttcgcttcgccaccgcgttcgccatggccttcgtctccgccgccgccgccgccaccgccgccgccgccttcctccccggcgtctcgtccgcgtcccgcgcaggaacacccttgctctcgctgcaacggcagccgctcgcgggttccctgcgcgcggcggcgcaggggtcgagcgcctcttcggggcaggtggtgatggagagcaaggtcaaggcgaagaagaagaaggggtccggcgccgggaacctccccggagccatcgacgcggagatcagggaggcgcaggactacctcgccatcgacgagcaggtgagagtgagacgcgcgctcttctcttgcgcgatactgtactactgtcatcgaaacttgactgatttggcgcgccaaatgagatattattttgtcatattggacagtgattttgtcttgtggggatgatgaatttttggtgaggttttgtcaaattatagtgctgtcttgcgtgaatgctacacgtcgactggtaactggttgataaataatgggcatctctagctaattgaacactacaattgggaaatatatttacgattgctttcacctaaaatagattacttttgcagtctcgttcggcgcttctctcttaatacagatcaattggtgactgatgacgtattgttacttcggtatgctggtggcagttagagaatagagaatttgttcatcttactcatgcatcgatatcttctatttatttattttatcttaagccattagtctaggtgtctgaattctttaagtgatagtttattggcaattgtttattgcaactggcattcagagagttgttaagactttagatttattccctgcgtcagctatgcaatgctcatctggttttcaaggatcctataactttcttgcatctattttgtcatgtttgacctgaatgtctggagagaagtcttatacccttgtgtaagcaaatcgtttcttaagcgttttccttgtttcaaatcattgaaccattctaatgattcttttaaagcggtatgactttggaatagacaaatagtgggactgatgatagagtttgtgatggtttgggttcaatattttgatcaattggaagctccaggcaagggcaatattagaactggcattgaggttgaataatcctttccgcataaccctgaaaagtgaatgaatgaatggacatcaaagctgtaaaattacctctgcaggtgtgacatctagctgtaaaattgacatgctggtttgacatcaaggcatttaacatctgttattgaatattccaaaggtgtttcatcttacccatttatctttcttgcaacaggaacctgttccggaaaacttcccttttgaaatccttgacgaagaagggatgagtgtggttattctgaaaagggactaca

SEQ ID NO: 71020 - DNA, 1923 bp, Oryza sativa
aattaatttgtcatatgacctctaagaccagtaccgtactgacacaaaaggattgatttgacgcattccatgtccatgatccagaaaggcagcttataaaagttgtagaatggttttatgcttttaataggttaccgatgttctggatattcatgcttagcattttattgatgttgtagcgatgttgcatgtatggtgttcttttcattatacagtagtatatgagtatatcacatcatggaatataatttcaattgcattctgtatgttggcagttacaaatatgctgttgcctattgactagtattgcttagtctgttaggctgtccattaatgctattgatggttacttgtttggagaggaatggaataaccgttgatttgtttgatgttatgcatgcattagtattttctagaacacaatataaataattgagctatatcgaaggctagaagtttggtgacatggactgttttttttcacaggcaaagttgcggagttcttcgtggtggtcgcgatactttatccagactggcttgagagagaatgaagggccattgaagaagtttgagcaggctgcttccaagaacaaatacaaaccagactgtcaaatcttccatcttagctcgtaggcgtgttctgatctaggtgatgtgtatccatgaaacctggatcgttgcctcgccggttttgtaagcaatatcctgtttacccccgttgacttgcgcttcttttacacggaggaattgtcacattaagagccagccagccttgagcataggtagcttatgtagagagatttgccacatgctgctagaaaattcttcctggaaagttaaattatgtgttaccaagaggtgcaaattgaagccctgaggatatatatgtaagaacttcacactgttgtaccctgttattcttcttggtgttacagttattcctggtgaaccagctgcagttccgtgagcagtttgtaatgtactcagttcaagagagagagaaaaaatatatatctaccctttgtctgctactctgacctagtagggtgtcattctcacgacttggatgatgcttaaagtcgacccaattctttctattgggatacctgagaacgatggttcaccagacttcggatttagccttttatcttttttgtcttaattatagggttagttgaggcctcaattgcaagcttcactaacaaacacagaaaaagaagagggaaaacacaacaaactccattacaatatacccttttgaggtcaggtaagatgtcccttgtcttcaaaccacatctgtgcatcattttttccctttttttttgtggctttcccttccttcaagcacaaagccattgatattctttatatgattatataggattggtctccctcccctaacacccagaccagaatcagcagaagctgtcctattttaaacctaattccaatcagaaaccagcagtcaccacaaaacccaattgccccctgatttgttcctgtgtgacaccttaaattccaatagctgtttcatcacaaaaaactaatgcaccttgtgtgtccccctgaagtgtaaacagcatctttgttctgcttacaaaaaatccattttcctatccacaagtccacaggcatgcgtgcatgcatcccatcatcatcttctccaattgatgtggctctctcatttgaccatttccttgtgctagctagctagtagcttagctgagcaaagctaagccagttgttatccactaatcagcattgattagtttagtcaaaaaaaaaatctcaaggctcaccttattatactaatctgcagttgtgcccttaaatacccacacgcctctctttcttcctctttatcctttgcagttgcaccaccaaacagagacagaggtagagagggttcttgctttgcttagc

SEQ ID NO: 71021 - DNA, 3710 bp, Oryza sativa
taccacgtagcatgacctcaaagaaatttaactcctcatcttctcgaaggtagagatcagctggtcgtatttgcatctcgttcccctgcaaggaaagttcagatgccaacttggacattggtcagccagaaaccagagaacatgtctgacaacagacatttggacgagagaaaacccaacacaacatctttgcacgataacgtctctatagccaacaggtaaagtcaatggaattccctatcgtagtgccaggttcagacccctagtatttattttaaaatcagatgctccgataaaatattattaaatgatgacaacttcaacatcatttgcatatatgtttgtgaggaaacatgtgatcagattgttatagcctttttaggagcaactctagttcatacaatagacgatggagccatcagctctgagaatcatacctgctccgcaaatagctcctccaagacatcatttatttgtctatcttcagcaaccattgccaatgccatgctcactagttcatttgatagaacatagtcactgatttttgacactgacaataaattttttgtcctaggatccagaatctcactgattatgacagatttatcagatgcttgttgcatctccccaatccaagaaccttcacagaagcttcctcgagtaacatgtgaaaccatcgcctccctgaatggaagtcgctttgcctgcagtagttaaaggtgtgagccaactatctttgtttaaatgcaaaatattctaatgtaggcttgagaaatgaaaaatagtacatgatcgaagacaactgcatgtgatcagagatatgatctaaagcaatcctaagtaaaatccaaaattgaacaacagtttaaattagttccccatggctagagagaacctggatatccctgatcagcagtagtgttgcaagcgaccttgaatcagcttggattgctgaatcctcaacagattcatctgccagaatcagtatctgtgtgttgcatataagcatcagccggaggaaagaagcaagcaattgtactcataggaaggttcaacagtactgcttttttcctaaaggaactacagtctatgttctcagaacttacagaatcaaatgattctaaagggaggctctccaagtgacggcgaataacagcatttccttcacggtgaaccaaagtaatattttctagacgactgaagtccaggcctccgtctatcagctttctttctctgtccatctcaggaacgtcattgaacatccacaactctgaccctggcgctagaaaagcatcgagtacctgaatacctaaaaccaagtcacactgttgctctagatcgtaattaaatgcattatccattcatcaaaacaaaaaatcatgcactgcaacgtacatcatttggtaatcatatgttgctatataaacataactcttttttttaagaaaaaaaatgagcatatataaacaaaattctcatagtacttacattttcaaatggacaggcctgcattttttgatggacattcagtacaaaagggtttgaatatattttttattatactaaatgcaaaaatataaaaagaaatgtatgacaattggagaagccaagcacagcatatgattatagatgtttaagttaatgcaaccatttcaacatatgtatcaaactacagtattaactcatggggaaatcatgcaaaacacactatagttgctcatgatattagagctaaccatggatctgatcatgtgaagaaacaaaaggccaaatgccagtacaaactcactagtcactacaaaaattggacagcaccacagtgggataaaaacactgagaaagataaaacacagggcaaaaataagaatatcaggtctgttttccaaaacactaagcacttaatggcacattggcttgttccatcaaccatgctgccgtggcagtaattagaaataagtaaagctcagaacaggaagggatattatatcttttcatagttttgacacaggcaaattttggctccaaaacctttagtactaccatagcaataggaatattatattccaatagaggacacaaaatgttgttttcgatctatcatcaagttaccattatcatatcttccatatcacgccgccaaccacaaaacaatattctttcaggagacttgggaacaacaaaatctttaggtaggtaacctctcataacctgcagagttttacagaaaaaggaatattaggagcttcaacgaaaggcttaccacaatcatatcatctatatcccgtcgccatccacaaagaagaatcttctgaggatttctttcggggtgaacaatgtctatgtaaacagcttctttaacctgaataataaaattgacttcgcttttgtaagcttcgttacaggatgctctatatatgtgcagtatctatgttagaactttcctagtaagttagctagcttttgtagttttaggcttttagcaagtaacaacaaaggctaatactaccaccatcccaaaatatagcaacttttagctacaaatctggacatgcactagtccagattcatagctaaaagttgttatattctggaatggagggagtaattgccatctataaggcataaattgactcatgcagttgtcttttccggtgcttaatgagcaaagcaggagaaattacttttgaattgtgcaaaagcaatctagttccagttgggcagaagctaaaattctattgacaaccatgcggttgtctgcacttatggatctcaagagcctaacaatattacaaggagaagaattcgcataagacaccattggaagaactcgtgtgaaatactacagagttttgaagcaattaggttgatgcagtaagttgtaaataggatatggctagtgattcagataaatatatcaataaaagatgccaaatggtaaatgagaggaaatagcaatgagcttaaaaacaacgtcaaccaagatgagtatacttcatgaaatgcaacaagtagactagcaatgcacaggctgacaggcaccgataataagatatctaaggagctgtacagaaaatagttaaatatgtaaacatggcatgactaacaacagtaattcaatattaatgttacagagccagaagggatacaaaaaaaagtcctgatagatgatataaaaagaacagaaagtttcagataattttgttcttacagattaatggttaccttgggtaatggcgctggggcatatgtgtcatcatcttctgcaattactagcacctcatcaccctcttgcaagacataaaagtcatccggatttaaaataatcttgccaccataagatgccacctttatgccacatggaatggcatcaggaaagctaatgagcacatcttcaaattgcataccatccaactgaggccatcttttaatatagaactcacagttttcgaagccaaggatatcttcccatatctgtttatgcaactccattagtatttaaagggacacattaaattagtaaataggaaggctgtgcatgtagtagactatatgcaatactcaaacagccaggtaattatagtaagcattatgtacatgcaggaaatatttaagagtgaattattgcgcatgtagaacaagaagataggctagtttcttaagaattatgccgtgccaggctaaaaagaaccacagaagtagataaaatacta

SEQ ID NO: 71022 - DNA, 3363 bp, Oryza sativa
acatcccccaaattcccccatctccccgtctcggaattcgggttgtgctccactaaatccctcgctaatggcgtgctaatcccaccaccacccttgcattgcacgcggccgtataaaatcccgtgccaccgtatcattcactcctcccgtccctatcgcgtcggatcgccacccacctcgccgccgctgcttgcttcactcgcctcagatccgcgccgccgccccccgcgaatcccctctcctccccgaaccctagccccgctctcgggggttccccctcctcctccgccgcccgccgcgtccgccacttccatcggaggtattgctgctgctgctgcttctgcttctgctgctgcgttgggggggggggtgttccgatctgtgggctgtagggggatctggattccgcccgtgctgggggtgtgattttgtgtgggcatttgtttgtgatgacgggatgatgatattgttgggtgcgagcaggtgatcgatcgagcgggggtggggggagaggttgggcggcttggattggagagggctcggagtggatgtcgaggaggtcggtgaatccgagccggcgggtggcggatgggggattgccgtctgtcggtggcctgcttcaccccaagtcacgctcgccgcccgtgctcaccatcgccctcgtggtcctggtagttttccatctttctttttgtcaatttagttgttaggatttctcatgtgctcagctgacagaagtgtgcttgtttttttttttgggggtttcagggtgtcattattctgatcgcctacttcaatagcggctcaggtcagcttgaactccacttgaatattcttcttcacctgtttatttttgttccgtttagcttgtattgcaaaatggtgaaaaaaccgtagtgagagtaactcatactaattcactctgttcccttattctgttgattctctgctttctattaaagaaaggtagtagcaacttaaataatagatttggaggtaggggtgggcgtgctagatgccatcactgattgttgctgtcacaattagtgcacagtgacattgctgcagcattgtacctgcattttcttattggtactgcattgttgctgtcatgattttctgaaatatcaaaacaaaatcaacttgggatattcaattgttaactgagattgccctgtagtatgaatatattttgtgattttttaacgttgaattgtcctgctcctagagatagcaaagtggaccagctcatactcgagtgccaaatatcgtggaccagctcatacttctaattgtcatttttctccaatggccaggtgtaacagttactagcagagaagctgtgagcaggtctgaaggtatattattctttgtgtgccaaatcatatgctgctgtcatcttttaacctctcttaatgcattgttgatttatctcttcaatttcttctgatactcgctgcagtaagaaataggtgttgtgcaatccttcatataagcattctggagatactgcatttggttttttattctccatgaatgtttctgtctttttttttctttgttgatgccttcggtgttattcttcattaggccatgaacagtatataaagaattcaactggtatgacatgatcaacatggaccatgtgataattattttttcccctgctgaattttgacactgtcataccaatgtaatttggctgtctgagtgtctgatgtgtggtacaaacagcaacgcagtttactgtattatcctaagcttcatgatactaatagataaccctctaaattttgataaaatatattggaacatgatagttataacttataagaccctctctgggagggtttagtaattgatttttttaggaatctccattgtattccttttcacacgtgttattgggaaaagttttgtgcttctcattatctcaacctttcctttgcatttgcattcaggttcttgtacaccagaagtcatgcaagcacttccttatcttaaaaaggcatatggcaatgagttgcataaggttctccatgttggccctgatagttgtacagtagtttctaacttgttgaaggaagggaaggttgaagcatggggagtggagccttatgatttggaggatactgatagtagctgcaaaagccttgtgcgcaagggctttgttcgtatggctgatatcaagttccctcttccataccgccaagattcctttaaccttgttatcgtatcagatgctttggattatttgaccccaagatatctgaacaaaacacttccagatttagcaaggatttctacagatggtcttgttatctttgccggtatgtatttctttgagttaatcgcatacttgttgatgatcatagttgacacataaacggctatatttgtagatgtacatgatgattccccttcgtttaaatgtcatggtaggttgggcagacctgaaaggatagcatactgaatgttcattttccctagatcttacatttaaaatgaagcttcggttatttgatggttgggtgggcaatcattattggtatttttagggctttttaattggatgcattctaataagcccatagccccatacggagaatggctatagagaaaaaccaggcaatgggttagagagctattaatacccatgtagatatactattgaaatggtttactattaatctagtctattgctgagatgtacatattttatagatagcaccttactttactattgcgggtgctcttatagcctgctattgtacctgctctaagagatagaaatgatgttgactaaatggtcaaatgtaatgcgaatccgtgacacgagtttgaccatttggtttcctgggcaggaatgaaatggaaatactgggtgctaatcagttggcataataatccagagagttgcacgatggagcattcgttagtgttaggtacactaaaatttcagatatagctaccaaatttcctgtgttgaccattgacaattttccagacctatttgaccattgactagtaataacatgtactagtagtaagtactttcagcccagtgggttgggccggaacccaccgggccaggccgacggccagcgaagcaaagaaaagaaaaggaaaaccaaaagaccggtaggtagaccccacctgtcagtgaaagcaggcgacggcgaccgacatcccccaaattcccccatctccccgtctcggaattcgggttgtgctccactaaatccctcgctaatggcgtgctaatcccaccaccacccttgcattgcacgcggccgtataaaatcccgtgccaccgtatcattcactcctcccgtccctatcgcgtcggatcgccacccacct

SEQ ID NO: 71023 - DNA, 5339 bp, Oryza sativa
ggtacacctctgatcagagtaaaactattcgaatagccgtgcccgcggttatgggcgggtctaacaatgtctttcgtgattagtctcacccttctcaccataatagaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgagccctatactatgccatcctttgttatcctgtgcacttgcatatttgctgcgtggcttgctgagtatgtcatatactcaccttgcaatgattcatcagaggaagagttctacagtgaagctgatggtgtggaggattaggtgtagccttggtcaagctgcctgtggagtggagccgtctgcgccatttatcttattttccattgcttagatctttattgaatgagaggaactatctacctctgtaatgacatttgattcgcttattaattagagtaataattgtactctattatcaatttgttattgtgtgcctcggctgattcctggaggagggttcacacacatgtaagcgtttggaattttggatagaaattccgggcgtgacaggtactgccaatgcgaggttatcgaaaagctttgccgtgacgcgtctcatgtgttgggacgaggctcatgtgttgggtagtcacggagtgcgggtaaattatacatccactgcagtgtgagtaaactaaatctattcgaatagccgtgctcgcggttattgagcaccgggacgtgtattacacttggctagactctgaattcttaacttgtatgggatgggttattgcatgatgatttttatgttgttggagccacttcctgagaggcgggaaggtggacgtcctcagaaaaccatgacgactcaatggcgggaatttatccttgagatcacaatggatggtggacagaaccgtcgttattcaaatgtgaacactggtactaaaatttgatcagtcagtgctaggtcttaggcttatgaaaagaattacaaaacttgctttgcgcaaaagaaccatagccatcctttgaaatacccctatcatgtgcattgttgctgtggtggcttgcggagtacggttggtactcagccttgcaatatataaacctaatcagaggccggagatgaagcttcggaggatccctacgcgtactaccaggagggtgatgaagacgacggcgcttagtaggtcttagttacggtcgttgcctgtggcaaaggcgtgccgctgccttaagtccgctgccttatctacttctgcttttggaatgtattccggaccgctcggttagatgatctaagactatgcctacgggcttatgatgtaataattcgcactagactctcgtatatgtgcatttggtatttcagctatgaactcgtgtgtagcagactacttgatccagggaaatggtaccgtttacacgattgattcctgttataaatacgggggtccacatttctacgatgagtttacaggagttgataggcggccttttccagtacatacaacaaataaattgtgccgaaaccttggagtaagccacttctatataatgtatctaccctatagttcaaacatgcactaacttatttttttattgattgacaggaatatatgggtgcaaagttcatggccgcacaccataaaattaagtctcaaaacacttcaatcagtactaaaggatggaccacttgaccgtgattgcttcaacatggccatacgcaagttcatgtatgaaaacatccggtcgcttcacaaaaccagctaagcaataacaaagcattgcctggacttacaattttgggtaagtttttataatctacccaatattgattcttttgctcatattttaaacaattattgtacatcatatagactgctactggatttggtataagtccaatgttccataaggatatagatcttgcggggtcggttggtagctggtcgaaaatccattatgaagttgcaaaatgcaaattggtaagctagctatcctttgttcttatttgaatgtgtttttttatattatcttgacggttgactttttccatattcttataccagtatgtgctgttggaagctatatcttggtcatactggaccaagaaagcagaacactttatctactagaccctaatccactaaatccaatgtatcagaacaacccaactatgagatataccaaaaaattgttaaacgttaccaactattacaacagagccatgcgtgtggcatgtcctggctctaggtggactgaggatatcgacttgtggggccatatatatgtcacaaatccggtggctaactcgtaagttttcttgtataatcttgtttgatccaataaattatttttgtctaacgcatggtgcctaactattcaaatttcataggaatttgtcgggttgtctcgtgcatctgttcatgcgatcctggaaagatggagcacttcatttgccgtcttttaaggtcattccgactagcattggcatttagaatattatattatattttataatacagtcatttattttataaacatatgcatttgctagtcgattaattcctgttataaatacgggggtccacagagttggtatcagagccatacgactgtaggaaaagaccaaaaggcgccccgccccttttctagttggccaagggggaaattcccatttagtaatacttttaaaaataaaaaaacgctatgtttacaaaactctatacgattttcatcttactcttaactattttcttcacaaaacaagttttactcttagctgactttgggtttttcttaaaattagatggcagatcaggattcacccactacctaggagatgggtgtaccccgctcagagggatacgtcattgagctacatcggttgatgaggcgcctacggtaccccagatttccgatctaccgagttcgacagtgtggacccgtttgggaggcctgggtcgaggttcatacacgagttccttcaaagtcagactacagctttccgacacgccatcgtcgcgacttaccggagaccgcgatgcagggtgcagcccgggaggccttcctccgacttagctctattcaccgagctgagttagtgagtaccgagtttgctcaccacccgtttcgagaggagagcaactccgtctgcacagttcaggacacaccttgctgctacaacccgatagtgactctactgtcccgatgggctgaggcagtagacgacttctacgaggaggctctgttagagatcgacgaccagcagaggcgtgtgggaaagttagagagtgaggtgactgacctcacagtacatcagcttcagctagaggaggagcaccaggctgggggcagtgagatagactcactgaaggcacagcttcaggtccacggtgaccagtttcagcagctatctgatcagtacaatgatcgccgcgggatgatggatacactcgaggagcactgagagagagttaggagcacgtcagccagcttgaggagcagcttcaagcagctatagtcagcaccacaggagcttctacttccacagcagtggggcgtgaccgctacttcttcctcacccggccgtacccaccagcgttccacgctcttctgggagaggttggtatgctggctactgagtcagcaccttacttggtggacccgacagtgacacagccacctgccccagagattgtgcacactccactgatccctactccgtcaccgcagctgggttccagtatgaagactccgatccaggtcgactccgagacagaggggactgacaccgagccagagatagagccggacatcactgatcctttagaggacgagactcctgtcccccgcatcacctttatcggaggccctcgcaccctcagcactgcccgcaagagcgcacgacccccgggcaagaagcccaagccaaatccagaggccactacttccgagccgtggggactcgggtttgcccgtgccagcgaccaccctctacctgccccaggatcctgcggatggttggatgactagactggaggtctattgcagcttcgatctcgcttcagatggtttttggatagcatgcgagacacacacccccgctacctagattgacgagtagcttgatgattagtttgatgtatcttttggatgaactttatttggactgcgtatatgtgcagtcgattgcatcatgatttatgtactatctgtggaactctgtgatgttatttatgatattattactgttgtgttatgaatgagtttattccaccatgcttgcaaaataaagttcacaatcaaaacaactcctttaacgagataaaaccaaaagggctagttaggaaaataggatacttacctcatcggcgtacacagatggcaagccgacgtagggcgtcaaccagcaatgaagaaactcaagcacccgacctaaacaccctggccggagtcatggctacccaaacccaacttctacaagccatcacaaataatcaaggcaaccgtggaggatcaagctttggagaattcatgaggactaagccacccacgttcgccacagctgaagaacctatggatgctgaggattggttaaggatcattgagaagaagctgacccttgttcgagtacgtgaagccgataaagtgatctttgtggcgaaccaattggaaggaccaaccggagactggtgggacacatataaagaagcccgagaagaagatgctggagaaccaaaccgggaggaattcactacagccttccatgacaacttcgtgcctgccgctgtgatgcgaatgaagaagaatgagttcaggagactacggcaaggaaataccaccatacaagagtacctgaaccgtttcactcagctggcgcgttacgcgactggagatcttgccgatgacgaggaaaagatcgacaaattcatcgaaggcctgaacgacgagttgcgtgggcccatgattggataggaccacgatagtttccagagtttaatcaataaggtcgttagattggaaaacgaccggaaggttgtggagcacaatcgcaaaaggaggcgtgccatgaaccgcccgcctcaggccgcaccccaatgtcctaaaggaacaacctcctcagtatggaaaccaacagtggtgacaaccaatcgtcctgccgcatttagcaatttccacaggccgggaacca

SEQ ID NO: 71024 - DNA, 2160 bp, Oryza sativa
taaaacgtgttcaatagtttaggaaatctggtactcgtagttcttatgatggtagcacacactttttcaccgactcccttcgtctaaaaaaaattatacgttacatccagtgctaaattggtattttatgggacagagggagtaactctgaacatacaaacactaagatatatcaaataaaacatatttctccgcaaaataattatattgaaacttgtagtagcaagaaagtgaaccatttccattttttaataaaaaaataaaacctgaatcatatcagaatggctggaaaaattccttttattttctcctcctttatactaggaaagaacagccgacgtggcgatcaacgattggtcgactgagcaagcaacccacgaacagataagacggataaacacaccgtcgctaaagaagaaacacaaagaaaccaactccgacgaccaccggagtcggagagcatcaagaatcgacgacgatcgatcatggccatccccaccatcctgggcagtctgaagctcacgccatccccaccctccgccacgccggtgcgctcctccgcctcctcctccctgcatttccacctcgccaacgccggcgccgccgcgctcgtcgcggcctcgctcctcgtcgccgacccggccctggcattcaagggaggaggcccgtacgggcagcaggtgacacgggggcaggacctcaccggcaaggacttcagtggccagacgctcatcaggcaggacttcaagacggtactctctttgattgttcccattgcctttctgtttcagttcttgaactcggatatgatcatatttctgtagataaattgtaactgttcttgtgggtgaattactgaattctatgtccagaagagtatctgaattgtcagcaaatgcaattgcaaagcttatgctgttttcttggtatgtttttgttgcagtctatactgaggcaggcgaacttcaaaggcgcgaagctgctcggcgcgagcttctttgatgcagatctgacaggttctgatgctgtgcttgtgaatttgttagatgttccatttatcacagtagttgtagtgattcttccccaatgtgaagttctgaaatggcaaaactgatgttttggttctagttgcattgattattcagagttttctggtgataaattcaggtgctgatctctctgatgctgatcttagaggtgcagatttctcactggcaaatgtatcgaaggtagtactgcatattgctcaaagaaaagcattagcgatagcaagctaattgaaatgctactacattccacattgaccattgcattgttcagaaagcctggattgttttttcctttttactgattagaccagtaataaattgatagcaatttggcattggcatcatagcaatattgaacaagcttgcgttacataatataattggtcattacataagtcctcactttcttcagaaagtcattgaccactttctgattaagttactaccagtttgtcaagcatggatttcacaggtttgcagcacaaatagtttgttactagcttgcataacctagtgacaaactgacaatcgagtgatggtgtgtctcttgaatcatttcacaggtaaatctgacaaatgccaacttggaaggggcacttgccacaggaaacacgacgttcaaaggttccaacatatatggagcaggcaagttactggtcctgtctctctgatggccatgccaaactaaatgactccttttatctgcaaactatcggattgttgacatattaatatgatcaattattattttttcaatctctaaccaacctcttactcatctacaaaatgcttcaacagagttttgattttgtcagaggctgaccaaaattgcattagactgaattgactattgtttgatgggatcatcaaacatctaagtttctctctctctttttttttggccttccagattttacagatgttccactgcgagacgatcagcgtgaatacctctgcaaaattgctgatgggtaagtaaccaatgttgcaatcatgcacacaccaatggctgtccattgcacttattttgtgtctccctgtatgtacattacattgagctcactctagctacaattaactttttgcatcagggtcaatacaaccactgggg

SEQ ID NO: 71025 - DNA, 2571 bp, Oryza sativa
tgtcacagcctgaattttcgttttaggctttataaattatctaataaattattaatagaatttatattaaatgttctttaatttacaagtgaagttcaatgtgggaaataaaatttcctaaatataaagcatggatggatttaatttttattaaattctccatgattaattacactctctgaaattttctcggatttttcagagctcaattcctaaatgatacaaagaacagttcagtaattagttaatcaattaatgatctaattataattattttaagtgcttttcttgtttaaaaatccttaatttataaattgttgtctaaaaggaattattagaaatgatcttaaaagcctagaagagaagatctaatttttaatttgttaaatctcaatataaaagtgggctagataaaatttcattaaatactttacttgattctatagttcctagatttttctgggatttatttgagcaaaggaagtatttttaatcaatggaatatcatttcatgaataatttaaatagaaaaaggtttttaaaatctttcttttggttttgggccgaaagtcagcccaagtctctctctctccctctcctcggcctgcttgcatctggcccagccggcccagtccgccacgcccctccctcctctctctcagccgctaacaggcgggacccacctgtcggggtcgtcgtcctcctcgagccgcccagctgtcacaccctaaaaattcaaaatatataaattgttgtttaaatggaatttttagaatttattttaaaaaaaatcctagaaaagaagatctaattttaattaataaattccaatataaaatggggccagataaaatttcattaaatactttgcttaattttataattcctagatttttctgggatttatttgagctaaggaagtatttttaataaatggaattgcatttaagaaataatttaaattgaaaaaggttttaaaaagtcttcttttggctttgggccgaaagtcggcccaaaacccttctctctctcctcggcccagccggcccagtccgcagccgcagccgcccgcgcgagcgcgctgtcgctgacaggtgggtcccacctgtcaggctcgtcgtctacctccggccgccgccgcccgaaaccctagtttcgcgccaccgacgttcctttccaaatccggccgcccctttccgtttccggccgaattgatagaggggaaatgatcctcgggatctcctctaccttttctcttttggaaacatcggctaattcgttttggaagttcgtggaatcgagttcgattcggatcggcctctttcctccgaaccccgaagtttccatctcgtcgccggccgccgtgggccttcgccgccgcctcctagcccctttataagcttccccggtgtctcctctacccgccgccacccttgctatcgcctctcgccatcggaaacgccctagcgccgtgagacctagcgccgccgtcgccgccgtcgctccagccgtgcgccgccgtcgctccagccgtcgccatcgctcgggaaggtcatcatcgtggtcgccgtcgcgtctccgtcctcgtccgtcccttcgccaccgccgaagatcgccggagcactgtcgccgtcgtcaagccgaagagcgccgccatttcttcttcgtcgccgtcaccatccgttcctcttccgccgtcgctttggtcgccggtgagttcgccgtgccgtccgctacccgttggtgccctccgttcgtgccgaagtgccgccgttcgccggcgagcatgcgcgcccgagccgccgagccgccgccgccggtggtgacgtcatcgccgacgtcatcgtccccgtctcccgtgagccagtcgttgaccgatcgatctcggccgtccgttcgtgtgaaccgccgccgtgcgcccggtccaccacaaaccctagcccgctgacgcaataatcctccttttccttttcaaaaataattcattattgcgtcataattcaattaaaatcaaaataagtgttttaatccgattaaatcttcaaaaattcataactaattcatcttagctccgatttagttggttcaagtctctaaatttttctaaaattgagatctacatattaaaaatatccacatgtactgttcatacttgtttatgtgctgttttggtgattttgctcttttctgcttagattccgtcgtttccggagagtccgttttcgccggagaagagtttgaagagttccaaggccagcaaggcaagtcacacagatctcaaacaaccctttgagcatgttgatcctatttaaagctattgtttctattcaactattgcatttatttttgaaatgtcattgggtggaattaacctattgtttgttatagccctttttgatcttgattacttttgtcgcgtcccaaaacgactttaaaatacatcctcgaaattgtgcatagaataattaaaatccttgtgaaagcctcaacaattaaaaagtgcaaatttaaaagtcaaaacacgcttggcggaattttgtatatttcctaaaaagcctaaaatgcgtaaat

SEQ ID NO: 71026 - DNA, 2066 bp, Oryza sativa
aattaactagcacaatgtacctggtcagcatttccttcttcagctaaaaccacaattgcacgcgctttagaaactgagaccttgtacatgaaggcagattcagttcaacaaagagttgcatatagatttagtaaagtaatagtgagtcattaaattaacataacaaccatccaattgtctattgattactgccaagtgccaacagatcataatgcgggttagcagaatcactacatcacaatgtttacctttttcaagtcagctagaatcagagggcttccacttctacaaattatagctgttcctttcaagtcaaactccattttagcaatgtctgcttccatttcctctttgtctttctcagccatcactacaatggttcctcctcccaaactttcattagcaatagcaatttggttcagcaatgatccctgttgccacaaaaggaaataggttagacacttagactacagtaatctggagaggaacagcttgtgctcagatcagttgatctgcagaaacagatatataagaaatttgcatatttaaactaaataccagaattcactaactactttacttttgtagcgagactgctatgcaataaaaagcaatgtaacagttgcaatgacgtccctagttagagctatatttaatagctattggtataacatcattcccaaacaacaaggaacataacaggacaggtaggtagaaatatggaattttgcgataaagattagcaggattgaatgcaggattaccagtttgtcactccacccaaggaccagcgtgtggctttgctctatgacctcacttcttcctttcctcagtgaatcaaacttctcagagatcgaatctgttacaagcccaagcatcatggcaaaaaccagcatcccaccgatactaattgaaactgaaactaactttggtccaaagccttctgcgtttgcatggttgcccgaatcagcaacaaaggtccaggacagccagaggcaatctaaaaggctatcatcatttacaccataaagagccaggccaccaagaccaataagtaacaatgtagcaacaagtagaaccaagggtttagcatatggttgaagtgataaaaatatatcaactcggtatgccaaccgcttgtttatgggaacttcttcttcggagtcttgcgaactcctcagctttaagaaaaggtccatgtacttaagaatgagtaatggggcgtacagcgtagaaagcgagagcagcaatgagaaattcttaagacctctgttctgcgaagtactgttattgctctgatatgataatatgctactcatatccatcgaggactctgtaatacaagactgcaattttgtagtagcttccgcaagctgagcctgatagaatccgcgtataagtgcgcagttatgcagaatgtgcattggaatcagttggaattttaccttcaaatggtggacctgatcatgtagcgaggagttactgcggacaagggaagagaagcagagcacaatagcctgcaagcatcaggtttacgcggttaaaccgtcagtcaacaaaagtcaaacgcgaaaaccccgcgagctcacccatttcttaccgccacggataccatccctgaccatcggagggtggtcgccgacgccgctgacttgctcccgtgcacctgcgcggccgtaggaaccgccgccgccgccgccgctttctcggcggtgagcgttcggacatcgccacggcggacgccagcataccgggggtcgcgacggcgcggggcgggaggaggcgtcgtcgggggcggctgctgctgcttctgctgctccggcggcgggaggggggagcgggagcgggagcgcggggtaggaggcggccggcggtccgggaaggagtatggattggaggagcgggaggtggaggggaagggggccctcggcgttcgggctctggaggacgggaggaagggcggcgccggcgggaagaaccagtcccggtgcggcggcgccggcgaggagtcggggtccaggggcattttcggaattctaggggttggcaggtaggcggcggatgct

SEQ ID NO: 71027 - DNA, 629 bp, Oryza sativa
ttatctgccaagcattcagcttagaatatcacccaagaaaacttttgcttagtactttcctaatgaaaatagcctagtacttttgcttcttcccaaaacaatgtttacttagcaagttaacatttgtcgtttatttggtgggttatatctgtgttcactgaaatatccatttcacatgtggcagcaatggttaaacttaccaaatcaatctgttggagaacagtggtaaaatctgaagatagtaatggaattggtgttgtcgtatatcaaaaaccagcatcaaactcttgctacctggagagaaggacaaatgaaccccctatgtgttctaagaaagatgggccccgttttccttggtaatttatagctcatatccttctctttcttccctgttctcataaagtcagattgcatctgatcttgtagtcaccagtggcctatttctgatgattacttattggttcattgtcagacaacagtgaaaagatagttactaacctatcctgcttaaatatgttttagataccgttaatgatctatagtgtattttctgtttggtgacatgtatacaatttatcttttgcaggtacgctcctcttgatacatgcatttccagttcaattgaaagg

SEQ ID NO: 71028 - DNA, 1095 bp, Oryza sativa
cggatccaagcgagggtcaagacccgcaggacttcgaccaacgcaagtcatcaccattctttgaacatgttgatccaattgcgaaattattttatttccaaataagattgcatgcaatgatgaacatcctacttgtgattatgccatgtcttgattattgtttacctttaaatccttgtaaccataattacgtatgagtccttagtcaattatgacacatacttagaaatgctacactagattcatgcacgctcatattttatcaaatgctatatgcttgggcaattacctttgggaaggtaattgagatgcggcatgtggagacatgagcgccacattgccatgatgatgatgacatgatttgtgaaagtaggaatgaaattaaacacttgttttagactggggcggacgatggatttgggtggtatatgggaaaggctagtaccgtccccggtcaattaagaaccgagccatgaagttaagcatgaaacgacccccgtacaaccgcacttctcgtatgggtatagacctagcggattaaataaccgagcggaggcagtatccctacatagatggttcacccctgagtgacgcaggtgcgctaccgtgggacagccgttgaggtagggccgagaggcgtgccctacatcggtgtcgccatgggtaggactgccatgagtgcgtgagagagagaacttaacctgaatcataatttaatatgtgtgagacttctttttcccgggagcgccagaactcctctcactgctagaaatgtatgacgcctagagtgcatgagggctaaagttcatggagcgggtactgccaatgcgaggttatcgaaaagctttgccgtgacgcgtctcatgtgttgggacgaggctcatgtgttgggcagtcacggagtgcgggtaaattatacatccactgcagtgtgagtaaactaaatctattcgaatagccgtgctcgcggttattgagcaccaggacgtgtattacacttggctagactctgaattcttaacttgtatgggatgggttattgcatgatgatttttatgttgttggagccacttcctgagaggctgggaaggtgga

SEQ ID NO: 71029 - DNA, 1146 bp, Oryza sativa
acatatcatatcactatgaatatgtatatgtttatgcagtatgtattacatgttgttttgtgtttatttatttttgggatggagagattcagctttcagcccccatcgtttggcatatctacaatcgaaaaataatttgtgaatgaaatttttacatacatattcttaatgatctaaaagtaaaggctgaaaaataagtttcgatgaaaaaaaaatcaaaatcaacttcaaatttaagtttgaaaatttaaattttggctgacaattcaaatttcccaaacataaatgatagaagaccacaactattttattaaaattgtagattgtagatttgcccaacttgagctaattttagaaaacaaaaactaaataatataggtggatcgggcccaacagatgctgtgttgtcgtgactacgccatccttggatcgggcccagcccacgccagaatggctgacctgtcaatttagttgcagcccaatcatggtagacccattagtaggagcctacggcccacatggtcttgcaagaggcccatccgaataaaacaaccggacgtcgtcttccccatcctggttgggttggagtcggagagccgagagcgtctcgccgcctaccgctcgctcatttgggcagaaaccctagccctaggcgagcccctaaaccccaacctcgcccgcgatttcctccccgagggcgtcgaggggaggtaggttggcgccatggatgcgatgaggaagcaactcgacgtgctcatgggggcaaaccgcaacggcgacgtgcgggaggtcagccgcaagtactacgaccgcgacgtctgccgcctcttcctcgccggcctctgcccccacgacctcttccagctcacggtaccttcccccttctcagtatccagtatccactcatctccatgatgcttctctgtgttttttttttctttgtgggaggttaatttggtgggtaagcgcttggggtcaggccgtagattagggttcggagtgtaaatcaatattattagcctattgcgttggtgtgaatcaaaatctaggttctctcatttgagataatttcgtgctgtgattctgttaactaatcggctattcattcatggcagaaaatggatctcgggccttgccccaaagttc

SEQ ID NO: 71030 - DNA, 2135 bp, Oryza sativa
tgccgttgcaacgcacgggcacccaactagttaattataaaaaatgtaattaaaagaaggggaagaacacatttttttttaaaaaaaaagcgaagatgaaagaaataaacgaaataagaggatacgaggcgacggacgtcgattgcctaacgccgacgcgagggtgacgtcaggggaaggatgacgcagagtagacgtaagcacgtcgttggcacgttccagctccatccattccaacctcgcccgcgccgcgccgcgattccggaagcagccgctcccgcgaaggaagaaaccaataaaacaaagcgtttttcatccacacgtgacgcgaggcagaggcactacacacactgctctctctgtttttttttggtcaaccccaacccaagcaaagcagccgcatatctctccattaatcacctaccaaaaaaaaacaaattattttgtttttaaagatcatttccaacaagaacaccataccaatccttggtcaaattctgctagtatttatcctcctagagagggacatggggagaggaggagtggatccacgatgatgacgaggagcatgatgaagtttttctctcccttctcctccgctatttataccaccctctcctctcgtctcgccaggatcaacgccactcgccacacaccgccaccaccaccaaagagcagcagagcagcaagatcactaacctgtactactgcctctaaccccagatccaaatccaaatccaaggccaagcatctcctgctgcttctcctgattgtctcgctcatcttgcttgcagctttcttgctgattcgagcaaccatgtcttcttcgtcttcgtcgtcggatgctgtcgccgcggcggcggcggcgacttttgagaagccgaggacggtggtgaagaagctcctggcggagtcccagcccgagggcgacggcgccaccgtgcgaaggagcatcggcaggtgaaggatcatcatcgattcaatcctatctctgaatctctgatcgatttgttttgccgaatcgtgttgggttctaatggatggggggcgttgacctctgttttttctgcaggtacgagctcaggaacctggatcctttcctcatgctcgatgaattctctggtaattacacaattccaattcaccggtagagtaaaatcgcggccctttttgtgcccgaatgatcttaattttccccttctgttttaccagtttccaagcctgctggatttcccgaccatccgcatagaggattcgagacagtcacctacatgctcgaagtacggatgactaaacttcttgtagttccatttcatcttttctttatgcccgtaaggtgtttgctgaaatgctactcatggtttcttccattcagggggcgttcacccaccaagactttgcaggccacaagggcaccatcggcacgggagatgtccaggtcttactctaccctccaactagggacatatctttcatcactttcagaaattgacgtttcaccagaaaaaaaaaagggtgactttgttttctaatttcagatgctgacaatgcaatcttgatcatgtttttgttcatcagtggatgacggctggccgcggcatcgtgcactcggagatgccggcagcggacggtgtgcagaagggcctccagctctggatcaacctctcttccaaggacaaaatgtatacacaccatgattgatttgatttgcactccaattttgcaagattgcatgtttgcaaatgctcattggatgaacttcttcaatgcaggattgagccgaggtaccaggagcttatgagcaaggacatcagctgcgccgagaaggacggcgtggaggtgaagatcatcgccggcgaggccttcggggtgcgttcgccggtgtacacgcggacgccgacgatgtacatggacttcacgatgcagccggggtcgcagctgcaccagcccatcccggaggcctggaacgccttcgtctacatcatcgacggcgagggcgtgttcgggagggagaaggcgtcgccggcgaccgcccaccactgcctcgttctcggccccggcgacggcctgagcgtctggaataagtccggcgagccgctccggttcgcgctcgtcggcgggcagccgctcaacga

SEQ ID NO: 71031 - DNA, 1334 bp, Oryza sativa
gagacgtacacatgacgtctagctagctactgcatctcctccgccttattagttgagtgagcaagcaagcaaccgatcaatcgatcaagatcgaaactgcagattattgatccatcgatcgtctagtggctaatcagtccggccctcctgctgctgcaggggtaccagcatatgcatctcttcaggtagcaaggacgacgacgacagcaaggaacaaagcgacgagaattgggggtagcagcagagcagctatagcttgtacgttagcctagcattgcagcgaatgtacgggcccaaatttttatgtcatgcccccaatcatcacatctcgagaatccaatgatcgatgcttgcttgcgttagataattccttctagctccctcctgttcgtacgcccccacacacattactaatgctgtgcattagcagcagcagcaacaacaacaacagaaaaagatatataaaatcactcgaacgaacgtttgcaacgcaacccgatcgatcgatgatcgaataaagcacaagcaacctgcatgttatagctagtgtatgtagcgtcattgcagtagtactcctaatattatgattagcgcagcagtacccctaatatatactattatgattagcagctagctagctgctagtactagccagctaaattaccaacctaggagtattgaggttgcttttatagtagtagtagatgaatctagcctgtacggatccacaaacatgtacagtactcttacaaagcacctcagacctcacctagttttaggatacgtacgtgcagtgaaacatcaaaatattaaccactaataataattgaataaaaaggggttagtactataagagtaatattaattttcttgctgaagataatcaactcgactgccaatggtgaatggatcgcggccattccacggtctatcccaataaatttgggacaagacctggcattatgagggaaattgaaagcaagcactgcacgcggggaggaggtgcagtttattttgccaactgcatgcccaggcaaccaccttcaccgtgggtggggtcatggcgagaatgaagctatagctagcaagtggaggaggaggagaggccacagtttccatggcgaaaactgggcgaaagtgcaagcgagaacagtttcatggtcagagaaaacacacgtacagtggcgaggagtccagagttaggtcttgtttgggggagcttgtcccagctgcagcttttcccaaaatctgcttatgctagaagctgtcccaaatagtctacagcttctaagaatctgtagttacagattctgaaaaattaaccaagaaggcag

SEQ ID NO: 71032 - DNA, 7801 bp, Oryza sativa
cctttttccatattcttataccagtatgtgctgacggaagctatatcttggtcatactggaccaagaaagcagaacactttatctactagaccctaatccactaaatccaatgtatgagaacaacccaacatgacatataccaaaaaattgtaaacgttaccaactatttcaacggagccatgcgtgtggcatgtcctggctctaggtggactgaagatatcgacttgtggggccatatgtatgtcacaaatccggtggctaactcgtaagttttcttgtataatcttgtttgatcttataaattatttttgtctaacgcatggtgcctaactattcaaatttcataggaatttgtcgggttgtctcgtacatctgttcatgcgatcctggaaagatggagcacttcatttgccgtcttttaaggtcattccgactagcattggcatttagaatattatattttattttataatacagtcatttattttataaacatatgcatttgcaggatgttgatgagctaaggaaacaatttttgctacatatactgatgtatgagcaaaatgagtgcacaagcaacattcctagcggcgcacgagattttcttcactgtatcgcaaatgcaaaacattagaatagttattctttacctatggggtgtattttatacataacaaatgctttatttaaataatggaataactctacacttctctaacatatttttctgcccgcaacaaataatggaataactctatacttctctaacatatttttatgcgtatattgccttttatattgtgtagtgtgtacatagggtatattatatataattaagtcttgtaaagttttactgtgcccacgtaatatcatagtactgcaccttacatgaaatatattaaatgtactatatgatttaattaaagttcaaatgcacagatcatataaaaatattttttggtaacgtgaaatttttttaaagatacagttaaatataattgcaccgtagcgtttagcacgggcatattactagtactattggctgaactaattctaagtgccatacacatgatcctaaaaatggatatcatgcacttgggaaagtttctcattttgattcactgggtccatatacatgtatctatgattgaactcattctaattgccatacacttgggaaagtttctcattttgattaatgggatccatctacatgtatctattactgaactcattctaattgccattagagccattagacgtgatgtcgttatcacagagtattgtagacattaacatatgagcaatgcaggctgaagagacgatggtctgggacagacttgcttgtgaataatcccaaattcgctggagcaattgagcaagccataagaaacacatttacaacgtcgacaggaatcatctgtcaaccgcacgaggggcaactatttgattcgccggcagaagcctatcaattttacaacttgcatgcttgggagtcagggttaagtattcgtttagggcaaagccggaagatcgatccaatggagtgctatacatgcagggagtttgaatgccagctatctgtcggtgaacacaaatcattaagcataatagttttgtctttttttttatcgcgaatcctttcatggaatatgttcgtgttctgcataaaaaggtcaattaggcctagaggggagggggggtgaataggctaatttaaaaacttaagtaaagcggaagcagtaattttcagaactaggctgggaattttcggaacttccgaaaggattttcggaacttccgaaaatgcacagagcagcgcacacaaaaagaaatatctagatctagaagtctaccacatgtaatcaaaggcacatacaacaactagaccaatagcggcacatgcaagcaaagttagaggagagggatgaagagatatcaccaaggtgaagcttgcaaacttgttcccggagttcaaatccttgaggggattctactctccgttgaggagctcactaagagccaggtcttagctaatcctttcctcgagaggttacgctaagcactcctcctaccactaagaggtatctcttccctagcttgcggaggcgagatccggccttcataatcttctcccggctaaccacaagtagatcggtggctcgggagtgacacctggccgtctaggagtcctcaacctccaagagtaaaagatgatgcaaagaattcccggagatgatgcaagtgctcacaaatcttcacaaagaccacaagaagcacccacacaaactcgaatccacactctcacacacaccaaatccgaatcaaacacgggtggagagatgaatcgaggaagcaaggctcaaatgaactagagagagagcaagccaagggcacaaataattggaatgaaactagcagccctcacaagtgaggggaggtgggtatttatacccacagcacaaatctgcccgttggagtgcaataaaagtaattttcggaacttcggaaacaattttcggaacttccgaaaattccagatctgagaaataatcaaagtcaacgcacttttcggaacttccaaaaaacgttttcgcaacttccgaaaatttccagaacgcttatgtgtattttcggaactttcgaaaatcattttcggaacttccgagaatttccagagagctatcaaacggttctgtgtattttcggagcttctgaaaatttccagaacgctccaaaagagaaatgctttgaagaaaaattgattttgagcacacgcatcactccttgtatgtctatgcatcatcccccttaatagtacggctttcctacgacacaatgcgaggaaaaagatacaatataccatttgatcattgccgcattgcatcgcgatgtcgcattcacaggatatgcattgtattacaacacgttgaggacttaacaaccttcacatttgcttgaataaaaatgttagtcctctctaatcgcattgtaatcaattatcaaaatcattagggacctagatgcactttcaatctccccatttttggtgattgatgacaattcgattaaatcacaagagagaatgataataatagatgattttggtgcaaatgtttagtgaaatctccccctaagagtgtgcataaaagcaagtggagagctccccctaaatctttgcatccacattgaaactcacaaaagaacaagtatcatcacaatatatgcatgaaggatcatttcatcatatcaaaatcgcatctcaaacaaaataatcatttcatctcaacaccatcacaacatagagagaatagaccattgcaacaaatacatcatcatctcatcacaaccacaatatagaataaatgagacatgacatcacatttaaacataagacacaataatattgaaacaacccggaattttaagctatttaaaaaaataaaaattatgtgacatatatcattaattaatcagttaactagcaaaattgttggaaacaagaataagccactcaaaatttataacattcgcatccgttgaagtaaaacaaataaataatgtccaatataccaccacaatatactaataataataacatggaaatattatacgaacaaacatcactataaacagtcatcatgtatacataaacttacactaataatacaatacatcatatatttgaatatacggttgcacaggacatacatagcttgaccccttttatgcacaaaaggtaatatgtaaataaatgttgccgtcagacccatacacaaagtggtgtatattcaaccgttcactgagatacctagatcacctagatcagctaataccgtctggcacccctcacttaagtcgggttcgtcatccggctaattaacacaaagaagccgcacatctcatataaagaattaatctcaccaaagggacctcaattcaccagcagtattaattatccaccaatcacatagctccacataggaagcttcacacaagaccacaaagatagtagcacaactccatccactttggtcaagactctatctcaccttggtcaagcactcaaagcatgaccacagccatggcagcagatgcatgcatatgagctccaaccaattagtgaggagtgagcagcccaggagaggaggaggagagaagtagggagtgaggagcaaacaaatcagtgaaatgcaagattgcgccccatccattgcaagcaccaaatcttgaatcccctataattagtagccaaatagttcttggccaaatactcataccatcactatgtcggctaggaagaggagaagagaaatcagcaaggagggaatgtgatttacccaaggaagaggaaaggccaatgcatcggcgaggatgaacacgggagcacagccatggacgaacttgtcacctaggcaaaggtgaatccctcaatacttggctttcctttttttttagcacctagcaaccaagcatctgttccccctacacctgcaaatcaccattagagccatcactaaattgcacccatcactgcacaagtgctacagccagagagatgagagaaggggagagagagagggagggagagagagagagcacccacagccgcagccgtagctgcagcaaccaccaccgccacagcagtagccgcagcagagctgatccacactagcaatggtagatcggtagccatggcttggatgatttagctgggaaagggagaagtgccttaggaacagcagcaaggaagaagaagaagaggaattactgctgctgctgccttatctgttcgaggaaggagagattagagaaggaaaggggattaattgctggatgtacactactaggctacacaagatattaaattgaacctacgcattacctattactacacattatctggaagaaagtttgcacattaaaataaactctacagagcacattttattggtagatcatttgtatccctagtatttaaatttatcaaaacctcaacgtatatatataatataatgcaggaatgagtagaatgataattgggtcaatcggcagtgctacataatttcgattcaactacagaaactcaggcaagtctctcctttgatcatgttgatagatgataattctatttcaacttaaaaatctatttcataaaaatatttctcctagtattgcatccaaatatattttctagaataatgagattaactatgatgatatgattgacaaactgatgatgatggagatcattgggatactagtatggtgggtatggggagctcagggatgagatgattgatgatgagggcaggacagggctctccctacatacggtgtataaatataaggactaatcatcccctcactcgtatcaaagaaccgtatataccgtgtcgaccatatatccgtcttaagacgggctggacctagtaccttatcaagtttattatactccacatgggtacgtagtagtaggatgggagatgatataaaccccaggaatgccgatgaagtgcattccaggcctcatatagtagcgcggtggtgtggagagctgataggctcaacacaaacgtggagtatagtaaattgaagtagggaaaaagttttgtactcttagcgtggtgccgcatctagtgaagtgcgacagtcaaacgtgttaagactagctatgggtacagtgatacaagcctgcgcagtgctaaattaaatcgtgattcacgcctgtctcctggattggaggctacggggagttgttacaaactctattcaatgttacgagtgtactctagcttttataaatctccttttgaaaactcttttagaaaatagaaatatactttacttttgatgacaatgaaggtgatgatgttacgtaaggtatagtattatagtatatagatttatatattattattcatgcatatacattttattactaatgacttgctgagtacgaaagtgctcacccttgctatataacccctttgtacaggtttgatcccttgcaagagtgagctggattagagatggccttaatactcctagggacgaattaaaggtagctctaactattcctctgttgcgatctctgatggtggattattatttggcaaaataatggttgttaaataataatctacagtctggcacttttatcttcattgttaaaagtgtggggcgtcacaaatatccattacatcccatcatccataattaaacaataatgtcttacaaagcattaaactaacttaagaaacacacatgtctcatacaaataaaaagtcactaatgttcgaccaacataagggatagagatgatagatagtctccccctttggcatcaagacaccaaaaagagaggacgaagagacaaagactcaagcaaggggcgcctgaggaggatcctctggaggaggttgtgggggatagccatagccatggccataacaaaagaaatcaaagtcaggaagcaccccagcaaatggatcctctagctcttcctcctcgggctcatcgggctcggcctcgaaacccggaggggaaggagggatatcaatgtggtggtcctcatgataccgcgccttgaggtacttgacgtcactagccgttttcttcaccaaattccgtaatcggcggttctttttagcctccgcggagcaaagactaaaaatagtccgcaaaatgcggaataagggagacggctcatgacgagccatagaggaaggacgctcagaagcagaaggcggctgagaggatgtggaggggatgtcccgaggcacagacctgtgcttgggcaagcgcaaggaaagagcggtatgtggttcctcgcacacaaactgaaggtgagtgacatgttcaatcatccgaattatatgaggagcatagggaagccttctcttaaactgaagagaagccatgcggatttcctgccaaacaaatagaaagacatgaaagggacggcaggggggattgaacctgaggagcatagagcgggagaaatggttgatgttgctagcatcaccatcctttggagtcatggtccgcctgaggatgtggttgagatagatatgataaggcttgagcccttcagtagtccccaacttgccgccaggaagatacagagggtgcaagtcatgattgtgaggaatcacaatgtcatgcaagtgggtcatgtaccgcatccagttctcatcaaaaccccacagattggcaagctggtcataagagatagaataccacgagccctgagtcatccaatgaatgtcacgatcaccattaaaatagactatggcatagaattgagcaatgatctccttgcaccaagcctgctgaagggtcgtgaaattgcgaacccccatctcctcacaagcgccaatgacggcattgaggtcaggatcatccagggtcgccaaagcctcccaatctatccattgcatgggcagtgtaggattggaaggaggcaaaatgacagtttcataaaagtcttgctgaaaagaggtccagtacctgtcatcagaggcaatgcgcggcatgcaacgaggatcctgattccgctccacagccacaatgtcagacttttggtgccagtcacgaacaggtcggtgaggattgcgcgagggagcatgaagcatgagggggccgatgagccccgccggaggaggcgcagtggtgtgagcttggcgagaagagccctcgccagaggaagccaaaggctgctgcgaagacccttgatccccatgagtggagcccccaggagggatagaagaccccccgggaacattggctacctgaggg

SEQ ID NO: 71033 - DNA, 561 bp, Oryza sativa
tagggactgccggactgggaagtggaaagggagaggagagagagatgggggaattattttggtactttagtctgaggtagaagacgactgttgtctgcctcaagattcgtgcgaacacgtgtcattcacaaaatgaagtctttccagatgagcgaaggactgaggtcctgtgtaattttcttccgccgcccgcaacacaacaaggtcagggggcatgtgggccccacttgtatggcccacccttccccacttgtatcacccaaaaaaaccgaaaaaaaagagaggaaaggatggcttctagaaggagaagcgccagaagcttccaaatagaacaattcggcgtcggcgtcgacggcgagcggcgcagagagacgccacgccggcgacgacgccgcctccatggcaacgaacgagtcccctaccgccaccgaaacagtggtactaccagcgggcggcagcggtggcgcgattgaattgatgatgaattaattggtgaggagaaacggcgccatgctcgccggcggcggtgccgatatgcatggatccatggagtattccaaa

SEQ ID NO: 71034 - DNA, 8780 bp, Oryza sativa
ggtcacgtattgttttgtttttttggttgaatcagcttcgactgcatgtcttgcactcactccaattgatcagagcagatacgattcaggtcgtgtgttgtgaattgtgtagccaattgcaaagtagaatgggttgtcaaatcgaatcttcttcttcttttacggatgtatccgcacgagactgaagcctaatcttttcgcttacgttcatacttatcaattaaaatttaaattttcaatcttaaatttaaagttgattttggggttttttcatcgaagtttctttttcagcttttaattttcgatcgctaagagcacctatatataagttttattcacaaattatttttcgtctacaaatatgccgcttcgaccatgaaactgaatttcctgtactggccgttagggaaatgggccgcacgtaattgaaatccaattctggcccaaactagtatgggccggacgtgggtcacggcacctttcaggcacaattaatatgggccgcacaaagtcctactcccgctgttgggccgcacataaccgaaagaacattcagatccggatatctctacaccatccgatgaagattacacggtccagatcgagttcaagagggtgccagggccagaggctctttttcacgggacaccctgtgttagcacggtttatcgtttatacccttcacgagttggatcgtccggggcctttcgccgccgccgacgcaagcggagaaggaaggcaacgaagaagaaaaggaggattgcactgcaaaacgcaatgtggtgttcttttctgtcagttattaccaaggggagttaatttgctttgcttgtgcaaaatcttactgtgggggttgggatgaaacgaaatgaaaatcttggtctcaagccttccatgatgctgtcatatcttcatcccaaattaggagagaatctgggcgagtcgacggccgtgggacccgcgcagccattgtcccttcccgcgctttccccaccgctcgaatacagcacatgtcaaccgcgcgccaaattctcccacatatatcctccacaaactcccaacgcctcgctcatctcgatctccatctccaaattaaacagaaccatttttataaattttagttgctgctcgttcctccgttgaagagatcgatatcaatatccgcgccatggccgccggtcaccggacgctgctgctcctcgtcgccgtcctcttcgcggcggccgccgtggcgctcgccgacgacgccaagccgacgatcctcacccccgtggcgaacaccccgctcggctccttcgacggcgactcgccggccgacgacgccatggacgacgaggacgccgcgccggtcggggcgcccatcggcaccaccatgaccgagcccaagcccgagctcaccaccacgccgggcgccgccggcgaggcggcaggcggcgccagcgccggttactcccttggtgttgcctctcacgtcggcgccgccgccgcgttcgtcgccggcgtgttcgccttctgagggcgaggatgctgggaacgagagaaacctccagccttgtgttgtgtcaatatatactgacaatacatacatacatatatacatacagcagtgctaatttgatgatgtacaattttcgttcttttcttcatccttgtacgataatgagcaaacattgcaaaagtttgcctcaaattctttcatgtaacagggcaccgtgcatttcaagattactggtagtttgcgtaaaatgctaaatgttgagtcgatcagaatgtggtcaaaatcaggcgaggaagacatacatttacagccacctttgcatctgcatcatggggggtcaacaaaatccttattacttcctcgaggacaatctacaagctacgctcttctacatcctgagtctcctaaaggcagaaaaagcacaatgctagggcattgtttcaaaaagattatgccgcctactatcttcttgtaagaatcgactcctgtagctgtatcctgtctgtctgaagctcgcaactagcacgtatggtcaattgcctatccttgggtgaacatgctgaagcagcagataggcatgaattggtgatcctccataggcacattatagcagcagataaggctagacccaccaccaccagtttccatttactacactgcagatttgtccattcgtccattctctacactgcatcttgttcgttctcttcgtccctcgatttatgagcgtcatgtgacgtagggtcgataactgaagaatggctgtcagttgattcctgaattatatcctacaatatagaatggttatattagaatctaaatacctttgattgattgaaacttgggtctgagagagctttgctatttgtttctctactttacctacttaaagatgtttgttgccttgataaggacaaagcatacctctttcatgcttccatttggtatcatttcatttgtactatggctaagtccaccattgccgttagctataattggttcattttcatgagattcctgttttgagtttgtcaacagcacagagaacttcagtttctgaaataagtgataaaacaatcaacaaaattacaaaaatgcctcacctgttcatctatgttgtctccagatgcatctgaattctgttttccatcgacgatgccagcttgtgtgcctgcctgttctgtctgttccgctttttccaaaaacacttttctccttgactcttcttcctttagttttctaaatctgaaactcaaaatgaatagaatatattttaagtactcatgttttcccctaacttgtgagattcaggaaactacaattggacatttcctgcatttaaatatcaatcacaactggacaactagattagcttctaggaattaactaacttttcatttaccaagataccaaccaaaatctctgttgaatgtccattattgtaaggctcatcgatctaatggtttgtgaccacggctgaaataatgcaggcattcaacaagcaatatctgaaaactagacagtacctttcaccacgttgtggtccacttggttctggctcttgactggccgggggtttaccaactttagggagaggatcactcttaatagcaggctcgggctttccaagattagttgattcttctttagcgagcttatcaatgtattctttgacgggatttttggcacctccaagcttttgaagccatacttgttgtgcagtgctaaggatattattcgtaagcctgcaagaaaagtattgctaatgacaaccacaaactatgaaaaattcaccagttaatgaagaagaaaaatgattaggcctgatgagagtttcacatatgtaaaccaagtttttcattccttcaatagccaaagtaacaggtttacagcgaattgcatatatttgccattctaaatagtgtagaaaatctggctctgttcattctaaatagaccatgaagaaagttatgatgaagctcttattattaaaagaaaaaaatctgaataaagagaggttgaaatctgtaaaacacacgcaccaatatagacttagtccagaaggaacagagagagcaaaataaccaattagcaaaggcaggaacttcactacagcttgagcaccttgttggctaggatcattgttctgcaggacaaatatagcaatcagtaagtttgaacacaaacttaatcagctattggtgtaagttggcatgatacagaaaaagaaattgtgtgccttgatcttttgtgctttttcagtggtccggattatttcccatgaagagggaacaaattatagagttcaacaaaattattactgtacagactacatatctttacaggtaatcttctggagatcttttcagaatcttgagttctataccaagaataattgaacccgatagaaattatgtgtttattcattagaagcaccatacagatataattcaactgataagaaaattcccatcggagtgttgaggaccaaaaggaattgaatacaatggactaaacatgctgaaaactttggtagaacaaacctgtggtggctgcattacttgagaagatacatattgggaaataacaagaagaactggtaaaacaaggtatgccagagtgtccgaccagccaagaggtggatgaccatcctacaacatcatcaattacactggagtcaagaaaaaaaaagagaagaaaagaaatgactccaaggtcaatgaaataaatgtcaactaacattcagaaatggtcctatccaaggcacttatataggttaatagcaagcagcattaactgtccgccgttaaaattccagaaataattagatgtgcatgtgcttgatttttgcaaatacattctagaacaaccaacggagtagagattgtgcacatacatttaaatcacatgcaatcacagttttctaatgcctgcaagcagacaacaccggcttacaaatggccttaacaacctgatcacaattctaaaagtcaaattttacaattaggtaaaaaattgaagttgcacatgaacaaaagttgcttgggtataccagggaattatcaagttctgtgtgcttaccgtaaagggaaatagccatgatattccctggccactttgccgtgcagcaattgttgtagggccagccaaagaaggtatccagaaaaagccttcggtaagaagtccctttcgaacaaagacacggatgcatcaggtgatgcggatgtttactcaacaaaaatagaaatgacaaaacacaagcatatcaacctcattagctacattggagagagctctgtatagaccaatccaaaccggtattgtcacaagagtaggcaagcaccctgttgtatagaaatgttaagtcaactgcaagtaaaactaatgcaggaatgtacctaagttgctaccagaaaaagggtaacagaaaaccaatataatgtgaaactattctacaaagccttgctatgcattgaacattgaggggcaaacactgataggaaatatatcaaaaatagtactacctgcgagcgggtcaacatctgacaacttatataaacgagcagtttcaagctgtatcctttcctggaaaatatgaataaataattaacctacagatggaagtgcctcgggtagtatttcaaatccattaatatgatctacaatgtacaccattgtgttaaatctcccgtgtgaaatgggtaaatggtagtttgtttacatggagtttatttgcagtatgcacttgcgtaataagtacctttcctacagaacattttgaacaaaatgacctcattagctgcatgtcttggaaggacttagatcttccagttaatgtgggcttcagtttattgctacataaataaggaatttacccccaatcaaatgaactgctaactaaaataaatgcaagaccttgccattagcccacagtgcacacagaagattcaacatgtgagcatgttatattattgtaaatcagatcaatatgtaaaatatacctacctgatcaccagcataacgttcttgaatagccttaacttgaggttgcagtgacctcattgcaattgcagactcaacctacaccagaaacaacaaatatgaacaaaaataaaaatttatgcaggaatagaatgtgtgtagttttactttgcatgaacatttattactacaaaatgccatcaattgatttgggacagaaggtgacagaatattcttgcagggtgaataaccatgtgatacacatgtttgcagtcaaatggtttccgcattgaagtctctgtcacaatgtcagtatggattaagtcatgcatgcatttattactggctccgctaagaaagtcctgaaaggaatcaccaatttattggatatgcttgaagctacagccggtatatataagaaatagaacagtacagatatgtaccaaatcatctataataatgtgttgaaaatagctacattattcgttcatctgtggatcacaatgtatcataagttgggttatggtaaatcttgttacttcctaaaaatgtgggtgaaaagtgcaggcaaattataatatgtctcacagaaagatctgccaaaatgaacattttcatggagtgatatgatcgtaaaagtaatcttaattatgaaaaaaaaaagatcagagagtatccttcaccaccttaatctgaacaattcacgatatgatatataaccacaacccaattataccactatctattctaacgcagcaacatggcaaaaaaaaatacctgcttctttgtaagaggaaatgtagctgccttgacgagaactgttagaaggatgattgcaaatccatacggataaggaacatggagagctgacagaccatcttttaaaacctgcaatagaaaaaagaaatgtaaatcacctgaaaatatgtagcaagcaaggtataatgttataagagtaataaaaatttatgcaaaccacaagatatcctagatgcaatgcataatggtggccactcattatgcataatggtggccactcacatgcacaaaaattgtagtggcaggagaacagggagataaattgtttgaagatttggtggtaaaacagcgtttgcccactgtcggttaaagagtgaaaacagttgaaattagatagcatggaaattccggccatacttttccgttgcaagtgatttaattccctaattagtaataaggcacagtacaaacagaatattgagtaataattgttggccattagccaaacaacaaatatgaatgtgatcacttcatatttccctcttcctatgaggtctccacacatatccttcagttcttttttgccttatggtccatcaacagctatgacaaccaaatcttacctaaactactttgggcatggatatcagggaatcgtgtttttgctttctttttttttgttaagtggatgaaagtgctgaagaaattccccatgattgaaccaaggtcacaaggtcacttctatggcaaaaccccttcctttcaacgggaatgctaataattgcctgatctgaaaaggatgctcagaaagctaattaaatttactccattcctcatagagaaagctttacccatcagcagagtagaatactactgtgcaactaacagcaacacagtgatacatggattacattgcccagagagtcgctctcgggcaatacagcaatctaacccaggttaagcagatttttcacctactactccgctacattcttaacacagaaaggttcataggtgacagcatcgcacaacactgaatggagaaggcgcgcgcgcacacggcaagacgctggaaccagctggatatgagaacaaagtcaagagtcacgctcaccttgagcacggtctccatggagttggtgatgccggagagccagtccccggccgcctccttggtccccccgccgcctccctgcaccacctccggggacgccgagacggccgcatccgcgaccgtgtagaggaacgcctcgacgcgcccgaacagctcccccacctccgcaaatccaccaccaccccccagcgccgccaccggtcgaagtacgacgcggcgcggggccacccggcgcgccgaggcgggccgcctgaagccggcgacgccaccgggggctcgcgcggcggcgagggctagggctcgcgggcgcgcgaggaggaggaggtgggcgtccatcggcggaggcggagatggtcggagtcggagaggcgagtggcgagtccacctaaactagtactcctactactaggcggagcatttggatacggaaatgaaattggggtgggacgcggcacgtgggccggtggtgcggggtgcacgacgccgcacaagtcaccgctatggtctatgcatgtgtgggcccacctagcagcgtggtgggccgggcctctttcgtgcccgtcggcctcctacgaaatttttttacgcacatgtttcatgcgagatcggcattaataattcctttggagactttgacaattcgggcctgtttggtacagctccaactcctaaataaaactccaggagttgagactggagaggagttgtggagctgtctaaacccagctccataactctagtatattttgtgagagagctccacccaactccactcccagttttggtagagctgaaactatttggttgagctccagctccaggaggggtggagctggagctggagctgtgccaaacaggctactttacctatatacgataagataagactatctccgtttttgaacataagatcgtgatgttgactttatgaatatgatgtttcaacatttatccctttttcatttattttatggacttgttttaccattagatgtatttaaatgtgccctttttctctttgcattttttgtattatatgtttgaataatataaatggttaaatgttacctccaaaattcagtagcatcatatatttaaaaacagatgaagcagataattagatgctaagccagcaacagaatgttgattatctagcggatatatcatttgtgtcacgcttccaaatttatggtaactctctaaaactttctttatcgatattgattacattgctttttccaagctattactccgtcatccatcatttaactctcaatctgtttcaaatgtgactttaaattactctatagaaccctctctgttttatataataagtcattttgactcttctcaggtttgataaaatttataaaataaaatttagcgattagaggtagcactatcttgaatatccaccccttattatgc

SEQ ID NO: 71035 - DNA, 942 bp, Oryza sativa
tgatctcaattaaaaatggctaagcaatcctttttagatttttaacaaataccaaatctaccctttcatatactgcaagtatatactttaagtagaatgtactgtaaaagtcctctttttttcgccccccatgtagttaagctggcaattaatcgtttttttgttcatacttcatttgaaatgtgtaggatcaacaaaacacacacacttgtgaatcgacaaacgcaacctgcaggtgctaggcatgcaccgtgaattattgtatattaatctgtcaaagactcaaagagcagcaaaggaaatgtctcatagccttgttaaacataactttgccaggagatctgtatgttttgatgcacacaagctgttatgagggttgctagttgctactcacttgctcttacatgcacttctgctggcataagatgatagtctggtagaggttctgttgttgagccctggaagtctggaacacagccggtgctcagaagaatttcatatcactacggcgtatcaggatttgatagagcaatttggtatgttcggtgaaagtcatacacatttgagcgattgtacagtactcagaaattggtgttttatatcctctggtagttgtggatcactgtattgaggaatcaacctgacgtataattgccgggtctgtaattttgtatatgtggagactggtgtgtataccaattttctgctggaatgtcatgcaatgaggcatgggcaaattctcttgtagggctttcatcgttcattgagtttaacatagctataacagtactgttttatatgacaaaataacagtactattttctatgacaaaatttgtgattaaactgtgttcacgatttcttttggttgtgcagaaaacaatgaactgataaaacatcctagagttagtgaattttgtgctggtgtaactgattctgaagg

SEQ ID NO: 71036 - DNA, 1878 bp, Oryza sativa
ggcgaattcgagctcggtaccctatgcccccgtacacacctctcctcccttccccctccccttcttctcttcctaatacactataaatttaaaaaaaataaaaaaacaaagttggaaaaatttatgtatagaaatactatattaaaaaatatttgaattcaaattcaaatttgaaacgggtatgtaaactttttacttataaactttgggtctataaactaatatttgaattcaaattcaaatttgaatcaggtatgtaaacttttgacttataaactttgggtctataaactttaggtgtataaactttagatgtatagaaatactatatataaaaaggggatgctatataccggaatcccgttcaaaaacaggacgattctgataccgatatgacatcgctctgagcaactgtcaccacctgcatgcattgcagcaaaatgagaatgacgaccagcgcttgccaaacgccggcttcccggcatctcggcgaaacctcctcggaagcgctcgcctccgcgcgcgattactcgcttcctcccgccggcgcgcgcgccgtccaccggcttctccccatcatggcgaatcctcctagaaagcgcgcgattcctcgcttccttccaccgccgcgagcatcgtccatcagctcctctgcatcccggtgaaacctcatcggaatcgcgcgccattccttgcttctttccagcggcaccctcgtcgtccgccggctcttctgcttccttgtgaaacatcctcagaatcgtgttttgcaaggatatgatcttacaatcaaaatagtacaaggtttgacagagaaagcttgcatcaatgaacttgacaccagtgggaggacaacatgctgagaaggcccggtttaagaatcgaggtgataggcagtaaaaatatgtgaatgagagtaataccatcaagactgtgagtatcttgactgctatcatggtgcctgcgggtttcattgatgatacattagtagaatcatgtgatacttgggaggtttcacgatccttctcggtatcataaaacctgaaggtttcacgcatgatccctcgctaggtatatatcatcttgtgtgatacctgaaggtttcatacatgatacatcaaaagtatcattatgtgtgatacttatgatgtatcacatgatcctacttagatatcatgcatggtatcatggttcctgcgggtttcacgtatgatacttgaggatgattatgtgatacctaggaggtatcatgatcctcctcagtatcatggatggtattatcaggtttcaccgatgataccttaggaggatcatatgatacatgggaggtatcatgattctgctcagatatcatgtctggtatcatcaagtttcatagatgataccttagaaggatcatatgatacatgggaggtatcatgattcttctcagatatcatgtctggtatcatcaggttttatagatgataccttagaaggatcatgtgatacatgagatgtatcatgattctgctcaatatcatgactggtatcatggtttctgtgggtttcacagattataactaagtacgatcatgtgatacttgggaggtgccatgatcctcctcggtatcatggctggtatttactccacaaaaagtctacacccatgtaatacacttcatttgttcatatatggggaaatgatttttgcttccgtcaacttccagatcaaatatatgtacatggagtggacatggataagttcatatcatttgattcgatcgatgtatcgtctgacactgcttagagcaagaaaatgaagaacctcctgttgatggagaccgtcaaccaaagaaaacgcggtgggtgtcggcgtcggcgccaccaccacgctca

SEQ ID NO: 71037 - DNA, 9601 bp, Oryza sativa
ccactccttgttattcttatactcattgttattcttgtcttgattgaaggatgcctcctcgcaagaaaacttctcgcaagtccaagcgctctagggatcggtctcccactccttccccatcctatcatgaggactcggaccgtgattggtccgggggaggagaagaggagaccggccctcaggtggccaatgttccccggggctcctctctcccacctcggcgctcaactcatggggatcaagggtcctcgaggcagctttgtgctttctctggcgagggctctcctcgctaagctcacaccactgcacctcctccggcggggctcatcggccctctcatgcttcatgctccctcgcgcaatcctcgccgagctgtacgtgactggcgccaaaagtctgacattgtggctgtggagcggaatcaggatcctcgttccatgccgtgctccgcctctgatggcaggttttggacctcttttcagcaagacttttatgaaactgtcattttgcctcgttccaatcctacagtgcccatgcaatggattgattgggaggctttggcgaccctcgatgatcctgacctcaatgccgtcattggcgcttgtgaggagatgggggttcgaaatttcatgacccttcagtaggcttgctgcaaagagatcattgctcaattctatgccacagtctattttaatggtgatcgtgacattcattggatgactcagggctcgtggtattctatctcttatgaccagcttgccaatctgtggggttttgatgagaactggatgcggtacatgacccacttgcatgacattgtgattcctcacaatcatgacttgcgccctctgtatcttcctggcggcaagttggggactactgaagggctcaagccttatcatatctatctcaaccgcatcctcaggcggaccttgactccaaaggacggcgatgctaaaaacatcaaccacttctccctctccatgctccttaggttcaatccccccagccgtccctttcatgtctttttatttgtttggcaggaaatccgcatggcttctcttcagtataagcgagggcttccctatgctcctcatataatgcggatgattgaacatgtcactcaccttcggtttgtgtgcgaggagccacataccgctctttccttgcgcttgcccaagcgcgggtctgtgcctcgggacatcccctccacatcctctcagccgccttctgctcctgagcgtccttcctctgtggctcgtcgtgagccgtctcccttattccgcattttgcggactctttttggcctttgctccgcggaggctaaaaagaaccgccgattgcggaatccggcgaagaaaacggctcatgacgtcaagtacctcaaggcgcggtatcatgaggaccaccatattgatatccctcctttccctccgggtttcgaggccgagcccgatgagcccgaggaggaagagctagaggatccatttgctggggtgcctcctgactttgatttctttggttatggccatggctatggctatcctcctccacctcctccagaggatcctcctcgggcgccccttgcttgagtctttgtctcctcgtcctctctttttggtgtcttgatgccaaagggggagactatctatcatctctatcctttatgttggtcgaacattagtggctttttatttgtatgagacatgcgtgtttcttaagttagtttaatgctttgtaagacattattgtttaattatggatgatgggatgtaatggatattattgtgtcttgtttaatgtgatgtcatgtctcatttattctatattgtggttgtgatgagatgaaatgattattatgcatgtgatgtgatgagcaaaatgtgagtctagttgtcttgtgagcttcaatgtggatgcaaagatttagggggagctctccacttgccttaatgcacacttctagggggagctttcactaaaactttgcaccaaaatcatctattaaatccattctctcttttgatctaatcgtattgtcatcaatcaccaaaagggggagattgaaagtgcatctaggcccctaatgattttaatgattgattacaatgcgattagagaggactaacatttttattcaagcaaatatgaatgttgttatgtcctcgacgtgttataatgcaatgcatatcccgtggatgcgacatcgtgcaatgcggcaatgatcaaatggtatattgtatcttttaccttgcattgtgtcataggaaagccgtactattaagggggatgatgcatagacatataaggagtgatgcgtgtgttcaaaatataattttcttggaagcatttctctatttggtttgttctggaagttttcggaagtattttcagaaattccgaaacacagaacgagttataagcttctggaaattttcggaagtattttcagaagtatttttggaagtttcgaaaatacacagaaccgtgtgagagctctctggaaattttcaaaagttccgaaaatgattttcggaagttccaaaaatacacaaaagcgttctggaaattttcagaagttccgaaaaatgcgttgacttcgattatttcccaggtctggaattttcggacgttccgaaaattgtttcggaagttccgaaaattacttttattgcactccaacgggaagatttgtgctgtgggtataaataaccacctcccctcacttgtgagggctgctggttccattccaattatttgtgcccttggcttgctctctctctagttcatttgagccttgcttcttcgattcatctctccacccgtctttgattcggatttggtgtgtgtgtgagagtgtggattcgagtttgtgtgggtgcttcttgtggtcttagtgaatatttgtgagcacttgcatcatctccgggagttctttgcatcatcttttactcttggagtttgaggactcctagacggctaggtgtcactaccgagccaccgatctacttgtggttggccgggagaagtttgtgaaggccggatctcgcctccgcaagggaagagatacctcttagtggaaggaggagtgcttagtgcaacctcttgaggaaagggttagctaagacccggctcttagtgagctcctcaacggagagtagaatcccctcaaagatttgaactcctggaacatgtttgcaagcttcaccttggtgatatctcttcatccctctcctctaactttgcttgcttgtgccgctattggtctagttgctgtatgtgcctttgtttacgtgtggtagacttctaaatctagatacttctttctgtgtgcgctgctctgtgcattttcggaagttccgaaaattcctggcctagttccgaaaattactgcttccgctttccttaagtttttaaattagcctattcaccccccccctctaggcctaattgaccttttcagaagccaaagagaagatgtacaagtgattggaggcaagaatcattcgaaaccaaggttggagggctcggccaggaattttcggaacttccgaaaataattccgaaaatttttggaacttccgaaaatttcagcccgagcactacaacttagatcccgcacaaatccaccaacaaaaacttgtgaaattgaatctacagggtctatggcactaggggaacaactccaccgaaggaaatcgcaagattaaactcgaggaatcgagggattcgattttaagatgggtacctcaagaacacgaagaacgcgaagaactcggtgaagaacaacaatgtagctgccaagaagacgcccaaccttgctcccacaaagttggagtggaggggagtgccggggaatcgctgaggaatcaccggggaggagtggatcgccggagaggggagggaggagaagaggaaaccgtggagaagaaagaggagagagagagagaaaagaggtccacggtcgggggtattagtatccctccgagaattttcggaaattccaaaaattttcggatagatccgaaaatttacataaacatttcgacggttctagaaattttccgaagttccgaaaaattttcggaagttccgaaaatatacagaagcgacgcaatggttctggaaattttcagaattatccgataactttcggaataattccgaaaaaacctggaaagctaacaaaaacccctttttgaaaggattcgcgccagaattttgatgaaaaacaattttgcaaactttttgaaatgcatttttcaagggaattcgcaccaggaattttgatgaaagcaatttgcaaacctttggataggagatggagtgaaaagaatggtcgaacatttaggccccatttgagcttatggctagcacgcaatcaaccacacaaaacaatagccacaagacaaatggatgatccaaagatcaaatgagagtgaattaccatgagacaagatgattcaccctcgaaagagggaatgtgcgcatctactgcaaattgtgttaggaccaacattcattgaaaaatgagatccccatacacatagattcaaaatatccacagaaatgtgacgagtgtccatccatgaattgaatgttcattttatcacaaggagaaaagtaacctatagtagaaataaaaaacaaatgcatgcaaaagatcaagccacgtttcgagaatccaagatatttagttcacttctcaactcacaaaacctagcttcatctagaggcttggtgaagatatccgccaattgtttgtcggttctcacatgttggatatctatgtcgcctctcgtggaattgtctctcaagaaatgatggcgaatatctatgtgtttggttcgggaatgttggacggggttattggctatcttaatggcgctcttattgtcacataggaatgggattttagacatatttaggccatagtctctcaaggtttgcttcatccaaagaagttaagcacaacaactctccgccgaaacatattccgcttcggcggtggatagggcgacggagttttgcttcttggaagaccaagaaacaagcgacctacccaagaattggcaagtacttcatgtgcttttcctatccactttgcacctggcataatccgcatcggcatagccaatgagatcaaacctcgctcccttaggataccaaagaccaatgttaggagtgtgcactaagtatctaagaattctcttcacggccacaaggtgacactccttcggagcggcttgaaatcttgcacacatgcacacactaagcataatatcgggcctagatgcacaaagataaaggagtgagccaatgatggaacggtataccttttggtcgacgtctttaccttgctcgttaaggtcgaggtggccatttgatggcatgggagtgtggattggcttcgcattctccattccaaacttcttgagcatgtccttcaaatactttgtttggcaaatgaaagttccttccttgagttgcttgatttgaaggccgaggaagaacttcaattcacccatcatggacatctcaaaacgcttggtcatcatcctactaaactcttcactaaaagacttgttagtagaaccaaatataatgtcatcgacatatatttggcacacaaaaatatcattattatgccttttagtaaaaagagttgaatcggctttcctgatctcaaagccattttttcacaagaaaattgcgaagacactcataccaagctctaggggcttgcttaagcccgtagagtgccttatggagcttgtacacgtggttgggatattttggatcctcgaagcccggtggttgctccacgtataccaactcgttcataggcccgttgagaaaggcgcttttgacatccatttgatatagcttaaaattgaggttagtagcaaaagcaagcaatatgcgaattgactcaagtctagctaccgtcgcaaaagtttcaccaaaatctaatccttcgatttgggtgaacccttgcgccactaacctcgccttgttccttattacgaccccggcctcgtcttgcttgttgcggaagattcactttgtgacaatcacattttgctgaagtcactccaccaaagtccacacttcattccgggtgaaattgttcaactcctcttgcatcgccatcacccaattcggatcattaagagcttcttccacccttagaggttcaagagaagacacaaacgagtaatgctcacaaaaatttgcaatacgagaacgagtggatactcccttgttgatgtctcctaagatgttgtcagtgggatgatctctttggatactttggtggattcttgggcgagctaagttgatcagtgagggtggcacttgcacgccttcttcaccttgatccaagcttgaggtagagggattgtcggcttgggttgatgtaggtggctccacttgtgttgaggaagaggctccttgttgtggctccctagggcgtacgtccctaagagccaaccttttgattgcttcactcgggtcctcctcttcacctaacacatgtgagtcaacttactctacttgagagccattagtttcgtcaaatgtcacatcacgtgcgatctcaacaataccggaggatttgttgaaaacgcggtatgcgcattcatttgacccatacccaagcaagaatccctcatccactttaggagcgaacttagaggatctagccttcttattaagaatgtaacacttactaccgaaaacacgaaagtaagagacatttggtttgttaccggtaagaagctcatagggagtctcttaagaaggcggtgaagataaatgcggttgatagcgtggcatgcggtgttgacggcttcggcccaaaaatggtccgatgtcttgtactcatccaacatggtcctcgccatctcaatgagagtcctattcttcctctcggctactccattttgttgaggtgaatatggagccaagaactcgtgcttgatgccttcttcatcaaggaaactctcgatgcacgtgttcttgaactccttgccattgtcgctacgaatgttcttgatcttgaggtcgaactcgttttatgctcttcttgcaaacttcttgaaaatggcttatgtctcactcttgtcatgcaaaaagaacacccacgtaaagcgtgaaaagtcatcaacaataacaagaccatatttgttacctccaatgcttagataagcaattggtccgaagaggtccatgtggagaagctccaatggtcttgtagtggtgtggacccccgtttttataacaggaatcaatcgtgtaaacagtaccatttctctggatcaagtagtctggtacacatgagttcatagctgaaataccaaatgctcatacacgagagtttagtgcgaattattacaacataagcccgcagacattgtcttaaatcatcagaccgagcggtccgaaatacaaccaaaagcagaattagataaggcagcggattttaggcagcgacatgccattgccacaggcaacgaccgtactaagacctactgagcgccatcgtcttcatctccctcctggtagtaggcatagggatcctccggagcttcatctcccgcttctgattaagtttatatttgcgagggtgagtaccaaccgtactcagcaagccaccacagcaacaatgcatatgaaaggggtatttcaaaggatggctatggttcttttgcgcaaagcaaattttgtaattcttttcacaagcataagacctagtattgactgatcaaattttaataccagtgtttgtatttaaacaatgacggttctgtccaccatccattgtgatcccaaggatagcttcccgccattgaatcgttatggttttctgaggacgctcactttcccccttctcaggaagtggctccaacagcataaaaattcatcatgcaacaacccatcccacacaagttaataatttagagactagccaagtgtaatacatgtcccggtgctcaataaccgcaagcacggctatttgaatagatttggtttactcacactgcagtggatatacactttacccacactccgcgactgcccaacacatgagccttgtctcaacacatgagacgcgtcacggcaaagcttttcgataaccccgcattggcagtacccgctccatgaacttttcatcctcatgcactctaggtgtacacagtttctagcagtgagaggagttctggcgcacccgggaagggaagttttacacccatgtaattaagctataactaggttcaactcaacacacgacagtcctagcaatggcgacaccattgtagaccccctgccatacacatgagaaaccactatgcatggatactgcctccgctcggctatttactccgctaggtctatccccattcgagaaatgtggttgtacgaagtcgtttcatgcttaacttcatggctcgatccttaattgaccggggacggtactagcctttcccagataccacccaaatccaccgtccgccccgatctaaaacataggtttttaattcctttcatgtcatcattatcatggcaatgtggtgttcatgtctccacatgccgcatctcaattaccttcccaaaggtaattgcccaagcatatagcgtttgataaacatgagtatgcaagattctaaagtagcatttctaagcaagtgtcatagttgactagggactcatacgtaatcgtggttacaaagatttaaggataaacaataatcaaggcatggcataatctcaagtaggatgttcatcattgcatgcaatcttatttataaataaaaattgatttcgcaattgggatcaacgtgatcaaagaatagtgatgacttgccttgctcgaggtcttgcgggtcttggccttcacccggatccgcggctccctcggtctctataattacgtgtgaggaaaacaatttgaattcatttagaattcaaacaaaatcgaaacaatgaccgaatgaaaaacgagcacgagagacgaactctacatcaagtatattattcgcgaagtggaattattcctctacctaaaatttttgtgtttcttaagaaattttgtgatttaaagtcataccctaagactttatctaattatctagtccttaattacatctagatcactaccgcgaattaatcccttatagagtttactaaaaataatctataacaatctataagaattcatctagtcatattctcattaatcctataattaaatgctagtattttaggtatttaattagtaagaattcatctaattatatttttattaatactataatttaattctactatttttaaatattttaaactttcccctaacttttcccttttattttccctctttttcctttttctttcttttctctcctctttttctttttctctcttttctctcttcttttctttctttttcctctcctcttttttttttctttttctcccggcccctttctccctctctccctcggctccttcttcctctctccctctttctacctaccaagaccagttggggaaaaggggaaaaggcggcggcggcacggcttaccggggcaacagcaac

SEQ ID NO: 71038 - DNA, 10891 bp, Oryza sativa
atttattccggtcgacagaaacgtgaaggtgatagagtaactaataacccagattaaatccggtcttaatctagagctatcaaagtgcattgcgaattaatgccaacatgtaccaagtagtagtgtatcgacaccggcggctgctatcgcaacattataaacacacagatgcttagcgtgctcgacttgtaatattcgacatcatcgaattgcagaaatattttggcgattgcatcgtccgcagcccattagtgtttgggcccaaaaggcccagctagaaacaagatcgaagtctcccttccgtctccgatggccggagctctgccgctgccatagcactaggagagagctactactagtactatgaagcaagagtaaccatgtaatgccatgccatcgtatgaccctacaggattgctctctctgttacagagaaaaccaactatacaaaagtggcaatgcttttgcttttcttaggtcatgtttgtttcagcttagaattattataatctgtattattatgagtaaactgaaacaaacagatagcttattacgatagaatattacaatctataagctagattactataatctagtaatccactctaaaggtgctttttttcattattggtttgctaacacctaacaaccggctaataatcctgagaaacaaacatctaacaatttattctatgtcggcttattataatccagcttatattaatatgtctcaataatctagattacaataatcttaagctgaaacaaacagagccttaaaaaaggaagatagagaaaaccaacttataactctcttgatgtactcactccatctcaaaataataaaaatgctatataccggaatcccgtgtccacccctcgggatgggatcccctcacctcgcccatgatacgtgcggcaaagaagacggagagcaaaaatcagtccaatgcaaagcaacaggacagagagcaagacgcatgcgatatccgtcaagtatcaactaatacctatcggtaccatttatcagttggtatctgacaagtatcggccggtacctatgaggtatcgagatcttatacctactcggtatctcgttcggatgaaattttgtagtatagctaccgtctaacataaataaatctaatataaattatggttatatctttttttattctaaggtgaaaagagtagttcaaaaaacattgacgaagggaatacttcaatgtgagtatgacctccggtctgctcttggtaaaaggtgccctgtttagatgggactaaaacttctaagtccctatcacatcagatgtttggacactaattataaatattaaacgtagactattaataaaacacattcataatcttggactaattcgtaagacgaatctattgagcctaattaatccatgattagcctatgtgatgctacagcgaatattctctaattatggattaattagacttaaaattttgtctcgcaaattagttttcatttatataatcagttttgtaagtagtctatatttaatactctaaattagtgtctaaatacagagactaaagttaagtctctggatccaaacacctatcgaagcagatctgaattacgcgtaccatcctagtacaacgtctgattttggggtgcaatgcttccacctaacaaatcggcatggttatggtgcacacgcattagcgagccatgagtttccgagagtatagtagtactgtactagtactggtacattaattaaaatgactccactagtccacttattaaccccacaccaccatctgtcagtctcatgttggattgaatccccacacggcacacggcgtgcactaatgacactgcctgcgattgtaccatcagtctacaattactggtaggtacttctacttattcctgatccagagccttccactgtcagagataaaaaggagaataaaaatggtgaaaaaactgaagaaaaaaatattatcaggaaggccgagatcgttgacacaactaaagagtcgtccaatcctatatattccagtcgtatgtatgtactgctatcactaaataggattcgtatcacgcacatagtaattaggcgttaaggacgatgatgtattatttggagtagtacaatatacgatgggtaataccaattgggtaagtagtcgtagcagaactagtgtacggtgctattacttgtttgggaattattcaacgtccaactaattatctgcgcgggtaataaatgcagtgaagtttcttgccacacttgccctttacatgattttcatagatttttaatgagaaaattccctatatacccctgaaaatttactcaatcccttcaatacccctgaatttgacatcaccccttatatacccctgaattttcattttgatctcatctatacccatctccgttagttgacgattagttgaccgttaaatattttaaaatgactatattacccatcctatatacatatgtggtacctacccaataaattttcatatgaaaaaaaataacttatacaaaatacaagcaatataatcatttaattcccaacttaaaaaataaaacttattattttttatttttaaaaaattatgattaaatccatacattagtttcaccagaaaattaagagcaaaaactaaatgttatttaggtttaattttttgggaagatatacgaaattcatcaaatttgatctgaaatttattttctaatttgtgataaactaattacatctcctttgttttttcacaacgaatcttttttcactaaatatttgttgaaaagtaattttcaaattttgtgcagaacttttttgacaataaatattttttattttaatgaaataatgttttatttttaaaaattcataacaaatatttagtaatttattccttattggttttcacaactcaaataatttacacataaaaaaatttctagcttttaacaatataccaaggacaagaaagtaatttctacaataactaacggtcaaactaatggtcaactaacggaatgggtatgtaagggatccaaataaaaactcagaggtatataagagatcaaacaaatttcaggggcgtagaagggattgggtgaaattacatgggcatgtagagaattggcccatttttaatccatttacatggtcaggagtaatctagaaattaaattacctacggttaattcgaaggtggatcacttcactctctataagaagcagtggaagcggaaacacactgaagcacacagacgagtgtgactgacatagctagctagctcgatctcgccggaaatggcagctcgcgtcatcctgctcctcatcctcctcatcgcctgcgtcgccgtcccggcggcggcggcgttcgagacggtgtacgcgttcggcgactcgttcacggacacggggaacacgcactcgacgacggggccctactccttcggctacgtgtccagcccgccgtacggcgccaccttcttccaccgctccaccaaccgctactccgacggccgcctcgtcgtcgacttcctcgccgaccgcctcgcgctgccggggttcctcccgccgtacctctcccccgccgccgccaacgccacccacggcgtcaacttcgccgtcgccggcgccacggccatcgagcacgagttcttcgcgaggaacaacctcagcgtcgacatcacgccgcagtccatcatgacggagctcgcctggttcgaggcgcacctccggcggtcgcccgccgccgccagggccgtcggcgacgcgctcttctgggtcggcgagatcggcgccaacgactacgcctacagcttcatggccgccaccaccatcccccaggaccaaatccggaacatggccgtcgacaggctcaccaccttcatcgaggtatatatatatatacatacatatatctcattaattaattaattgttttttctcggccttttggctatgtttagttcctgaaaaaaaaattaattgcttttagttaaacaaattacacaaagtgctaagctagtagaacaagacaagacgagaatttagaggttgtccgatgcgggtccaggatagtaattacagtgacagtaaaattataagtcgatcggtctaatactaattataagttatatagtttattaaaataatggtaaaactttttttttaatataggtgtccttagccatttaaaaacgaatgcttaaaacgtaaacttatataggaaaacatcaaaatcaagttttaacacctaaattttgtcgatagcttgtactccctccgtcccaaaaaaaaaaaacgaattagcactggatatccaaattcgtaatactagaatgtgtcatatccagtaataggttggttttttataagacgaagggagtactccattcatacaaaagtacaaagtatttttttttgtcactaggacgaataagtaagaccaataaataattaacgcatccatcatgcactatatacatatattatatctaggtaacaatttaatttagcatataacgactagaaatagattttagagttttgaaaaactaaaaaaataaaatatgaattagacttttggatgtactggagaggaacataggagctgatattagctaagagcattaactaatactttcaccgtcttataaaaaacaatatagaattatgtatctgagtatactttttatcttggtacgttgtattagaatgtgttatatgtccattcctggatttttttttcgaggcctagattcgttttttttttactaagcgagtaactataaggccttcgatggttcagaaattagaacccagcctgtcctaatgtatctacccctgtcggtgcatttgctactagcatgacagatcaagagcatggcgaccctgtagctgcagccatggcgaccctgtagctacaggtctgcagccgcatgcagaagagtagatagatcaggaagcacagtgacatctctttaattttgctgtccctgttcagcttgtttgcaaacatttactgtactgcttatgggaattccctgcttatgctgccatcttcagtgtgcgaatacatgagttcgtagttcgtactagccggagtattcaccgagctacagcctacatgcgattaggagtacttagttgcactgttcatctcaagaatatggagttaagtcgctgaacatgatgttgggaggctacagtagacgctttgatgactggaatcaatcagccaaccaaatttgatggccaccaaaatttgacggccaccatttactgccttgctctttctcctcctagcacactatactctcaaattctgaatccataccaagtttgaatgcagctagccggacatgcatgtgcattgatctactacttattctgaatactggaaaagtaaaaaaaacaaactaataacaaacacaaaagagcactagcagtattctctctctttttatgctgttattttaaaatagttttcttgtttataattaagttgtgattttgtaattcgcagccattcaacatacaatctaagtatatgataattggtttaaaaaaacacaaatattagggaatgacctaatatcaaataattagagaggtggcgcttcgaacccaaatcgtctagcccactaaattgtggagctaaccggaagaccgcttgacatttctcgtataattggttttacctaccttctgtccttcgagagagagaacaataattggatgcatggcaggcattgctgaagaagggggccaagtacataatcgtacaggggctacctctaaccggttgcctgccactgaccatgacgctggcccgcccggaggaccgcgacaacatcagctgcgccgccaccgtcaaccagcagagccacgcccacaaccgccgcctccaggccagcctccgccggctccggcggcagcacccggccgccgtcatcgcctacgccgactactacgccgcccacctcgccgtcatggcggccccggcgaggtacggcttcacggagcccttcaagacttgctgcggcgccggcggcggcgcctacaacttcgagatcttctccacctgcggctcgccggaggtgaccaccgcctgcgcgcagccggccaagtacgtcaactgggacggcgtccacatgacggaggccatgtacagggtcgtcgccggcatgttcttccaggacggcaggtactgccacccgccgttcagcaccttgctcgccaggcggaacaaaggcaattaagcaagtgatcatatcttttctgccattaagcaatattgatcagtgttgttgtctctttagtagctaggtgatcattgatcagcattgccattgaagtattgaactgaattctgagcagcatcagtattaagctcttcattcttgaatcattttgtgacttgtgtcagccaggcataccatgtgccattattgtcgacgacagagcattcaataagaagaaacctagagttttaggtgaagtttccacttaccagctcttggcttaatcagttttgagcatcctctcttggatactgctccatagtaataagattaagtaagctgcaccccacacattctttgagcgatatttgttcatattgtactcaagaaaaaaatttctgtttccatttacaaccatgaaggcccatgccaactggagaacaacgatgactcattttgaaggactaactaacttctatctactgaccaccaacaaccatttgcttccaaaacaaacacccatgggaagattgcagcaccagctgaaaacaaattgcaagttcgcaaccaacttcggacaaggttaaaggatagtaaagcaattaactgcagatctcagcatatcaaaagccaagactcaggattgagaggtgattgctggtactctgcgtaacccaactggcttctcagatcttccatcaatatgcccgccttgatataccttgtctgtacagttcaatcctgtacagtgctttttgaatctccaaggacctaacaaatgaggtggattcatacattagaagccactacctcaaacttgcaatgcaaccaaaaattagtaaacttccttaccacttgaacaatgcgctagacagctgaagattggcgaggtaaggttcgagagacaagcacagctgctccactcgttgcttttgctgatgccatctcttccaggcgcttccatgcgacttcttgcttcaattttgtctccttctctttggctttttcatcctcgtatttccgctgacactcatcatatacaccaacatcatgatcggagaacaatttccgaacattaagtgtgaggctttgcacagcttggttccagtgcccattagcatttctctcgagtgcagggaagatgataggtaagatcaccctactattttgtttgatcagattctcgatatgatcattgttccacaaaaacaatgctctctcagcaacctagaagtagcataagcactattagataaaatccatcaaccaatatgcgtatatcatgtttctgctgcttcaatataatttgcattaacaattccccgcaggaaaaaaaaggatgcactggtaattatgaaatattgcacaattaaacaaaatttgatgtgctaaattgtgaatcctcataatagcagggagtgattaactgattacaaagaaccagaaacaaaatcctgcacttaaaagcagatttgagatgtaagacaggggctctattgaaataaaatgcaagtataccctgtgtgttgggtcaactctcacactgttaggtttccaaactccacagcatttttggcatagtcaaacaaatagttatgggagactcatgcctgagcatgcggaattagccctacaatatttctccactcataacataacaagaaataaacaatgaaaaacaatttctatgtaacaagattcagggaagacgcataacagaactaaaactctatacaatttcaaggtaagtttccaaatgagcagtgtaagccattaataaaaaaaaatgaaaaatacaccaggactctataaatgatcactgttttagtcaatcctaactgtgagcataacagggctctaaagatgaatgctgttttagtcaaaccctactatctatttgaagggcataaggagtcagattgttttctatttcaacttacaaaactccatcataccttgggaattgataagaaaagtcacagatgaaagatcaattgcccttcaagtttttggttggtaagtaacatatgaatataaatccgtactgatagcagtgtcaatgcattgatacactaaagtagctcgtggctagactaagaaagtaaaccatgagaaaaaacactccgagctacagcttataacagccagttatgctattctttgacgtggttgagagggattttgttttccatgcctctttttcactaaggacccttggaaacccaagtccacccaaagagtaacactaattgatggttagcacataacaaacatttttcactagtttgaaatttcaaacggcacaataatatataggaaaataacttcagaaatccactcagcagcctacggtgtacacgagaacaattggtaggattagcttttgcgaaagattggctgctcaccagttcttcagtctaattatagagtgaccagcccttagcttgtattctgatttaccaccaaacagtaagtcacttaaaaaagaaagaagaaacaaagcccctacaaataaaactaacaaatatttggacaaacgaaattatcatgacagatgattggaactttgtaaatgataattcactacattctgatattctattataatgctgagctgtatagttctaacttctaagtgaatacccaacaaagggtaattaaacttaataaacactatatgtaggctagcttaacttgaacagaaacaaaatgtgcaaaatgagacggttaccatgcaggaaatgcatctgtttcagttttaacatgataaactgacgaaagaaaattacattaaagaagaaatgggagtaaaaggtggaatgaaaaatgaaggggaaagtttttaatgacagtcacgcaattaatgttacctggaagtgagaactgtttagacaatgtgcaatctgacggaaaagaggaaccatgcatttctgaaactctgcaggttgtgtagcctctaatatctcttccaactctcccaaaaacaagacctccttggagctgtttgtgattggccaatatttcaataggcccctgataacagtgtctgcgagtttgcagtctttttcaacaaattgtgtaatgcagtaagacaactgttgatggtacatcccaatgcactttggcttatgaagtggaatcagggcccggacaaggaacaacttatgctcctccttaagtggcagtgcaaacccatttatgatacttcctaaaatctccaatagttctgcaattccattgtgtttttcagtttcatagatgaactggtaaaagatgttgttgattgccttccttataaatggtcgatgtaccatgaactttccgtagacacggtgaagtatcgtcttgaggtactccctctccctagggtcctccgagtcaaagaggtcaagtaatctcaggacaaatgaatgatcgatgtatctttttgccaacttggcatcggtctctggagactgaatgaacctcaagaacagctcataaacaatctgcaagtgtgaccatgcaggatccatcacaggctcctcatcatccacatcgaaggcttcaatcttattctctctgggcggggtagtcagtgtcctgaataagtttacagaaaccatccttgtgatctcttgcataattatctccggaaacttcccattggctgaggcaatatagtcaacaagttccaacaaagtttgcctctttacttctttctcctttacactctttgttggatctgtgaagtcaaatgtggcacagcacaagttcagtttttttacgaacaggttattcttctctgtgttgggcacatccttaaagcttggcaacagctcaacagtcggttgtaccgaattcccgttcacccttgagtttgcattcccaacatgcatgccactcccataactaagcccagagcttgagataaccggtgtctggctactcaaattggaggacctttctgcacctcttggacccaatggtggattcggcactgaggggcttgacctgccaatagggtccttgtctccggatttggatggcttcttggggaaccgtccaaggatttgcttgatcatgctatcacccagcttagtcaaaaccaaccagcagtagctctcgggtgcttctgaaacaacttttctcccgactccaatgtggcaattggtattactgaaaagtaaaccctaagtccatttccatataacggggatctctcatccaaacgatgaagctttttgcagagctagtgcaccaaatggagccactctgacctgcttgaatcaaattgacaaggaaaaacaacaaatcaccctaagatcgctgaagaaaaacaacgcctagctatccacaggatcacatgacagttgatcagaggacggggctgagtaaaacgcgctctacctctccatcgccactccaaattttgttgaggaggtagtaatggggggcttcgccggctcatcgattcggcgggagggagctcacctagttggctcgctggcggtggtgctccgcggagacctggcagctcggcgacgggagctgtgcacttgacggggacctcctcatgcggcggcggcggatggcaggagctggaatacacagagacctccgagccaccggcggcgctcagagcaaaatca

SEQ ID NO: 71039 - DNA, 3606 bp, Oryza sativa
taatgtctgccgcgacccacaagcagcacggagatagttcatgacataccgagtgatgggatgtatgcctccaccttgggctgcaactcgagcaggatcacggcggatgagattttctaactccatgaatatgcctttgatcgatgagccgagggtgttgcacaccgccgtgacctctgcacggagcgcagcagagtacgggtcggcgaacacaggatcaaggtcagggagaaggtcccgcacagcctcgtacatgtccaccactcggaagaggcgctccggagcgcggctggaggaagagatagcatcgccgaatgatatgagctgcaaggcttgtgtgcgcacggcggcgacaaaggcaaggtccccaaagggggcgaggccgtcgaagacgcggtcacatagccggcgctcactgggaatcagaatacggaacaccatgttgaaggccgggatccagcgggcgatgtcgaattcgagctcctcccaggaggaggcatggacctcttcagcagttcgtgggcggacgccgaggcgagcaacgctctcgtcgacgaagccgcgacgcgcggcggcatagacctcggcgcactcgcggccgaagccggcatccaccatcctccgcgcgatctggtgcacattcgccaccgaccccggcgagagcgcgtcgatcaccacgtcgtagtcggtcaccggcttggcgattgggatcggctcgtcgccgtagccgtcccgccgacgaagtcctcctcgtcgtcgctcccgtccgaccggaacccaccgggcgccgcggggacccgcgtcgtcggggcgctcatgagcgcccggaactcctcctccaggcgcgccatgcacctgctgagcagctcctccgcgcggtcgaacaggccgcggttggtccccgcggcttccagctcctgcacggtgccgatgaggtcgtcgaccgcctcaaggaacgcgtcggcgtccgcggagtccgcccatatcagcctgtccatcgccacgaactgcgagatctggcggtcgagggtgcggacggtccgctccatcgacgtcacgggcggcggcctccccgcggccgccgccgccgacaccgcagccgctggcggcggtggcagcggcagcgtcggagactccggcatcgagtgctcccctcctccccctaagccgccgccgccgccgccgccagcggccgaggccgccgcggcccgcgcggcgtagagcttgtcgagcgagaggcggccgtcgtagttggagaagaccctgaggatgtcctccgtcatggtgtcgctgctccccagcgtctgcacgatgtgctgcaccgtcgcgagcagcttctcctccccgtcctccgccatcgcctcagtaatccgcgccggggaaagaaaaaaaaaacacaagcagacgtcgagctacctcacctccggggctggaacggcatcccacggcgagcggcacagccccgatctgcacgacgccttcacctccacgcggcttcgcttcggggtggtggttgggcgcggcggacaaggggatgaggaggaggagggcttccttccacgcagcaacgcgttgcggcggtggcgtctgggcgagggcgacagcgcgtggaccggacgctttaccgcacagcggcgcgcaagttgtggccgccgcgtcggggttggttcgaggcggccgtcggatgcggcggcacggacggtcggatgcgtggcctcgggggaagcgaaaggcggatcggaggacgcgcgtgacagaagaaaccgcttttctgacgaggtggggccccgggaactagtgtcagtggagcggtgggaccagacgatcggtgggtttgacgcgggagagaagccggggtgtggaggctgaccgtcggcgtggcggacgatgtggcgcgcgtcgcgtccacggtgcgttttgcagtatggagaaaaatacgggtcacacgcctcacacgcgttgcggaatagccgtaggccgtaggcagtgacccggtgtacgccccgtagtttttttttaattttttacaagagactttacgcccagcttttacttgtaagagttcttattaggccagtagttgttgacttgtgacttgtgagtttaggaaattagaagtgtggaaaagccagctcaccaggttgggttggtggatggttcgttctccgtccacatggatgattcgttggctttggtttggtggtgaccaaacgtccaaaccatgagctcgatggtgaactgccacggatcgaggccgtagcaccgcgacattgcacatcgcactctgctgtacttttagagcccgattaatgaacttggagcaagtttaatagcatagcacatcgcactttgctgtcctttgagagcccgataaatgaacttagagcaagtttaatagcatagctaactactggcttcaaattatctatagctaatctaagagtaagtttaatagtacagcccactactagctccaatttatctatagccaatctaatagccaatacatacaataattgcttactatactattaatatatgatcccacatgtcatacacacagtgtgtcttggagtccgtgctgcagctgactatagatctgtagcccgcttcccttctctctcatcgtttatcttattaaaatatgtttatagctggctaatagtctgctattgtacctactctaatagcccattcatactacaacattaatatctacataaataatatctttgagtccgtgttgcaactggctacaaatttatagcccgctttcttctctcttctcttttcttctcgatatgtgggtatagctagcttataatctgctattgtacttgctcttagggtccgttcggttggagtattggactgttcggagaacaaacaaaatacaaactaggtgatgccctacgttttgctgtgggaattactaagtaatttctactccctcagtttcataatgtaagaatttctagctctatatgtattcatatagatggtaatggatgtagacttatataagtctagatccattaacatctatataaatgtggatagtatatatatatatgtgtgtgtgtatgtatatatatatatatgtgtgtgtgtatatatatatatatatatatatatatatatctttcaacaatcgagcaaagagtaagtatgttgttaattattaacagcaaatataaaactaatttgtcaagccatatttgaagagaaataaatttaataaactttgtagagtattatagatgaaatttatgttgttggccaagatttgtatcgcaagaagcagaagaaaaaaaaagaaatgaaaagctagaatttattagtagtaaacatgaaacaaactaaataatatcttcgctttgatacagaatatatggatgaatgtatgttaagtattataaaaaatgatgaatatatttgttgaaatattatggaaataacgagagaggtgatggttggatctatttgcattttgatttgtagaacaaaataaattatggatgatattacatgtttgcatgagctatttaataggtagttattgctattggatgataaggtgacatgtttgcatgttgagctttacgg

SEQ ID NO: 71040 - DNA, 5651 bp, Oryza sativa
  unsure (1)..(5651): unsure at all n locations
cttcggaaaatgcacagagcagcgccccaaaaaagaggtatctagatctaaaagtctaccacatgtaatcaaaggcacatacatcaactagaccaatagcggcccaagcaagcaaagttagaggagagggatgaagagatatccccaaggtgaagcttgcaacttgtttccggagtcaaatccttaagagattcttctctccgttgaggagctcactaagagccggatcttagctaaccctttcctcaagaggttgcactaagcactcctccttccactaagaggtatctcttcctttgcggaggcgagatccggccttcataaacttctcccggccaaccacaagtagatcgttggctcgggagtgacacctagccgtctaggagtcctcaacctccaagagtaaaagatgatgcaagtgctcacaaatattcacaaagaccacaagaagcacccacacaaactcgaatccacactctcacatacacaccaaatccgaatcaaacacgggtggagagatgaatcgaggaagcaaggctcaaatgaaccagagagagagagcaagccaagggcacaaataattggaatgaaaccagcagccctcacaagtggggggaggtgggtatttatacccacagcacaaatctgcccgttggagtgcaataaaagtaattttcggaacttccgaaaattccagatctgagaaataatcgaagtcaacgcacttttcggaacttccgaaaatttctaaaacgcttctttgtattttcggaactttcgaaaatcattttcagaacttccgagaatttccagagagctctcaaacggttctgtgtattttcggagcttccgaaagtttccagaacgcctaaacacggttctgtgtattttcggaacttccgaaaatttccagaacgctccaaaagaaaaatgcttcgaagaaaaattgattttaagcacacgcatcactccttatatgtctatgcatcatcccccttaataatacggctttcctacgacacaatgcgaggaaaaagatacaatataccatttgatcattgccgcattgcatcgcgatgtcgcattcacgggatatgcattgtattacaacactttgaggacttaacaaccttcacatttgcttgaataaaaatgttagtcctctctaatcgtattgtaatcaatcatcaaaattattaggggcctagatgcactatcactgcacctaatagcattctgcaatactgtgtcgtataggggaggccaaaggagcaccaaaggtccaccaccaaatgtgagtgctctgcacgttggagagtgctgaaaacagccacgggtagttgttacgttaaaaccgtagtgcatgagcataaccatcggctggttgaaagttgtgtcgagaagcatcacttcttctcccataaatccattgatcaggctgtcaaggagatgtatagatggccagaaggcccgaggcccgacggcccggcccacggcacgatgttttggcccggcccaagcatggcacggcccgttaggggtcgggcccgtgccggcctggcccgaccaccggcacgttgggctgacccggcacggccgggccggcacggcacgatgggccgtaggccaggcccgacacataaacagtagggagtaaaaatagacattatataccacggtcgaaagaatagggacgtaaaatagacttattttagctatatatatgccagcccaaagaggagggacggaaaatagacttactttcactatacatgtgtcacagcccaaagaggagggacggaaaatagacttattttcgctatatatagtcacagcctaaagatgagggactgaaaatagacttatctaaaaaaggcacgatgggccacccgcgcctttgggccggcccggcacggcccgacggctggtgggccgtgcctgggcgggaggcgtggcccatgagccggcacggcctagcacgaagtgccaatcgggccgtgccggcccgatggctagtgggccgtgcctgggccgggccgtgccgggcgggccttttggccatcgataaggagatgatccgccacctaagaaaaaaacaacgtcagcctgtcaaaagtgaactgtatactagaaagcattcatggatcgatgaacgctctactattgacaaagaattctgtgcgcaatgtatgtgctgagattgcacaggacaacctgcaagatgatgtaaaaaagaccatggaactattccaaaagctttcaaagtcagaccctgacttcaaattttcagtacagcttgatgaggagaacaagataaaatcattgatgtggtgcagtggccgaagtcggaggatgtatagccatttcggtgatgcagttacgtttgacactacacaccaaacaaacttctatgacatgacttttggtatttgctggtgttttgctgacaacgaagacaaagaaagctttgagtgggcattttcagagtttattaacctaatgggtggccctccgcccatgaccatcctgactggttcgttgatctgtcattgcctataattaaatttttatatttattttgggaaacctttgctgcacttctttggttatgtggtgctttttgttatgcagatcaagctcccgctatggcagctgcaataaggaaggtatatccccatccacagacagtgcacaggtggtgcaaatggcatgtactgaaggacacacaaacggggattgatcaagtgtacgtgaacgacaaggaattcaaaaatgagttccagaagatagtaaacgaaatgatgactattgaagagttcaatgaaggatggaacatcactaattttgagatacaatctctagaagaatcctttcctgagtcgtgcctttgaaagtaaggaaatgtgggctaagtcattctttaaggatacgttctgtgctaggatgacaagcacacaacgtagtgagtgcgcgaactttatggtaaaaatttttgtccctcgcaattctcctctgcatgattttgttgaactgtatgccaagctcgtccatcaaagggaggaggatgatgaccaacagcagaatgacaattcacatgtgcgagagggaaaataacaattttggtttctttttcatatatgcatgttttgatttttccagctactatttttttccatgcctcgaataggtacgtatcaagcctgcttttgggtacccaatagtgcggcatgtagcacagatctactacaatcgctgcatacaacctattcgtgtaagaggtttccaaatcaacctcttatatcataacatatgaggaagagtctggtctgtacaaagctacagatgtcaacacggaagaaattgggtcttggtgtcgtggtacttatttggtaacccacaataccgacaacggcacatacaactgcgagtgtgggctgcagactcattttggcatcggttattttttaagaactataagttattttttaattatgtatttcagacattatgtaggtgtttctataactatattaaattcaataattataacatcacacaaatttcttaatttaatttttaactacaattacaagatcttacatctacaagttaaattttaactacatattcaatccccgtaaaggggacagggatggggcaagtgtggtgtttgtgtggcattgggaaagggaggaggaggtcttgtgttctatttattcatcaccggagaagaaagggaggtgccttggggcttggacaacgccatcaatggcgtcgattcgctgaaaggaataaaaacttcgagtaacaagttctaatggcttgattgagtgtgaaactcaaaagggaaatgaaggggtggatctgtggagtaaaactcctctattaatttggagaaacggcttgaggaggagccgaatcaaggggcggcgctggctagggttcacggggagagagagatacgggggcaactggaggtggaagaagggcctaactggtggggtccaccagtcagcagctaagtgcgtgtccggcatcgtgggtcggcctggcccacgcgcgaacagaatgacggggcggcctggtgagcacgcggcgctgggacggggaagagggggcacagcccacagtgggagaaaagagggagggaagagctgaggctgggccgggccgagaaagggtgggaggagagggagagatggagtgggccagcgactggtgggaggcagagagagaggaagagatgggccggaaatggcctaaggagagggaggtatatttattttactttttcttttttaagaaaatttgagaaaggtttttgatgcattaaaattatttatttataatgctatgaaaatttgaaaagttttttgaagcatgaggaatttaacaaaaattcccatatgccaatttgagttgaaacttggtgatttttaattgttgaatgctatttttagcctttacaatttctagaaataatttagacgatgaaattttagggtgattttagggtgtgacaggtggcctgacgtcgatggctatgccggctaggtcgtagcagtttgggcggtgggaggcgaaggcatcgatggccaagttgacatggacatggcttggtgctactactgttgaggagaaagaatatgagggtaaaatagatattttgtagcttctctctgctcaaccgagtgaatgttatattttaatgcttacagtgtccaccagaagtcttctcaagcaaattcacgttcttgcaacgtctgccagtaaaggccatatgttttgagtgtcctatagtaaatttggcctattaataggtataaatattgactgaaaatttgtatacctacaaacactacttatagaaaataacataggcctatgaaatagtactaaattgactagaattgagttaagtatggatatctctctctgtgcgtgcaactgtagatacacattgtcgattaaaaaagtttacaataaaatcatgatctataaatgagcacgtatacatctgtaaataatattattaattacgttgttgacgtgtaaattaattagttgtatccctgaagcatatggacatttcatatgagcaatttatccagaaaagaatacatcaaatagaggagtaattgctttccctttgtaactgcatctagctagctcttgctcttattaaaattggctgcctgaatgtttcagccatatgctcaaccaatcatcgcactctcaagctaagagcaggtacaataatagactattagccagctgtaaacatattttaatgagataaaaaataagagagaagagcagcgggctacagatctgtagtcagctgtagcgcggcctcttagatgcaatgtgtgtatgacaggtgggaccatgcattaataatatagtaagcaactattgtatgaattagctattagattggctatagatgaattgtagctagtagtggactatactattaaacttgctctaaatgaatcagactgtgaccaatattattgtgcagatgcggtgtgggtggtcccagggggtgatgcccgactgtgttgccctggtggccaagtgtgccagtgtggtgtggggtggtctangggcactgttgcccaaccacagggatgcccatgctctcaccc

SEQ ID NO: 71041 - DNA, 3399 bp, Oryza sativa
tggggttcgcttttgctcattgccatgcaaatgcaaatgctttgctaggctgtgttgttgttaagtgctgtagatgctgttgttaatctttaagccgtgcaatcaggaaaaggcccttgccacctaatgtgtgaatgatgagcctgtctcacatgttgaactaactaatactcctgctaccactaaccaatgcccatcacatgatggttatatgttttgagttaggattctctcttcttctttttttcatatatgcaatttgcaaccagtgataaagtcattagtttttgtcctcaactcgttaatttctgtacggaaaaaaatcattcgtactcataactcaagtgtcactgttctatattttggtaactcaagtgtcattgttctatatttggggatggaggtaatactaactaaatacagtgtcatggagtactattgatagaaaacatgaaggtatactgtaattttcgtttgtcaatttttaacaaagcttgacaattctagatgccattcgaagtacaggaatagttgtacatcaaaattattaaccagcagactgatcccaagggggatgatgacaacctgccagcagagatatttaagtcaacaaactgaggcatattttaggacatacaaaggaaccacctcaattagattgctcacacatatgaacagcagcagagaacccttcaaagcaaatttcagtttcaggtcacgctacgattgccaccaagtttgcaaataaaaaaggacttagatttctacctcatggttaacatcaatcttccttattcccaaaattgaggactctaacatgggcatcctaggagttcctaccactggtactcctcaaggaatcttcaagctgaggtgagaggtttccttgtttctttcattcttttcaattgatccttatctcacatggaaccattttcaaaatattagctatgtcctttagatcccacaataagctaattttgcattcttttatggcttcatctataaagtattacaatcaggagtagtacaaaacaacatacagacaatgctactttctctctgaacaattagctgttttgcaaaggaaacaatcagcatataatcatgtagtcccgcaaacatcaggcatcagcctcccttgcctacaaaatttgtacagctaaggatatctgtttgagcttgcaacatcctgctgctaaaactttattcactcagccaagctggaagcatctttcaagcgctcccgaagtatgtcacagagcttactgcaggcatccatgcagagctccaccgcctattagtggaaggaatcaaaatgttattaattcataatgttttagtatcatgtgttaatatagtggaaaagacacacacgttcgtgattttgccatcagaccactctccagtaagagttagctgcgtgatctctttgcgggctggcatgtacgccaccataaggctgccgtcttgccatgcttcctcgtcagaggttggatcaatgattatgttcttcccaaaacaggactgacaaagaagcacaggtggattgtcttcaaattcaaatgtcgagttttaagtacacacatggtaaaggagagagaatgtgaggccataccacagatactgatgtaacaaggtcatacatcatgattccagcatcagccaacgcaagactagcacaagaaataatgatgggaagatcacctgaaatcaaagaaataatgatgggaagaatggaagatcacctgaatttccagtatgaacgaaagtagttcaattcccatttgcaaggaaataaagttctgtggaataactcatgatgatatgaaggcttctctcaaaaacataagcaagacacattcttgtgtgccatcatattataccttgttcacaaagttaaagtgcaggtcataattcttcctaaaataagtaaatacggattattacagtaaaacagcctgagcatatcaaatgcagcaagatcaatattaatatgaaaaggcagagatcaaattcaaggatagtatcttactgccaccagactcaagaaccaaggcaaaaacatcaacagtggtctttggaaaagtgtgcaacatcactgcgccttccagagctttatgaagcattgcggagtactccttgttatctgttccctggaacaaagatgcaaactttcaacacttattttcaagcataaatggtccagtaacaaatttctccaaagagacaatggagagctaataaagcagcagacctgcccacgtataggagtggcaaatgttgtgtagctcacattgcaattgagtctaccagtatcactgtacaacattgctttcttgctttctctcggtccaaacctgagaaagtaataatcaaataaacatgaccaagcaatcggagcaataagacaatttcaacaggaatatacaatctgataagttttgactgacaagatacatgaaactgatgtaatatgaagctaggaagtacatgttaaaggtcagcctcaaggccttcaaactatcattgcgattgcctttttttttttgggttgccccttgagaaagggtaagccatagagacaaaaccctcaaaagtcataagagcacaaatttataaaatgctgataaatgttagcatgctaaactgatagatgtataaaacatactgatacatgaatccaagctgattatgaactgttctcaagagcttagtaacttttaagtgtatttcaagttcaaagaaagaagtttgaagtgtaaacatatttcagttgaccttaacttgctaatatttggtcccacaaatgccaaaatctttaaaaattcaaatttggaatgatgtgtaggaggatagattgggaatatcataatggaaactgttaattatgttttagtagcaagttgagtttatgagacacctttcacattgggatctaatgaaagatatgttctttaacacttggaaactaaaccataacgtacttacatacataacgtgattgtataaaaatgcaactatacttacactgacacaatgacctttgtcttcccaaattctgcataagcagatcctgatgcagcggttgttggtcctgtttgcataactgcaaacaaatcaaatttattattggctctgagcaacatatgagtcccactagtttcaagcatcaaattccagtgatcatagaacaatttgcagtaccattgaggttaaaattaatacttacaaggaagaaagaaatagaggtagtgaaacacagtttcaggtaatatatcaaagaaggttctgcaatcatgtaacatggatcataatattcatacatgaaaaaaattcgttcttccttcaaggttggtagatgcatactgtaaaatcctatataaattcaagtttttt

SEQ ID NO: 71042 - DNA, 602 bp, Oryza sativa
agcaaaaaaaaacaaacaaacacatttttgacaggcgaaaagcctcaaaactcaaaaacacaaagtggcgcgagggtgggcgctgtacccgtacctgatccggtggtcgggctgcgacgaactgatgattgattcagacggtagcaatgctgcggcggaggagtggaggcggagtggagtggaggatgggcagcagggagaggggaagcgtttaaaacgaggaaacggagggggggggagaaagagagagcccgcagtaaagccgttttgttgcgttcgcgtggcgtgggttcgggtgcagggtgcagcgcgctagagaggaggagagagaagcggcacgctcttctcgctgccgccgcggcgcccacttttattgcctgcggccactgatacgtgggtcccaccctactgcggggcccgctcgcctggtcaaaagcccggagtaaaagcgcaacaaacaaacagctgtgctgtaccagtattccacggtttccaccagtaaagcatggtgctcgatcggtgtggtagatattttggcttgtcacggtttaatttgttattggttcactgtaacgttatatactctctctcttacactgatc

SEQ ID NO: 71043 - DNA, 15384 bp, Oryza sativa
ccaaggcccggccagcgcgggcaggcgctcgggctccgccgcatacatccatgcattagaactaattatagtgcttagccattaattagcctagatgcgtacatacacaattagattagtactaattatcatacttagtcattagctaatagcccaattttacttctatccatgataaaatgctatatgtatttgtgtttacttattaatttattttctatcgttagatttgtctaggttaaaaaaaatttctagatccgccactccagttattgcttagttcatatctatgcgagagatgagtagatttttattctctatagctatttctccctctacgacccttcttcctggcgatgtcaggagccagcgtgtgcttgtctgtttggagttgatgttggggcagtgtggttgtggctttgttctagagatctggtggcaatggattacatggatcatagaagattaattcctatggtgccgttatccttacatatgtttgtgtaaaagcttcagtggtaagagtgatgggttaccgctcctccaaatttatcaagaacagaggcacatgacattaagaatgtttccggaaagacaaacaaaaccatgtacaacaaaagagaggaacatatggaagaaatctatagattatgatagcttccatattgtgtgcatattgaggggtcatgtattgtattgacatgatgcatgtaaagaagaatattggcgagagaattatggaattgctcagaaataacaaaaataaaagaaaaatatataaacgacaggaatgatgtgggagaaagagacggacttttggcagttataaagtgaaccgaatggatggtgtgcaggactgcaggattagttagaaaagtaaaacgaatatgacttcaatacttcaaaggcagaaaaatacacaacggtatagacaccaagatcaacttgatattaaagttttaaaatttaaaatttagctacaactgataagcaaactagcacctacttattatatatcaactagaatggtagcccacgcacatgcgcagacaccttcttatataatgtgagtgaaattttattatgaatatttatgtgcggggttttttattaaaatatttttattatattccaaactaaaactaaacttattttgtattctttgaacgctgctatttttttataattactcttgcaacatataaattctaaaataaaattatttaatatcatacggttttgaattgataagaaaatattgtgtcaaaactatggaggtggttcctaatctcgaagaaaaggatgttgttgcttagagttttttctattaaaaaactaacaaatcgctagtctaatgctttgttcatttttaatattttctagtattttatttaatttaatagtaccacatagcatattaaaagcgtttgcagcatgtttagaatgagagagagaaagctgctaaacctagcgggtggagatctatttgtggtattttaatgtaaaaataatattgattttaatttaccatgaagttagctcgttggtacgtacttgacgaggaggtcctagatgtgtgtgtttttttaaaaaaacgatctaacctttgaaaataaaataatagatccaccgatttaaatgaaaatcgatgatcgtggattagagtgtcacttggcaatctaggagtgtttgtaaggtgtaattcggcggtttagaagtatttataggatgtttaatagacttataatagtctttttcttttgacatttctaagattttttttaatttaagaatgctatatagtagcttagaggtgtttataaaatgtttaatggattttaacaccgcatgggggtgtggaggggggagggagagaggtttggcattttttattaaaaaaatataacaacctaaaatacatcaatttaagtaaaaatcgatgatcggttgctttgtatttttttaaaaaaaaattagtactttctctaatttaatagcaccacgtagagatttcgaagctttggtaggattttaaagtgacgaggggagagctgtagtctatttgtgattttttcttttaccggtaaaagtaattttgattttagtcttcttaaaatagaaatatggaaggaacagatgggatgtacgtatagtacatacgtacgttcgttagtacgatccaaaactattacgtatgtttgtacattggttcagatgttggctccagatgtttttttttttacaaaatagatataaccatccaaaacaatgggtacaccaatttaagtaaaaatagatggttggatttctcttatttattaggtgccacggggcgactcgtgagcatttatagggtgttatttgacggtttgggagcgtttataggaagtttaacggacttttagcccatgcattcgcctaggcatgcatgtatcattgttaaatatttttctaagatatttgttagttttatattatgtaatacttaattcatctatgtacgcacttatctataatcttacagccttatcttttcacttattgttataccaatcagccaaaatttgaattttcaactttaaatttggagttgattttggagttttctcattgaagtttattattcaacctttgcttttagatcgctaataacacgcatataaaattattattcataaatcacttttcgtttgcaaatatgctacttggcttattccaggaataaaccaattgatggggttgttaatcttctttatcatttaaaaagatgacttagggggtgtttagatccagggactatagtagtgcctgtcacatcggatgtttggatactaatttagagttttaaacatagactacttacaaaactaattgcataaatgagagctaatctgcgagacaaattttttaagcctaattaatctataattagagaatgtttactgtagtatcacataggctaatcatggattagttaggctcaatagactcgtctcgcgaattagtccagggttatgaaatgagttttgtcattagtctgcgtttaagtaaaccaaaaatattttatctgtaagcaagtaagatcatcattgtttattaacggatagattatatgcaatatctggctactgatagattaagagagatccaattaaaggattcaccattttgagttatctatatttaaacataaatgtagtcttagcgaaccaaaatgaagtattacttctactacttattatttaaatcttattaactaattctttgtgtttcatattaatggttctacgaaattataagaatttctacaaatggttcaatttacactctatggatatttttctattttattttatacaaatattattttgagatcaaattttacgatacgataaatagtgatagtggtacaccctatgtgccaatttttttaaaaaaaagtaatcaaataatattgtatctataagcaagtaagattattattgtttattaatagatagattatatgcgatatcaggctacagatagattgagagaggttcaattaatggattcatcgttttgagttatctatatttaaatataaatgtattcatagcgaaccaaaatgatgtatatcttctactacttattatttaaatcatattaattgattctttgtgtttcatattaatggttctatgaaattataagaatttctacgaatggttgaatttacactgtatggttattttctattttctattttatatacaaatcttatttttagttcaaattttacgatatgataaatactgatagagttacaccctatgtgtcatttttttaaaaagagtaatccaataatattttatctataagcaagtaagattattgtttattaacggatagattatatgcgatatcaggctacggatagattgagagagatccaattaatggattcaccgttttgagttatctatatttaaacataaatgatgtgaccagaactcgaaactctaaatggactaaacgctaagagcagcaacacgactcaactatgtaacgcaaaactcaacaaagcaaaaaccgaaatgaacaatgcaatggcacaatatggctaggtaaatgatgcaattttttcggctattttctggttatgggtagataaaaactcaccgagcaacgaaagctctgataccacctgatgaaccctgagttcctctcaacactcaaggctgttgttggcccgatctttcagtgagttgtagataactacgatttgggagaagcgttgacgacccaactacaaccgtacgagacgttgtgttgcaccttagcggtcgatacacctctccgagggttgttgatcctgccggtgcaaatcaaccttattcctgcaagcaaatcgaagaaacaagcaagaacaagggtcatgctccacctggttgaggcgcaccccacttgggccccacttgggccagggtcccaaatgaagctacaagcccataggcccattacaggtggcgcagcaccttggtctatcaattgcggctcactgtgatggaatttcgcaatgaggctggatccgttggaaagaggactccgatagctttccatgaagtatgcacgggccgaaaacggagctcgtatgcagatttggcggccgtttgaaatcagtagtgcagcaggtggccgaatcggattccagcacttgatctcgatatcttcttgttcatccatgatatgagctatggatgcatctgtggttgctatggtcacatcaataaatgtagtcttagcgaacaaaatgatgtatttcttctactacttattatttaaatcttattaattaattctttgtgtttcatattgttctgatatatgctacatgctgttaattaggtgtttaatacttaagattttccctaaaattttgtcttgaatgaccaatagattgtccaaagtaacgtattcttttacttgttaaatatagttaatttgggtcttaaattatgcaacaaaatctgatgtacgtgcataaaaaataattatatgattttagatcgtatagtcatataattaatatgttttgaatctaatatatttaaaataaaagagacatgaagagaaggggaggagaggccaatacgtatgttagcgtggtgttagaactacacgtacaggttggaaggggtgaaacgtgggcctttcaattttttatttttctatggtagaaagtaatgggtccaccatatttaaagaaaaataaatttaatttattagagtgccacatggcagtttaggagcatttgtaggagtgccacgtgacgttttaggagcatttatagggtgtttaatggacttttagtatataataatagatcttattatttgttagtctacaccactcccttcgtttcaaaatataacaacttctaccattcaaatttatcttaaaatataataatttattcaccggcctatattcttcacttgaccaatagtaaccttcacaatcttcccccgtttaatttcatctattttttaatgtccatatcaagccttaaaatccttatattttattttaaaacgaaattagcaattgaaaagatcggtggatagcgacgaacttgtcaatcatgtcttaactatatatgcaagcgctagatatctcctgcttgtacggtgcaagaaaagtcactcgtatttatccagcgtccagtcattcctgagctcgatagcatcatcaattgctgatttgttactgtcgaacgacggggcaaaagttgaggtgcagcttcctccttcgagagacgacgagcctcatgtgtcttctccttgatgatgatgtgcaggtctttcttcacgtgtgaaaatagtgtcatagttactgatgaactttgctaactttactaaacggttggtatattgttacgccgtgcggtgagaggatgcgcacctgatgtttactaagtagataccaaaatataatagtttgattaaatttatagaaaaacatagcaataattttaacgctaaaattagttttagtaaatctagcattgaatatattttgataataggtgcgttttgtattatagatatagctaaatttttctagaaactttgttaaacttaaaaaagtttaataatctaatactatcttcgttttttaatatatgatgctgttactttttgacaaacgtttaaccatccttcttattcaaaattttttgtgtaaatataaaaaaaattaagtcatgcttaaaaacaacgataaatcaagtaacaataacataaataataattacataaactggtcaaatatattttgaaaattcaaagtatcatagattaaaaaatggagagagtaatataaaacgaggggagtactgctatatattcctattacttagtcaatatattgctatctttcccgacaataaaagagcaaacaatttattcatcttctacgatccatctataagtatctccagtaagcataccatgaaattagagcccctttcaatcaaacaatttatttagaaatttcataagattgaaatcccataatatcttttttctatttggtctttttaacaaagtattggagcttttaaatcatatgaattattttaatggctcattgcatatagtttttgaaggaaatttagtaagagctctaactggccttaggagaattttatttgtcaatctctcatccgatatctatgtttctcttgcagtacaactaaaaggttacgggtatttagattcagtggtgtaaagttttggcgtgtcacatcgggtattatataggatgttgcatggggtgttcggacactaataaaaaactaattataatatccatcattaaatcgcgagacgaatttattaagcctatttaatccgtcattagcacatgtttactatagcaccatattaacaaatcatggagcaattaggcttaaaagattcgtctcgcaaagtagttgtaatatgtgcaattagttatgtttttagcctatatttaatgcttcatgcatgtgttcaaacgttcgatatgacagggcagtgtaaaattttggggtgggatctaaacatgcctttattcatatgttttttcttttcccttatttcataatctaccgttttgcacttactttcctatcaaaatcctatgtttttctaactctttctgtttttccatccctatcattctaagggctgaaattaattgtcggcaatccataggatgagattcctcgaagctgatcatgctgagcccatgttgtcccacaacgaacagagggaggaaagagaaacgatagactatatgattcatttgttcaaaaattcgttccaatcacatcttctcgttatagcaccatgtaaggttgcgttcgctggttctggttatagcaccatgtaaaatttttttttaataagatgagtggtcaaacagtacaaatagaaactcaaaatcccttatattatgggacgagggagtacaaaatagttttcgcagacgaccctcatacaggattgcacggaacacgagaacgcccatatgtgtgatatagatttgctctgttctaacaaattaaaagtatctcaaagtaccagtacctcatggtatcaaatcgtttcctatcgttcgatctagctaagtaggatggatattgttagatccaacgatcggaaatgatttggtaccatgaagtaccggtacctcgaggtacttttcatcggaccgaagcaaatctctatgggataagttcggtctgaaggatacacaggctgtatcacaggcgacctatgacgtccgcttaaatttcagctactgcgcattattgtgatgtctgaattaattaattaattttttttagtgattttggatatacaacatgagaatccatgccgaatttctttacatagtaattaataacccaaaaattaaataaatagtaaatcaaagatttaatttataaaaataagaaggatgctatgtaaatgtacaacagcatccagatatggacgttgttccccggaacgtccagatcaggacactgtttgtaacagcttccatcccgttggagccgaacccaacctatggtagggaagcctccactcgcatctggctggttcttggggagaaagctaactatcggacgcccgatgctcctcagaaaatcggatggtcaaatgttgcagttgaccaacaagtaaaatattaagttatatatggtgaaaaaaaatcagcaactgaaacaattaaatattttatgaaacatggtgaagatacacgttgaaacatgtcgctgtcacatatgaaacaacaagtattaacggattgaaacatatatttttcctttatcaaaatatagtcatgcgatatcttgttgtaaagatttaattaaaacgaatacaatggtgtgatcggatcatatattggataagtaatttaagagaaaaatcattttgaaacttgctaaaataaatgcacatgtacatggatgaggtagagagagagagaggagtgagagtagtagcaggtagtattaggaattttgtgaaacacaataaagacgcacattgaaacatatcactatcatgtataaaacatttagttttaacggtttgaaacacatgtttttattttgatataatataatcatatgatatcttgtcgtaaagatttaattgcaacaaatacaacggtgtgatcggttcataggtcggataagtagtttagaagaaaaaatatttaaagggaaaaggaaagaaaaaaagaaaaaactggacatacatgttacagtaataggtttcgtctaatccatctgcccaggcatccgatatttccgattcgctcggacgcgcgatataaaacgtttcccggttcttggtcgggtcgttgtcctcaacgctgctcggcaaggaaggcctccgctgcgtctcgctcggtcagcatcagcgccctagccgcgaggttaatagttcatatccgatcctgcggtccgattcgacccatgcatcctaaatatttagcgcacttcttcaaattaaatggacagctcctgcaaatggcggaacaaacaattttgtttcattatgacatgacaattttgatttctctctatcctatgtgttgtcgtacgttttattacatttaatatgtccttagtttttatgttaatcgcgtgcgtactttcttcggtggttgacctggccttatacggctagatttttttttaagtaactgtgtgcacgccaagttaaacatatttcttactaagttgaaaaacaatagttgtagaagattgaaggggaaaaaattgcttgactagattagaaaaccaaaatgtaaaattttcaaatgaacagcgatcaaatttggtgatatttcaaaagggtggtgtaacggctccattttctaagccattaaaaactatttttataaaaagtctttattacgaaagttttgttctttgtatgagttaaggatataaatgtcctttccgttgaacccaaaatcctgattcaaacttttcatctgcagtcctgagacacaaaaattcgagtatcagcccaaacccatcaaaaatttctcaaatacttcctaacacctctcctcgcaaaattcaaatttgcatgaaaagcatccaatatatattttcctttaaaacccttcctttgatccaagtatgatatttcaattcaaacccaattttaaattttacaaaatgtccaggagttcaatccaacaattccatggaattttccaaatgtcattattgaaatcatgccaccctttcccacttttttccggccaaccatgcccccctctccttttatcttgtttgcccacttcccgctctatctcttcctcactgaagttcaccccccttcttccctctttcctcctcaaccacctaacctcatccctttccgctctcctttgcttccattcctcctagccatttccacgatcagtgccatacacttattttacaccacttctcctttgcgcctgcctccgcccaaagaaaaggtctcactaccaccgcttctaataagcctctgattaggctttagcttattggtttaggcttttaattggttttttttggcttatacgatttataagacgatagatttaaatttctaagtttaagggcgaagtcataactccttttttttgaaaataatagaatgaaacattccggtctttgctcaagagctacagccaattattacaaggttcacacaaaagcaaagtcataactctacctcatataaaccaaaaagaccttcttcaacctaacttttgccttaacagtgtaagagtggcttgtgactttaaaaaagctataagaaaaagttgtttatttgtttatacttagactttttagactcataaactagcttatatgcctaaacaaagagggcctaagctcgccgactctcttcgtcattgtttagtgcccgagcttgcctataacgctgccactacacattatttctcatcgcagtcccacctaactagcaataaattgagttttcattttacacaattaaggctccatttgaaggaccataaaaggagacgagtcattagcacacgattaattggatactaattattagaaacttaaaagttgattaatataatttttataaagaaacttatatattgaaaacttcgtgttgtttatagttcgcgaaaaatacttacaggaaacgagacattgcccaaccgataagccgagtagcgcacgattaattggatactaattattacaaacttaaaagttgattaatataatttttataaagaaacttatatattgaaaacttcctatcgatgtttcagtagttcgcgaaaaatacttacagtaaactgacattgcctaaccgagaagccgagtagaacgcagccctagctaagttcctttgcatttccaacactattcatacgagtatttcgcatttacaataggatcatttgggtagttccaggagaaaatttgagtgggtgggccaggtaaagaaagaaaaaaaataagtgcacgaggaactaaaaacaaggagagtgaaagaacgtgtaaaagttgatgtgccaacggacacagagcttgcacttgataacaacgatttactacgataaagtatagatgtttggagctgaagatatagagatagatgacctttgtgctgctagctatctgtctaatatccacatatatcaaatcgaccgttgtgctacgtccaattcatatctatctagcttcgtcacaaacagtggtagagcttccctagctacaatcagatcaggattctctgcattagaggtttcaagatgtttgacaccgttgactttttagtacgtgtttgaccattcgtcttattaaaaaaatttaagaaattatttattttttcatatcatttgatttattgttaaatatactttcatgtacacatatagttttatatatttcacaaattttttttaataagacgaacggtcaacatgtgctaaaaagtcaacggtgtcaaatattttgaaacggatggagtacaagaattgaataatatcgtgcactaggaggtttgcagccatccaatcaatatatcttacgatccaatcaaaaaaaatggggcaattgcttatttgaccctattttgaaagctaactaccaatttgaccaatttgaccctattttgttcagtttggttatttgaccccgcttttcaaatcgaaaggaaagctgaccctattccgttaagacgagttaacaccgtaactaagtggtaaaatgacaaaaatgcccctaatacatccatctatcctccaccactcattcttatccactctctctctactctctctctctctcaccagagcactgccgagaagcggcggctcggcggcgcgacgcggaagagcggcggtagctcggcgacgaggcggccctccaccggcggcggaggagcggcggcagttcggcgacgaggcggccctccgctggcggcggaggagcggcggcggcggctgcgcggagcagcggctcggcgacgcggaggggcggcgggaggagcggcggctcggccgacgatgcggaggaccgccactggcggcagatgcggagggctgcatacgagcggcggtggctcgatgacgaggcggccctccgctggtggcggaggagcggcgactgcggaggagcggcggctcggtgacgaggaggggcggcgagaggagcggcggctggacggtgcgacgcggagggccgccgttggtggcggatgcggagggctgcggaggagcggcgacagctcggcgacgaggcggctgtagacccccgattttggaaatcggaaatcttctgtgtttatccgtaccaatccctggatcagtagttggtacacacatacatagttggatcacaacatatcacgaatgaatttaggctaaaagagttaaatacttacattagggccaggtaggccaacaactatcagagaacaacagcggaagacaaaataatagaagggcccggttaacatgccacaggcagtcgactggggaacgagacctagaacaagaccacactccgatcatcttgtgggatacgcaagcgtaccgacaagggcttctcttcaacactctcctaaaagatatataaatagcaagggtgagtaccaaccgtactcagcaagccaccacaacaacaatgcatatgatagcgggtatttcaaggaatggcttcaggttcttttgcataaagctaattttacaattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcccctcgggatgtggctccgtcagcataaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaagccctcatgcactctagacgtacacggtttctagcagtgagaggagttctggcgctcccgagggggaaaactcacgcaagcctaacatcgcatcctgtagttgaacccaatccatgctgtcctcttttgggtatctccttgtagtcttgtagtcttgccaagtcagtctctagccatccgtatcgggtatccgccatttggccatccgtatcgggtatccgccagcagactgcttgttcgtccacacacctaagtgaaaccactatgcagggatactgcctccgctcggctatctactccgctaggtctatacccattcgagaagtacggctgtactgaggttgtttcatgcttaacttcatggctcggtccttaattgaccggggacggtactagccttttccagataccacccaaatcctccgtccgcccctgtcgaaaacagttgtttaattttatttctcctttcacaaatcatgtcatcaacatcatggcaatgtggcgctcatgtctccacatgccgcatttcaattaccttcccaaaggtaattgcccaagcatatagcgtttgataaatatgagtatgcatgattctagaatagcatttctaagcaattgtcataattgactagggactcatacgtagacatggttacaaagatttaagggtagacaataatcaaggcatggcataatcccaagtaggatgttcatcattgcatgcaattttatttataaacaaaataatttcgcaattgggatcaacatgttcaaggaatagtgatgacttgccttgctcaggataatccttagtattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgcgtctgctaatagattccaatcacgctaggggctaaggtttcttaatctttctattgtcaacgtggcctatttaggagttaaccaacatagcatttatgggatacatatatatttggctaatcggtggtttagtctatcaaatggcttatggaaggattatggctaagcatgcatctatctaaataggacggttatatactagaggttctgttgttagatggatttaggatcaatcaaataattacagtgaatcatttgtattatttattctattgatggaagctttactttaattatgaacatattttacttgccattataaattataaaagggctaataattatccatgctctatatgttaaattcgggaagtttataatattatagttacagattatctcttaatgaacaatccggagttacaattgaactatgaacatatgaggtcaagatttataattagtacttatctgctattcatctttgttatattctccccggtttaatatatgaaaaagataaattaattgtgtaactataatgggatgtacaatatatgtgtgcaacaacgtataaggttctggtcacctactgtacatgagcttatttagaaagtgtactacccaatgctccaagtgattcctaaatatattgtagtttaattatacattagctagtttctatgagtgatattgtatatgtgatgcgacaagtttaagcactggttctattgggttactaataagtggtaatcaatttaggcatatataagctattctatatggtattgcatcgattaatttacttagtgattcctccacatctagctctattattattctcctaaacaggttaaagattcatctatgtgtgtttatattttagttgcataatcataaggctacacttgatttaaataacctataagccatggatttaattatatggccatcgaatattaaataagtactagtattttcctatatatccattcatttgatacatcacataaaattagtttgtgtggttgttacagtggcaagatatgttagagacaaatattattacatctactctactgtacaatactaattttatttattaacatatttttaagttgactattatgcatcatcttgatattaattatttaatatttataaatatattttatcaaatagtgaattatatatcattgg

SEQ ID NO: 71044 - DNA, 1293 bp, Oryza sativa
ccatcgactgattccgagatgctgcagccgataatgattctaagccgatgacgtctttgccgattaccaaatttcactgttaacagcgaggcgacatctatatcaaatttttacaaagcctgaatagttagttttactggttttggtttatttataggtgttgttaaagtgaggtttgcattaagagaatgactttagaccaacatcataatgtcctccaaagtccaaaggggaaatggtaaagggaaatagggaaaaaaaagagtaatatatgaaaatggggaaaaataggaaatttgtagcaaacaatagatggaccagacgggccgtgccgtgccggcccacggggggaggcgtcggaccaagcacggcccacaggccagcgtgccttgccatgactgggccggatacagtaccgtcgtggtcggcccggcccagcttagcacggtccatttagcctacaatacccctagccagttgccactcccgtcccaaacccttccccgaatcactccaccgaaagcggcgctgctgaggaaggccgacgcggccacggccacgctctccgccgccgccaccgccaccgccaccgtctcgtcgctgcatagttcgccggcctccagtctctctcgaatctagagacgcacgccgagctcagagacccgatcctgctaaggtttggttggtagctcgagcagccgacggcgacgacgcacacccagttcccggcgatgtcggcggctgccaccgctgggacctactctccggcttctgccgcgggggaaaagcgtcgggagaggaaggaggagctgcggcgccacctcgccgaggacgccgactggccccgcgccgacggccgctccttccacgactgccgtcctgcatgtaaatcctcctcctccaccttctcaacctgctccgatttctctgtttgctctgatttagtgccgaccctcatctccatggaacgcccccattcgtgctcaggggtccgattaagcaacattttctgccatcgcctggtctgcgctttaggtgctcgacgttatgcctgagtagtacacacatgtcttacatacaacggtagttccatgtcctcagtggcagagcaaggatgctgatgatggtgttgtggggcgaaacattcccactgtcaaatgttttcttttactgttcaagtcatcgtcctactgtgaatataccacgccttagactcttaggcactgacgtaatcgaaggaaaatagaacgacattgcgctctctatttgagcagggtattgaggaagaccttt

SEQ ID NO: 71045 - DNA, 622 bp, Oryza sativa
ttttaacccaaaacaaatatattatcaaaatatattttatgttaattttaatgaaattaatttcgtattgtagatgttaataatttttcggaattgctagaaaacttccgcaagtttttttttgcccccaaaaaactttcagatttgtggccatcagatcgcattgagatttgtgcatgaaggaaaataattggtagaaagaaattttcacccatctcacgcgtaagaacttgatgctaaccaaaacatagtagaatataagttttatataagttatattacagttacagcgcagttgcagtgtggttacgatgtaatttcacttcaattatattatagttatatctgaaaatttttcactcaaaaaacttactgcggttttcttaatactccttaatctttctataaatttaggtaaacttaaataagtttgattaagaaaaaagttaaaataacttataatataacctgttctttcttgtttctgcaggcaaagttccgtgtcaggtcaatggtgacgatggcgctcttcttctccttgacgacccggccggcatcgtcgtcgggatcgggatcttctccgtctacgacgcgaacagcccaacggcgcttgtggtgcagg

SEQ ID NO: 71046 - DNA, 940 bp, Oryza sativa
cccccccccccccgccgctttcacgactcgcgtgacgcgcgagtggggccaacctgcagagtcatgtggccggagggaaagtaattcccctctacttcacgtacccctgggcccatatctctgacagtagcccctgacgctatatcagatatcgatttcctgggatcgttctaacatggcgcctcacgactcctcgagctggggttgtgggcccggcagggaatccaaaaggatatcaccgcgtggcctggttggcgtactaaccacaacagcggtttgaccgcctctgactacgctcatgataaagacgcttgaggcacgataaccagggggtcagttagaccacgcctagattctctcgcccgctactcctgcggcggtagcggtgacggtttgcccaacttgtgctcatggccgttgcaccctccacctcgagtgtgccactaacgggcgcactaaaggcggaagcggatacaatgggcgacgtgatgattgggcgcgggatgcgaagagacaaatgcgggcgtgaggatcgtgagggcagttattggctcgcgaaatgaggaggtgagcgcggatgaggcgaggataaaagggggcagagaaggagactctgtcttcttcctttcgccaaccgcccactcgtcctttcgcttctcgaaccctaatattctcgccacctcacactgtctcgtgctccacgctctccatcacctcttcgccggttgccatggcccaagacaccggcgacgcagtgctcccttcctcttgcatcacggcagacaggcaccttagccttccttgcaagatcatgccggcggtccgtcgtgcgggcgggagagtcgaggccgtggccgcgatatccggagcgatccgtgcacctcttgtccttcgccatggtaggcttgatcccgctgttctccagattcttccatgaagt

SEQ ID NO: 71047 - DNA, 1767 bp, Oryza sativa
acgctcccatcatacttctcggtgatggtgggccggaaccttgggggccaacggacattccgaagactcgccacaaaggctctacagccgacaccaccagccgggggcacggagggctgatcctcacgtccatgtcgaggtgacactctggacgaggaggcgccctccgttgcacggggagtacgccggctattacgctcgatgttgaggcgggcatccggctccccatgctgatcctcccgagtcgacggtgtcgacgagggagtggcagccgaatgacgtgcagccgccgccgctcgccgcgccctccgccttgatgacacggagccggtggtagcggcgccggaggtcttggtggtgacggaccgtccaccagcacccaggcgttgctgcgccgtcatgaccaagttggccacgtcgtccagccatcgctgggctggagactccgggtcagggacgacaggcgggtgtcgtaggagcgcgccagcagcctgaagcgcgccctgaggcgtgctgccgtcgccgtagacgaggaggcgacgctccccatctcgccgttctcctgcaccacccgcgactggtgatgctgcggatttctcgactctctcgagcgcctccccctgcttgggactttggcgtggaggaggtgggggagtgcgagctcgacggcgcgggtttggctccccgtcatcgccgctcacactcggagagagattgtgcgcctttgcttgctcggccattaggctgaacaagggaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgcgatctcaagctctctctgtatgtggaaagattactcgccggcaagacacacgagacacggcgatgtatacaggttcgggccgctgcgaggcgtaataccctactcctgtgtttttgtggatttgtgtatggacaagttacaaaggatcaacttcctttcccctcagccttccaaaagggaaaagtcccccctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgatcagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcggggtgccccggccctcggggccggggcaagcgcaaccgaccccccctgggggaaat

SEQ ID NO: 71048 - DNA, 706 bp, Oryza sativa
ttgaagaattgttcatttgtttgtaaatctgtgcttgtaaatctgtgacgtgatgtatgcatgatttgatgaactggtgacttgatgaattgtttgtgattctttgacttatttgatgaattacatgtgaatttcatgaatttgatgtgttatgtcaatttgttgtgttgaattgaacctttgaaggggtttttttgccagggcgtgcctaggccggcacgggcacaatgggctagccgggccgtcgggccagcccggcacggcccgaggctacttgggccgtgcctgggccgtggttgtagcccgtgggctggcacggcacggcacggcttgttcgtcgggccgtgccggcccgactgacctcggcccaggcccggccgtgcctgggccgtgccgtgccgggcggcccatatggccaactatagctccagaggaggaagaggctgacgaggaaggtgccacggagctggcctttgtagtagaggatgaggaagaggaggtagacgacatagagggcctggttcatcatggacctcgtctgctggctgctgtcgttgaagctgaacgccgtcatggtgtcggcgctgccgaggaggaggaggaagcaggcccagacgacgaacagctcgttctggatggacgactactgcatcaggccgatggtgtaggagatcaccgggtagttaaacatgaaggctccccagac

SEQ ID NO: 71049 - DNA, 922 bp, Oryza sativa
cgcggacctcggtgaacttaacgcgcacgtagcacaggcgcggcacgtcgtaccgtatgtgcttgatgtgcgccgcgagcttgtcgtccacggggaacgcggcgtccgcgtggacggccgagtcgaagtagctgtccttctgcgtgccgaaccacacggccatcatcacctcgccgcggaactcccctttcttgtcgaagacggggtaccactgcggcgcgggcgagctgtcgggctggacgctcgccggcgcgtcggggaggatgcccaggtcaaggcgcgtgctgccgacgtagtcgtccttggcgaagccccggccccggacgagcacgtccaggaacggcgcgtgtatcctctcccgcgagaacgcgaacacgtcgtcccactcggggctcgccgtcttctcgacgtggcgcgtgatgcaggagtagcccccaagcctcagctccgcgaacgggtcgaattgcgccgctccacttgagcccccgcgccttgacgacgcgcacgtacaggtactccatcctctcgacgagctcgtacgccccgccaggcccggagcaggcgaggccaggcgtgatctccctgatcccgaactcattgttcggcggcagcatgccggcggggcgggcataagacctcggcagtacgtcgcccatgtcggcgaacactgccgccggtcgaacgagatatgctgggctggtctggtcacactagctggtcagtgagcaagttgcatttatatatgtgtgttcagcagtctggctggccaccaaccggccgcgcgcgtgacgtcgtgcgtggcgagcgaatgcgtggatttttgggatttggtgatcgacacagtcggggtgtgtgcttgctgacggacgattggtgatccaccagggttagttagagtaagtcccagagcaaacagacatga

SEQ ID NO: 71050 - DNA, 779 bp, Oryza sativa
ggggaaatcacgaggagggcggacacctcaccctcgggcccgacgtccccgaaggtgccaggccacgtgggcgattgcgtctgcctcaagcctctggtcatgatactcccggtcccatatcaccgacaatgatgaatgcatatacttagataatgaggaggctgttgctggtcaagctgatgaaactagaggtgaaggggctgccaatgaagaatccgaggatgaatcttgggctacatctgaggatacatctgaggatgcatctgagggtgatggtgttgatgaatctgaggatgagtcaatggcattggatgggatgccagaaaatattcctagcgcaacttatgacaagaatgacccaccaatgatcgtaggaagcatatatcctaacattgatgaatttagattggcaatagcacaacatgcaataaaaaaggagtttgaatttaacattatccggagtgaaccagggcaatatactgcaaagtgtgctgctcaaggctgcaattggaggatccatgcatctgtggttgctgatggtgtcactatgatagtatgtatttaatttaaaacagcatgcattcttcaagtattgtatatgtattttattgtggtattgaatatctttatatttcaggtgaaaaccaatccttttccacatgaatgctcaagtacgagaagaagtgagactatcaaggctacaagcaagttttggatttgtgagaaagtaaaggattggttgttggaggatgctagtgtgggagcgaaggaattgcaaa

SEQ ID NO: 71051 - DNA, 1143 bp, Oryza sativa
ttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatagtaaacctgtgagatgacgcggtggcggacgagcttcgcgcggtcctcggcgtcgtcgcagtcgtcggcggcgtcgttcggcatcgtcgccgacgcgatcacggccgacgacacgccgtgcgcgttcccgcgctcgtggtcgtgcgacgacgacgcgtccccgccgcacgcggcgacggcggcgacggcgccgcggctgtcctgcgcgcgctgcaggaagtagcccgtggcgatcgtgtcgaggaggagcgtggccacggcggcgagcatggcgacgagccccgtgaacgggtacttccgccacggcccgtccacgaggcacggcgagccgagcttgtcgaaggacaccgggaggatgtgcacgaacgccgtggcgaggatgacgccggcggcgaacgccttgagggcgaagaagaggctcgtgtccgggcggagcgccgggaacctccggccgagcgacggaatggcgcaccccgctgagctgcccacgaggatgcagaagatggcgatgaccttgagcgtccgggacttggccgcgtcgtggccttcgtcgctgggctggcactcgcagtcggcggcggcggcgagggagaagacggcgaggaggaggcatgcggttagcttgagatcgaaagccatctttttagcctgtggccaaagattggtgatgatcgaacaaccaatgtggagatagtatccgtacagttatatggatataagggcagtctcaaccctccatctagaatggtgtctatggcattaacttcattaccatgtaatacttttagcttatgtggtactatattaatta

SEQ ID NO: 71052 - DNA, 3804 bp, Oryza sativa
gcactggcgacgctgtcgtcgccgagccacatctcatactcgagcatgttgaggcccaggtcgaagtcattcttgttctcgagcttgagatgcagcgtggcggtggtctcctcgaaggagaacctgtggaacttgatcttctcgacgtcgacgtcgggcttgtaggggatggggatctcgccggacttctcgagggggagcttgatcctgccgatgatggggacgtcgatgaggaggacgaccctgacgaggtaggggatgatgctcccgggcttgatgtcgttgtaggtgctcttgatgtcgtcgtagatgagtgagatggggatcttgacggtctcctcgccatgggcgtggattgtgccggcgtccgggatgaggccggagacgagcttgcggccgtcgctctcgatgaggtagtcgatgtcgacgagcgggatagggaccgggttagggttcttgatgagcacgtcgacgacgaggtcggcgcggtggaggctgatgtgcgggatgtggacgccggagacgtcggcagtgggcttgccgaagccgacggccccctcgatcttctccccgatgtcgtggatgaagtccttcaccttctccatgaatcccccgcctccttccttcttttcgccgccgtcgtcgtcccggcggtccttcccgccgccacgctccgtcaccgtggggttctccgacgaagacgacatgctcgctaacttcaggtagcaacaacaacaagcgatcgaatcaagatctcacagcaagatcaaatcaagcaaacagatcgcacgccattgctaactccacaagaatcaccaaagacttgatcacaagaaagattgctttcttttctctttcctattctacacggctaggctacacacggcaacaagatctgaggcacaaatatcctccaaaacgaagcgagagcaagtagaaagaaacatagattgattttttcttactttacctgtgggttgatgcggagatctggacgaagcgagtggagatcgcgagcggaatggagaaatttagagagagaagaagaagaagcacgcggagagatgagcagagcagagcacgagcttatcgtggagcaagtacggcgtggggcccacttgcagtgacacgaacggactgccagctcagctatactgtcggctggacacgaagtcagaggcaaagcgagaatttttttcatttttaaatttttattttttaatatttaaaaaatattataccatccaaaatatttacataaattacccctgacacctaagggtgagtttgagaggaggggaaaagagaagattgggaagatacgtaaaacgaggtgagctattagtacatgattaattgagtataaactattttaaactttaaaaatagattaatatgattttttaaagcaactttcatatagaaaatttttgcaaaaaacacaccgttagtagttcgagaagcgtgcgtgcgaaaaatgaaacaaactaactcacaaactcctcctgccgaacgctccctaagtggagggtggcaaggtgtgcgtattttgcaccgagatataatgcaattttcaccttgtaaaaaatacagttttctagttttttttatcttgtccgtcctcacatcaccttgccgccctcgggatctacttctgtaaatgttttcgccgtacaatatttctgtaaatattaaaaaataaaaatttaaaaatgaaaaaacttaggcaaagcgaagtggctggaacctttacctgggccaatcaaaagccggtccatttggcccactaaccccggcccaacaaaaaccggtttaatgggcctccatctaaaaatcctatccttatctatccactggacacgaaggcaacacacctcgcctacctccactctctcgcgctcgctctccaatgccgccaccaatggcgctctccatctcctccaccgccgcggcgaccgctctcctcccgactctcccgccctcgcgctcgcgcctgcgcgtcgcgccgcgcagggcggcggctcgggtggcgcgcgtggtgtcggccggatacgccgcggggttctacggcggggcggcggctgcggccggtggcgagaacgacgaggtgggggatgaggagggttcgtcctcggggttcggtgctgggctagggataggaggcggtgggcttgggatgtcggccgcggaggcggcgctggcgctggaggagcgggagatgccgccgtgcccgcccgggcttcgccagtacgagaccatggtcgtgctccgccccgacatgtccgaggaggagcgcctcgccctcatacagcgttacgaggaggtaaaaatcaaaattactagtaaataattagctgcactgactaggcgccaatgcatttgctatctgctgcagtagacatgaatttccgaggaagatttgtagtggccaatgcatgagaattttatcttttgccagtttatggtaaatcgggctgaatttatggcacactggtaaaactcaaaatcactactagtggtaaataattagctgcattgactagacgccaatgcattttggatttgggctatgctgcagacctgctcctgcagttgacatgaatttctaggaaggtttgtactggccaatgcatgaacttgtcatcttttcccagtttatggtaaaccaggatgagttaatggcatacttgtttcttattaaaaatgctgtcatttggctcgttctgtcattaacattgcttaaaatcatatatcagtcattgtaggtgaagctgaagcaaatcattttgttgcaaatgtatactttctggtcaacagctacagccccatattatttgcgtatgtcatagtggagatacaggaagcataaaattgtttctgctgtagaacatacgtttactacagaacctaccaaaaaaatagttttgttattatatatccatcattccatcctgcgcgcacaatctcctgcattgtttagtaggagtagtagcaatcaccagttaacacgcattcaagtttaccttggtctttttttttttttgtcccataattgtcttggttgatgatcaatcaagcctcttgcccattctgtaaccttaaatttgatggtatcctgaagtgtgacttcactccataagatgttcacttgctacaaacctatctgcaatttgcttactgagttacttatggtggtttttcgcatgtcttgcagctccttgttgcgggtggcgccatgtatgtggaagtcttcaaccgaggagtcatcccactggcatacagcatcaggaagaggaacagcaggactggtttgccatccacctactacgacggaatctacctccttgtgacatacttcaccaagcctgaatccctggatgctctgcaaatgaggctcaatgctgacgacgatgtcatccgctcaaccagtttcaaggtccgcaagcggaaagccttttaagatcagtttcaccacctggactcaggtttccatgttttggggaatatgtttatatcatacaagaatcctactgccatgggaggagattggtttttcgctgcaatcgttgagaaaaaatgtcgccctttctgttgataatttagaagaaatttgtcttccttttttttcgttatagcactgctctgatcttacctggtactcctacacgttaagggatattgaacgaacacttttgtggagcatggcctgctggggcctctggaacaagttatgctgttaacaaaatcagggctcatttcctgtacgccatggcatttcatttataggctgccttacccggcatt

SEQ ID NO: 71053 - DNA, 4065 bp, Oryza sativa
taattgagatgcggcatgtagagacatgagcgccacattgccatgatgttgatgacatgatttgtgaaaggagaaataaaattaaacaaccgttttcgactggggcggacggaggatttgggtggtatctggaaaaggttagtaccgtccccggtcaattaaggaccgagccatgaagttaagcatgaaacgacccccgtacaaccgcacttctcgtatgggtatagacctagcggattagatagccgagaggaggcagtatccctgcatagatggttcacccctgagtgaggcaggtgcgctacggtgggacagccgttgaggtagggccgagaggcgtgccctacatcggtgtcaccattggtagaactgccatgagtgtgtgagagagagaacttaacttgaactataatttaatatgtgtgagacttctctttcccgggagcgccagaacttctcacactgctagaaacatggacgcctagagtgcatgaggatttaagttcatggagcgggtactgccaatgcgaggttatcgaaaagctttgtcgtgacgcgtctcatgtgttgggacgaggctcatgtgttgggcagtcgcggagtgcgggtaaagtgtacatccactgcagtgtgagtaaactaaatctattcgaatagctgtgctcgcggttaatgagcaccgggacatgtattacacttggctagactctaaattcttaacttgtgtgggatgggatattgcatggtgatttttatactgatggagccacttcctgagaagagggaaggtggacgtcctcagaaaaccatgacgactcaatggcgggaagctatccttgggatcacaatggatggtggacataaccgtcgttgtttaatgtgaacactggaactaaaatttgatcagtctatgataggtcttaggcttgtgaaaatatttgcaaaatgcagctttatgcaaaagaacctgaaaccattccttgaataccctctatcatatgcattgttgttgtggtggcttgctgagtacggttggtactcacccttgctatttatatatcttttaggagagtattgaagagaagcccttgtcggtacgcttgcgtatcccacaagatgatcccctgcggtcttgttctaggtctcgttccccagtcgactgcctgtggcatgttaaccgggcccttatattattttgtcttccgctgttgttctctgatagttgttggcctacctagccctaatgtaagtatttaactcttttagcctaaattcattcgtgatatgttgtgatccaactatgtatatgtgtaccaactactgatccagggattggtacggataaacacagaagatttccgatttccaaaatcgggggtctacataaataaatatgagcaattctaaaaagtttacattgtgaaacagagaaagtggcatatgtgttttctcattatattatttaaatatattaaaatgacatcataattttaaattttgcaataactttacgaaactacaaatgtgtaatattcatattgtattttatatacgtgttagttattaattatttttaatatcaaattttagttatttgtaaattatatatatttctatatggactctagactcgtcttttaatatttctttttttaattccaaattttctataaattgtatttctatatatactctgcacgctcacatataccaagatgtggtactcgcgtgatctcctgccggggactcgtaggctctcctacgtgtttagctcgcgcgagaactcgccacgtgatgggcagtgaccggatgcccaagtgcttatagctatggtcgtcccctgagcattaccacgtgttgacctcacgtcaggataaggatactagttagtatcgtttttctcaaagtaatatcgtatcgtagtatccggatactatgtgattttctttttaaagtttaattaatatttatattaattatatatagccattctgtataaaaaatatagtaatgatatatatcatgcaaatagagacatttatcaagagaaaccacgttggttttaatatatttagctgatttttatataattttgagcatatttaattacattattttcaaaccatgttatttaaaataagatttcgtagtatcgtagacatgtagaatcgggatatcacctaagatttcgtaggattgtgtagtaatgaatagtaggatcgagatactatgaaaattaagatactagataggatcgatatcgttttggcttggtaggatcgtaatatcgtaagatactaggatacgaattgaatactgacaaccttgcctcagggaagtcaccccgtggacgacaccgagctaagcattctatcatgagtcaacattaagataggctccgaaaaaactgtaatctttaatttcaatgagccaaatagaaaaaaaagtatatatacagctgtaatcctacgaaattagtcgacaaacccatgtttcaaaagaggcgtaaagaattggccacaggacgagtacaatccatgttcaagttggtaaagaataaaggaaaaaggtttgacacagtcaaatggaaacaaatgttacaatacaattagtcaagccaaacaaaacctttggttgctcgtgacaattttctcgaatgtatggcaagcattttattaatctttcctattagtattgggccagtcatcttaggctgtgtttagttcaacatcaaaattaaaagtttgattaaaattagaaatttaaagaaaaaaaagttagaagcttatgtgtgtagaaaagttttgatgtgacaaaaaaaaattagaattttgaaaaaaaagttagaaactaacaatcacctagataggacgttgcatttgaagagagcccctggcaccgtttgagctgcaggggcagggaatcctgcaccgtttatttaccctcatcagtcaccttgctcactttttacagtcttttgaacagtgacgctgtgactgcgaccaggctcgagacctgggccggaaggtccaaaaggaaatacgagtaattaatactcgccaaaggccccgaaagaaagaaagggacagtgcaaaaagaaagaatttttttaaagctcattggtcccaaacaaatctgtgttatcattgcacattgctactgcaattgacaaaaatacccatgtgagaaatttcagtagaatcacctgtccttttaaaaaaaggaaatacgtagtgcagacctaaaaactactatcggataaaaaaattgaattatgagaattatccatgtcatcacgaataaattttagatgtttatttttatccaatgataattttacatgtttccactacaccgttgattaaattcagtcgtgtgacacttatcttctgaaataaattgagtaccatctactccatgatccatgcatatactattctcacttgaataaaacaaattatcagaaaaccaagccacgtaattggagcaccttctacaggctcacatagccagtcacatgtctttaaccaaatgtataaaggtgttattgccccctttcaaccacatatttagtctcaagaaattatctccggattgtttctttcccatttatagatcagggacagtgcccctaaaccttttggcaataatgatgaaaagctggaatgagctctccaaggtttgctcaccacccttttgtccggtggtccccccatggccatgaggagcgttttcttatccttcccctccggctccgacgtttgcttgctcggctccctccgtccctctccgtgtctgttaaagaaggccatcagtgaagacggggggcaatggtgtcatttcgtacgccttttctacatattatatcagctgttctgacggcaacagcgtacggcgggggcgttatctcttcgggttgcgccgacctgatggcgaacgccgaacggacggacgggatgcggagctttgtttgcatcgccgcgcgtgtgcgccacggaccgagattcttttgtttttcctttgtgtggtgaacgttgttgcaccggtccggtatactccggcgtg

SEQ ID NO: 71054 - DNA, 701 bp, Oryza sativa
ccgtgggagaagttctggatcagcgtcgcggtggtgctcggcgtcggtgggctagtgttcggcctcatcttcctcatcaagagaagcatccccccgccgaggaccatcagtgtggtcaagcttcaggttaatttctctgaatctgatcttagagtgtccatgagcaattcagagtttcagactgggtttcttgatatgatcagtgatcgatcactgattcaaaattgtatatatactgattggatgatctatcttcgtctctgttactcgcaatttagattgcattgggtggtgtggctgcggcgaagtcgttccagaaggatctgaaccggattgctgagagggtgcaaggctctagccgacgttggtacaagttcatactgagcggtaatgcctattctgaatttcttgcacatcaaatctatttattctcctcgcaaaaaaaaaagaatctatttattctgaattcttgcacatcgaattctgctttggtggttccatgctaattacttaattgcagatggattatatttgacactagctagtagctttaaatataaatcgcacttaaaatgtctttaataataagacaagtagcaacaaaattaataatatttacataaatttattgaaccaagacaaatggtcaaactttgtagccaaagtcattcacgccaaatatttattatcggagggagtag

SEQ ID NO: 71055 - DNA, 13933 bp, Oryza sativa
cccatctccagcatgtcgccgccgacgaatctcctcaccccgccgtcgccctttcctttccccccaccgccgatgaaactcctcaccccggcgtcgccccttcccttcccttcccccccaccgttcatcggcgacgatcccaccttcggccctaccggatccctctccaccaacggtagagaccctcatgccctaccggattgatttgataactacaagctccatccacacccagtgctccactcaggtttgatcccagttcgctgcctgctccactcctttgatccctgttccccccttttgtccagataatcgcacacttgggcaaactcaaccaaatttcgattttcagatatattgtcatatagtgttacacaatgagaattcctgctcacaactaaatagctggacgtgctcctattttcttgcaatgctatatgttagttttgagatgcagcggctaagcgagtagaatttgtgagctatctaagtaggatatgatttaattggtgcaaggttaatcacaatagcagacattttgtagattattattctctaccctctgagtaaaaaactgaaaatagatgtcttagcagattcttcagatgttcagcagaccactgtgcgtgaccccgctgattggaaacctcctgtgcgcatatcctgctgtttccagtccatgtcctcggttcatgacctgaattgaaggtaaaagcagtttaccaatatttttactccttaaaaaacaaaggtttttactctgccaattgatttattccgtgatataaatcagcctctattgaaacctatagtgctgaagttatgctttatgaatcagtactattttctaccgccaaccattgcaagtattcattatggtctttatcatggtttatggtttattatgaccactagcaatgcagcgtgcacaaatatatatatatatatatatatatatatatatactgattcctttagttgtctctcatatacaattaatggatatatctaaaaactgaacagtacggggcacaatgcagcaggaaaatggcttactgaatgaaaagtatgaacataaattcatataatgccaaaagcatatattcaagcctagctttcattaaaatacaaaagtactttcctctagaaaaacacgaaagtccttggatataacaatacacgtgcggtgtgtgtgaattaacatggtagatgtcatatcaattaactcatgtgtaatgttttgcgatttaaaaaagccacttctgcatggttgaagcttttgtgatcttatatgcaaagagaaaggtaaaatgaaaatatcaaccttgctcacattattcatgtttgtgttgatcctttttctaagtgtattttaatttgatctttgtgtcaggttataggaaacaccgtacctcttatgaacagttatgctacagaagtcctttttgggaatttgggttcaatcacacttggaattaatatgaaaatttattttgctataaaatatgaacattgcggccacaaagagtgttaattttcttccaattgattaaaggaaattctccatgaacccaagtttaaccactttgttcctttgctatagggtacagttatttaatttactaggtgaaaccccacgcattgttgcgagaatttagtatgataacaataaaaaaataacgtgtaagatagctaaataacatcagattaagtaaattaatgtgctttatgataatttaaatttaaatagtatgcagaatggtgattcaaacgtaaaaagtaaggtggtatgactttatggaagaagaaaagtagggagatagtttggaccgtagattaatcatctaaattctaaaaacaattgatatgatatgacttaattagaggaaaaactgaaaaatataattcgaaccatagattaatcatttaagcactaactaagtgaggatgagctatataagtttataggatatcataaaacataataaagatatacattggaacattatgtgaattatgttggataataatttaacatgtttgtatttgaaaagctcttaaattataaaaactataaagatatagcatgtttgcttgatgtttaaatgtgatgattgttagtggatgatgatgtaccatcttgttagtggatgataatgtggcatctttgcatgttaagcttaaggagttagtgggggataactttatagtaagatagaattagtgtacagtgaatgatactgtgtaaatgtttcatctttacatgagctaatttgtgtgtgtttttaaatgcatgcagtgtcttgtctcttcttgtacaatggtgaccacaaggttatatgttagtataggtccccacatgttcaatgtgaaaactcagcgaaattttatagacccaactgcaattaatcaatgaaccgaggtcaatacgagtcatatcatgctgatattagcggtgttaacgggacggaaaatacgatcgaagatgattatgtccgtcagcctgatgaaattgtcattggttatgcagacattgaagattcagtgaacgcactgattgaatatgtgaatatgtgttcccctcactcaatgatgagagatatacaacctccgcggaatatatgagcacacgggccattctctcaacagaaaatgatttcgtggataagctgaacaggaagatgatcgacaggtttcttggcgaggaaaagatttaccatagctttgattctgttgatgatgattcccaaaataactaccctttggactttcttaacacgataactctaaatggcctctctccacatgagctgaaagttaaggtcaactaccatgctattctcctccgcaaccttgatcctaacaatggattatgcaatggaacaagattaatgatcagggcattccaagacaatgcaattgatgctgaaatcgttggtggacatcatgcacgaaaaagggtgttcataccaaggatctctctgtctccttcagatgatatttccctttctttcaagtttaagagaaagcaatttccaatacgtctaagtttcgcaatgacaattaataaatcacagggacaaaccatcccgaatgtcggtatctatcttccagagcctgtattctcgcatgggcaactttatgttgcattatcaagaggggtgtcgagaaaaacgacaaagattttggcaaagcctaaaaaagaagtgcaccccacaggaaggagcacaagtcactatgatgttatatctttttcaatttgagttatcaaatgtcatcccatagcattagcatgggcatgtaatagaaaaataattataatatgaaaatgcactatattatataaaaaaaatatcacccactggtgatgcattataatgacgcagatatatacacacacgcacaccacatacagaaatgacgcttgtgagatgaataaatattgatatcaacgccattgtaaattattttgcgtgtcacggatatatgcattatatatcatattattatgcattatgacttaagacacagatatgcgcattatcatatatctttaatataatattattatgcattatgacatggggcacatatatatgcattatatatctgcatcaattggtatatcatattattatactttatgttaaatatatttgatgtacgaagtaaattgaattaaagctcaaatgtatagttcatatagtaatatttttttgctaacatgaaaattttaaaaattattaaagacaaatagagttacaccgggtatattactagtacgttgtgatatgacccgctaccgtatcttactcctacattcttatcatcagtttgctgctagatcctcgcgtgtttgttaacgaaccagatcttacacctacccgtaccggaatgcgtaaaggcaaagctatgcctgggaagttgggagtggagcagcgcacggctcgtcgcgtacgtacgtgctcgctcgagcgcgattgtgagacaacgtgacggagcaacgcgcgcgacgcgccacggtgtgcgctagctaccaactagtataccgcgctacgcgaacgcgggttcacggtaccgaaacgcggcgaggagcgcgtggcaggagtacgtagacacagcacgcagccacgcgcacacgtagtcgtgtacgtacgcgcgcgtaccggggaacgagcggtaggcgcggggtcggccgacacggcgaggcaagcgcgatctcgatccgtctctctctcaaccccctggtgcagtgccgtccttttcccggcattttctcccacgcccccccgcccccgcgcggccggggcgccatgcgttttgcctcgccaaggccacaccaccgaagccagccgtgcctcccgttcccagatccacgcgcgcaccgcgtgcaccgctgctctgactgcttcgcttgtctccttgcgtctagccgcgcgcgtttgtcagctccagcttccacacacacctgactactgtacctgacattaacctgcacgcccactttgcaacacaatcgttgttcagctgttcaccatgcctttgactgtttaacatcgatccatatatacgtagccagtgaagccggtgtacagttgagtacattgtacctgaggaggagtaattcagaaatgtcaaaggctgggggtctgtctgtggcgttctactaaaatactagttcagacatgtcaacgttacggtttaactagccagcgatggcaacactggaaccaacaaaataacaaacaacagtaaagtagtacggcttaagtatgccaacttggttacatcgaggatgtaaactgtgcttagtttatcagtttaggtgatatatatggaccagctccatgctagctaggagtagctagcaacaactagaacagtggatcgcactgcgtgtaataattgcaatgcacatgatcaagagatgttctgggaattaaccacggcttgcctacaaaattcacgtatctgtacttgtataacagcctcaagaaaggggacggatcgagacattcatgtgcggtcgaggagatgactctgcctcggttctcttcataaccaatagtacatggcatgcatgcatgccccattcttccttcacctataagattttatctctgttacgcgtgacatgaatgcttagtttaatacgtactgttagtacttctgcattactgtgattttctgcacgttgtatagtggaattactaagtcacaaagcatttaatttaaacccgatctgctaagatattttacctctagaaaaataatattagcaaagcattgacaaggacttcattctaagaaatgttatcaacgaattcaacttccagaatatatcatcatacgagtcaacttatctcaaaaatatcatcaccatcaggattccatccgttaactctactctgttagcccatttgaaaaatgcgatagggttaatggagagtaatggatggaatctgataacaatggtatgactcatatgatggtatttcctaaaagttacattcgtcaatagcttttcttaacatggagaatttgtcaatggcattttggattttctctagtaagatttacacattgaccctcttatatgatgcaataattctaatattatatccctttccaatcacaaatttcagctgctaaaacagtggagaaaatggtcaaaagttattgtaacccattccagaaacagagctgttaatgccaaaaaaaaaaacaaaggtgcatttgtcttacaacttgtcatatgaagaaactattctgaacataccccgatgtcgttctgcagttgtatatattgctccaatgtaaacctatcacacatggtcccttcctccctcagttctagcaaacccctcgaagcattgggtgagctccgagcagtacagtgcaagcctttctcacttctatctatttcgatcatatcatatatccagacccttccatgttctctagcttcttgtatatatatccacttgagtgaaccactactgctatctgctccatgcctagccaaagctctccgcaaactctcaatgggaagctaaagctcaacaccagcaccaccattctcctgttcatcgtcttcctcttcactctctgtatcatctcatgtgaagctcgtcacgatcacctccgtatcagtgacaagtactcgagcaagaagtcttccctggttcccaaggtcacagcagatatatgatcattgttatggaactattttttctcattcctgatttttttttctctgtatcacgcaggatgtggctggagacgatgttgttgggagcaagcagccgatcgatcaatcagtgggcaaggaggtgacgctgaatgcgaagatggaattggcggcatcatcaggtggagttcgaaatactggacccgctgttagggtttcgcaacagctgcttcgtcatcggaagcacgaggatgatcagggaattcacctggattatgctcaacctaaaacccatactccgtgccataactgatgacatgatataatgtcaatgctatccatccctctgattgtctagtaatctgtctagtataatcctatctagcctgtatgtttttctagctgtgcctcctagctagcactagaacacataatgcacgtacgtgtgcatgttttgatgagagccctcccccgctgtgagcctcactagctactagctagtaaaattatctacaaacactcatttgcaaactgacagactgagtgctagctatagcttggctacagggagttaattttgatatatagctcgaatggaacatgctaatcttatatactcccatctctttttccctcgatctcaaatttgattgatcattcctggtagtattgtttcatagcaagtggtcgtgtgatttgcagggagttcttctggctctctgaataaacggtttgaaggaaccaaggtatgtatatatgcaagcatttcagtctgagatctcacatatacacatagcaagctcccttcttaatccccatagcaaactgggtatctggccctcttcttaatccccttctgcaaaaataatgtaggtgaggtcggttgcgcgagagcgttcggtgctaggagctgagactaacagagagcaagtaggatcaaagccggcgaccactgcgtacaccgcggaaaccctagcagccatggactacccagttgcacacacagcaccagctgttcacaacaggtagccagttgcaaaaatgccaaatcgatagcatgttcggccttttcacataaattggccaaattttggaggcatatatcgagagaaaacagttcgctgttgatagtgtgatcactggtcagaagtatgtagcgtcagatctctccgatttacttagcccatcaagcatcaagcctgtgatgttgtatatataggattacaaaatatggaggcatgagtgaatcaaaacatgagtttgcaatgtgcatgcctcttgctgaaggtggttttcgttaccaattacatatgtgggatctatttcctgcactggtctcctcacaaaggacctgtttagggaagttcagccgcaacatctcctagaatcttcaggtcctccaaacatgcagtctatattcttacctagattatgagaatttgtaaatatagaatcgagatgaactagaagctagtaaccctagcttttccagattgtcaccaattgcttctcagaatcccacaaacagaatcaaaaagttgatcttacatatgtccctccatgcgaaacaaacgcgctcagcaggccggtcggcaccgcacagtatgatcttaacctttcttggttcagacgacagagctgctgatattttgtggttaatgatagagtactagagtctctgagatcaagttccctaggctcgtcattggctaataaataaacctagctccagaagaccgagactatttggagtaaatgtttcgtgaatgttgtgcacctggagcgcagtcaacagtttatgctgaagtcaagcaaaacgtgttgtacagagtacagtgcataataaaagggctttctaaaagttcagaactttcaagtttcaacaaacagtccctgcttattgagttccttttttcttagatggagctttgtacacgttccatcagtcaggctccagcctcttgcattcttcatgtttgatccagcagaccagcacaagctcttgaatcaacgatactagttccaaagcccccaaacaacatcacctcaaaagaacaattgtatggcaccattcagcaatcagaagaaaaaaacaaacttgtagccaggtgtctgattagaaacgcaaaactgagagtaaatcctagtatattgaaggcacgaactacaaaggtttttagtacatgcccacttgtgccaattatctcaattctcccaagaatgccccctgatccctgcatcaatcttaccaaaatagtgtaactaatgcgagaagtgcaactggaacagaaacgcctgctctaaaaaagacagacatcccaaccccagatccaagcaaaaacctattggtttacatccctggcgatgtctcatgtgttcatcaagatggtaaaaccacatggattcaaagtttctcttccgttgtacagttatcactaactacacttcaccacaaatggtttgaatgcatttaggaactgtgaggtccgcaccccaagcttgaggtcaacttctccaccacccagccagaagaaatccttatctaacttggtaatagcttcatcaatgataacctgtgtagaaactcattgtatcagatgccttgaaagcttcaaaatatatgtaccctctctttccagagaaacaagaaatacaagaactcaaaacatccacgcgtaaaatgcaatctatcagaagtgtaacttgataagacagtttgtcctactcagagttgaaaatgaaaccaaccatatatgtcaccagacataatgcagacagggttagaattcaagaaaggtttaacaggatttgtaaagtacagagttttatatatgagcgtgcaaaaacatgattatcccttatattcttgcaagatctccccatttgaagttgacccttatgacataaaacctaaagttagaggcaacatttataccggtatgtctgtttccattccaatgcatgtaacagcattgtgaacaaaccctgtaagcttgagtgactcctcttctggtgccagcctcactgcacaaacacaagtaaacaacatgagttaaagaatagaactggcataaaaagtaggtcttcagacacacctacaaatcttgaaatgcctaaaatataatagaggcaacattactgcaggatgctgaaatctacacacgatatactgcattcctttatctttgatcatggtcacacatttttccttaaagtgaaaaaaataccaccgtatgaaaaatattgttgtatgtaaaaaccatcagacaagatgcttgccttagttgttgatattaaaaccaattcacagcataccatgttgttcaggaattaaggttttctcccatcctgtgagaggtatattcctcctcatacttcagatatagcattccatggagaggtaccagaactaatcttataggttagaataggattgtgaactcatctttatatatgttcttgaccttctcttacgtttttttagaggtgtaggtatttgtgctagtcaagagatacatacctattcctctctactaacactaaaagtcttgccactgccaattatgaacttgtcttctgatcagttcaacaggtttatttttttacctcataaatagtagggaggtatatacctcactaaggatgggagaaaaccttcgagggatttcatggaagctttgaatgctgatgaccaataaaaggttatcggtggcatttgtagagattagatttgtttcaatatattattataaatcttactgttaaatctcttcttgggtatctgcttctcgtttagggaatagatgaagttcttgatgctgtctgcattaagccgtgccatatactgcaaatatatccgtgtgaagataaaatgtactaattaaatttgaagatagtgtgttgagatcaaacttacagtttacctgaacaacaacgacataatattttgaattctttggattgctgcagtcaacaacatctgcagcagcttgtgtattcacctaataggtaacttcaacatcagcattaacacaaaggcttcattatttacagatatgttggcataaacatgaaattgtggctctacggtcagataacaaaatattgcacatccctcctcccattaatgttgttttagccaaatataaaagagttaaatttcaataaataaaatactgcactgataggcagtgaagttcggtccatattgcatttctgaatctaaagttgagaagaatgtcaataagttcaatgcaactcaaaacttcatgtatagctgagcaaatattcctaagagtgctcaaaagcacaacatttcttgcttagcagtacacaccctcttctctacaaatgccatgaaaacagagaacattttgatgtcaaaatattgaagctgctctcgaccaagttgatccaactggttaaaaatattaatatataaagctgctcccatctatcaacagtccagctgaaaccaaatcacaaggagcagctctacagctatccttctctgctgtatacttcaacttaaaccatttctttcatagttcactacctagcaatttccaatttatcatgttaccaattaccacgtcatgctaacaaaaagtatcaagtcattatcttgtacctcaccgacgacaccattgtgtctaaaaccctaaaaagttactgataacacaaatccaaagagctatctccaagccgacgttacgcaggccaactgttcgacaaaatgccgcacgggaaggaaaagggaggcccgtaccatgacgatgctcttgcagagttgattgactgaatctgcgcggaggaggtcgcggcgctcctcaagagggcggtcgtagtagtcggcgggcacgcgccggaaggtgaagtcgagcacgccgcgcgcggtcaggatggaggagagccgcgcctccgtggcgcccgtctccgcctcgccccccgagggcgccggggagatagatagcgcccccaggcggtgctgctgcgcggcgagctcgaggtccgcgacgcgggggaggatccgcagctgccgcgcctcgagatcggccgcggcggcgtccatggtcgccgttgtctgtccttcctaggggactaatttgatggttttggggacttcgaggtccaaaggctcagctaatcccctgtttgatgccaaatcaactcacttgcaaaattaaaaagtcaaattgtaggactaagcttaatcaaccatttgcatcttttaatttttttaaaaaaaacaaagtgtacttttttaaggaaagggagcactttcagtttaaccttcgagagtgacggtgaacaagatataggcaataagataataaatctttctaatgatacagtcatcgaacaacaaatgttgttggcaatctagttaatgcacgtaatgttgtgactaatgagatattgaggtcaatctgaacttttctttgaacgagtagcagatgattgccaattttgctaaagataagttatggtcaatcaaggttaatcgtatttttgacactcatgacatatcacatggatttgtaatttaaaggtcgctattggacactcacaaagctcatattcatatatagcctattaaatcgtatttttcacgtaactataaccaccctctttattaaatatatttacatgttgagttgtgctaattagtttaaatttagagtaaatttcacaaaactacagatactatgaccaaattatcataaaactacacatttaacaccaaatatatctcaaaactatacatttaagatgaagtgtcacaaaactacatgtttagtaactaaattattataaaactataggtttagaaccaatttaatcacaaagtaataatgtttatagctccaccataacaatggtgctagggatttaaacttcaaaagttgtagttttgtgataagttcaatattaaatatgcatttttgtgatacttaacctaaaatctgcagttttatgataattttggtgctaaatgtgtagttttgtgatacaactccttaaatctgtagttttgtgataatttggtcaaaatatctgtagttttatgaaatttactcttaaatttataacaattcgataatagactaacatgataatataaagtttctgataattatgctaagtgatttacacggccatgagtagccatccttggtcaaattttctcataatagggaagttcaaaagtaaacatgttttgtttaggtttagacgtgtccttttaggctgaacgaaatggaatggaatgttgaatagcttaatgattcgaggaacacatgaatgaaaaatacacaatggtatttaatgaaaagaaacttggatgtagcatttaaaaatggtatttaatgaaaagaaactcggatgtagcatttaaaaaacacacacacaccatttataagttcgaagagcatgcatatttatgttcaattcctttacggaaaaagagcgcaccctatccttgttgttgatacacactctttgtccctcttagcgacccatagtcttcatagcccatgatttttataagattagtatatttgatcaccgctaaagtattgtaaggatttatgcatttaaaatgatcttgaatttatcatgtagatgttactttattgaaaattgttagttttccaccctgttttatagcatactaattagaacatacgtacttctttttttggtaatgtacttatgtatgtctagataaattttatgtattatactcgtgtaaatctatctaaactaaaatatgtttattttttaaacactcgtcccgagctatggatctatttgtaaataagttttacattgtaaccatttaaaaatactaaaaaaccatctttatgacctatttatataaaataaatattacaaagggtcattaatttgcatctctatctttatagcacatttgtttttgtcctttctgttaacatctgatgaatctttccaacctaagccacatgaagattctagatacctcctttctatttcattcaacggtaaatattggttctacatataaatccaacggtcatcttcgctcgacgatgtggctcatcttgggaacatcctgcgaaaaactttttacttatagagattggcgcaaggcgtatacgtagccttccaattaaaagtcagtaggtagcgctgtgatgtaagaatggatgaatatgtgaacaactataacaacagaaaagtctgttcaccagataagctgcaatgattaaaaaaaaaacagataagctgctatgacggagttgtgagggccgggtttgattccattcaccagtgtttatgtctgtgtgttcataaattagccaatgctcaatccaagccggatatccaacggggcaatgaagacatctcgtacatctcactgccagtcagcgactcctttttccgcgtgttcggcacacggactccacgtccactaaatttcgtgtactatgcgtgccgtgcgcagcggtgaacccgatctctgcatacactgtgccgtgcgctgccctacccgacgcagcggcgagacgaagaaatccagcgcgtgtgacgagtgacgacgtgatcaagctgtcgggggacggaccgggcaaccggccacatgaaaccgagacctcgttacggggcgatgaaacgcgcgcccgttcgtcctgtggtgtgggccggagcggtcgtctcccgcgcccaactggacacctgatgggttgttactggtcgatc

SEQ ID NO: 71056 - DNA, 5673 bp, Oryza sativa
acgcccatgaacggtggtgtgaccaaccaaccgtataggcgaggacaccagtcggcggcgacagaggcaggccggcggtgaagtcgtagacgcccaacagcggcggcataataggccagccgtgtaggcggaggcaccactcggcggcgacggaggcgggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcgaaggcaccagtcggcggcgacggaggcaggccggcggtgaagtcgtagacgcccaacagcggcggcataataggccagccgtgtaggcggaggcaccactcggcggcgtcggaggcaggccggcggtgaagtcgtagacgcccaacagcggcggcataataggccagccgtgtaggcggaggcaccactcggcggcgacggaggcaggccggcggtgaagtcgtagtcgcccaacagcggcggcagcggcgcacactaaccgtggaggcgtgtaatccaatcggccgcgacgagggcggccggcggtacgtgcataaaaataacagatcaaataataattagtgatctgtcaattagaagactagaaaacccaagattaatctaatttatgtaagaaaattagaacgataaacctggtaatggcaaatactagctggtgaagtggactcgtggccgattgactggatagcgagacgcctcgagtccatgaccagcatcaatcgcctcagtaatgccgcttgacttgttctcagtatcctcctccaaaagtatgctagcactggccatgtgcttgtcgcggacggcttgtgtatatttgtaactagttttagccttgatcaatcgcggccagacgctagcaaatattgcggccagaccatctgctcagacttgttgcttgcatgccgtactaaccgtatccgtttaggattttggcaaacaaaatacagcagccgctgattggaaaatcctgatctcttgattcaaggcctctggtagtcgaacttttgatgacggatataccaactcagaataactcgtccaggagcatacatgactagataattccttctgttgacatgttcggaatcgatctctgcaagttgcagcgatcttaggcagcgtgctgatgccggagattgatttcgccgaactcgtcaaggtttgatctaggtttttcctgttgcatgctgacgctttcggcgtgatattacaaatcaacgtgtatgtgtagtgatcttcctgatttgatgtgggccagattcccatgcatgatctcatgcgtgtgcatatcagattggctatggaaccttctggtctcgctgatcaagagaagaactcggcggcggcggagattaaatccatcaaaattgccgagattaatcctcccagggcccggttgactggcttgatctagtcggaagtttttggcaacgttcgttccagccttttgttgagaataacatggcctgggatgaaggtgacactcgcggcagccacagtagattgagtctgacgactcatgaagttaattccatcacacttgacgatgatattctcgacgcacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtatattatagatctgacgatctagttgtctcatatatgccccctagagggcctcctgcccaccttatataggatggggggcaggattacaagatagaaaccttaaccaatacggtatctgtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacacctgtttttctaatagattaaatcttcggaaattcataactaaaacatcgtaactcggttttgagtggttcaagttgctaaattcatctaaaatcatgatctacatgtttgtttactttatatgtactgtttatgcttgtttttgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttggattctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgtgaactactgttgtgaaacattaaccgtgccaaccacaagccagcgtgggcaacggctttaccttttgtatagcatggttcattgcggagcaccagactgagaagtggcggagataagcccacgggggtcactggggagtccatgccttgttttataaaggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaataaccatgcccgcggttatgggcgggttgagcaatgtttttcgtgattagtctcacacctctcacaataattatggatgttatacctagtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttatttcgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacagtacgcttgatgctgttcttgcatttggcaaagcatgtcttggagtcgtgtcatgttctgtcgcatggcttccatgtcggctttggtttgtgtctgggggtcagagttgacttgggcttgcacagcggcgagcgcagttggggccgctgccagctgtgacggagcggcttggggcaccagcagttggcttgtcggaaggatctccgccctggtctggagtgccctcgccgccgcagccgccttcgccatgtcaaccgtgttcggcacctgcacagaggtagcaggggccgaaggcggtagtgatggcgcaggtgcggaagcagatgtgtcacaccctgaaaatcctaaatttataaattgttgtttaaatggaattattagaaatgattttaaaagcctagaagaaaagatctaattttaaataataaattccaatataaaagtgggccagataaaattttattaaatacttcactttctttgaattgtgttatgcgaagggtattgtcacaatctcttttcgggtacttgttaagtatcgcgacgcatggttgacttgatgctgaggttgtgtcttgtgggtacagtggtacacctctttcacttgtctttcgtgattagtctcatatttcacaccataataaatgatgatgaaaataatttgtttagctcctggtttggaatggtatattcctagtttggagatagaactgtgcagccgggattggttgttcagaatggttgggcctatgcaatgggtgtgttgtatagcgttggattaatattgtttaattaaatactttactgttttattaaattctgaagtatttattaaatgccatttatgcaaatgagactatattatgccatcctttgttatcccttgcatttgcatatttgctgcgtggcttgttgagtatgtcatatactcaccttgcaatcattcatcagaggaggagttctacagtcatgccgaaggtgtggaggattaggcgtagccctggtcaaactgcttgtgggatggagtcgcctgcgctgtttattttatattccgctacttagaactttattgtttgagaggaactatctacctctgtaatgactttatattcgcttattaattagaatattaattgcactctattatcgatttgttggataaatgtcttaactccctcctttcacttgtctttagatgccgtgcttcaagcctgagtacttgttcggttctgagggatttgtccaggagttgtgtacgatgtccttcgccataggattcgggactgcccctttgtatgcccagattcctcatgatcgtgatgaagagaagtgccgtgtcaagatcaccttgaacagtaatcgtgaagatatcccatcggtgatgttcgaggctggagggggaaactatcttcatgcctgtcaggaggtggcaaggatcaccataggagagctctgcgaccgctacagtgatcagttggccgacactgagtatcgctaccatcctctccaaccccagggaagtgactgtggcagctatcttgaacctgcagggattgagaatgatgctaccacaaggcatttggttgagatgctgtgggccatggatgagtcccacgctgaagtcgtgatagctgctcaagatcgcgaagatcggaatcgtggtaagaactgcaagctggaggacaaggttgatcggttggagaaggaattagccgcattgaagggagaagcaccaccacaaaaggccagggttcgtcttaccgcaaggaagagagctctatttgtccctcgctaccagttggcgcctaaggttcgtgtggtggaagaaaaaaaagctgccccagtttcagcggatcctcctgtcgttaacgtaagtgatgatgatggaaaagattcgaagcgcacccattcaaaggtcgagtggggg

SEQ ID NO: 71057 - DNA, 11230 bp, Oryza sativa
ccaacggctattgggttcaccttttttcttaggacaagatgaccaggcaacagctccgtcggtcgaacttttttgttgtaagttgccgaagtgcctgtggcatacttttgcatgtgctcgagtgcttcgactcttaccccctccaagagttcgagcgacaactcgcgcccctcttcgcccccagagaacgtcacccttggtgagttagcccctagctctattggggtcattgcctcatcgccatagaaaagcatgaacgggctgaacttggttggtcttgtaggggtcgtccgaagggcccagagaacagatagtatttcctctggccatttgcccttagttgccccctccagccttttctttagtgcttctaggattttaccatttgtacgttcggctgctccgtttgactgcgggtgcgcgaccgatgcgaacctgatttccaggttaagcccttcacacatctctctgaacttgtcagagtcgaactgcttgccgttgtcagtgatgaactcttttggcactccgaaacggcaaacaatgtttttccatacaaacttctgtactgctgccgaagtgatcgctccgaggggttcggcctcaatccatcgagagaaatattcaacagccacaattgcgaacttgtacccatttcatgccaccgggaacggcccaatgatgtccagaccccatctggcgaagggccagattggcgcaatgggctgcaactcatactggggcgtggtttggcttcggccatgacgctggcaactttcgcacttcttaatttgctcgacacagactttcaacacaatgggctagtaaactccttgtctaaacactttggaggcaactgttcttgcggcttggtgcgcgccacatagcccctgatgtatctccttcgccatttcctcgccttcggcgaaagagatacatcgaagcaagggttgaagtaccccagagcgatagagctggcccgagaccatcttgtactttgtggctctgagttgcaagcgttttgcttctgcttcgtcttccggaagccagccagtttcaaggtgtttcacaaacggggttcgccagtcgtatgggtcttcgcccagttccaattggtcgattgtcatgacttccaagctgtccatgggcacacttggtgcatataggacttcaaaaaagatgccaggcgaatgtgggccaccaaaagcagcagatttcgccaaggcgtctgcttcctcgttctggcctctaggtaaatgttcgaccgttatgccagtgaagcatttttccatggactgaacggcctccaaatacttcttcattccttcttcctttgcctcgaaggatttgtcaatatggcctgccaccagcttggagtcggttcggattagcaagcaccgaacccccaatgctttcgcctttcgtaggcccagaagaatggcttcgtattctgctgcgttgttggttgtgtcgaactgcagccttgctgcataccgaattggcgcgccgtttggcgaagtgagtactgccgcaatgcctgctcccctatgtgaccacgaaccgtcaaagtacatcacccagggctgttcgacaggctcggggtcgggggcgaatgctgatgtccattcggctacgaagttagccagcacttgagacttgacggcagtgcgggcaacaaaatgaaagttgaaaggggatagctctgccgcccacttgctaagccgtccagtaacttctttaccccagagtatttcgcccaaagggtactgtgatggcactatgactttgtgggcctgaaagtaatgcttaaccttgcgtgaagccatcaccagggcgtaagcgagcttttccattttgatgtatcttgtcttcgctccttgcaatgcttcggagacgaaatagatcggtttttggcctgaatccgtttcttggaagagagcagcactgactgccactggcaaagctgccaggtatagtagcagttcgcttcctgatgctgcgctgatcagagctggccggctttgcaggtattgctttagctcgttgaacgctgcttggcattcgggagtccagttgaattttcctgcgccccggagggttttgaagaagggcaaacctctttcggctgcctttgagaggaatcgaataagtgccgcaattcggtccgcgagcttttgtacttcacgtatgctcgacggaggcttcatttgctaaatggcatcgattttctcgggattcacctcgatgtctcttttagaaacaaggaaacccaacaacttgcctgcgcgaacgccaaaaacacacttctcaggattcagtttcatacccgctgcgcgcaagttgtcgaaggtctcctgtaggtcggacgcgtggtcgaaagccttgcggctttttacgacgatgtcgtcgacataagcttccatgtttcgccctaactgctttaaaggaccttgtacactagcctggcgaaggttgctccggcattcctcagaccgaaaggcatcctaagatgacaaatggtgccgaacggtgtgatgaaggctgtcttagggatgtcggccgggttcatgtgaatctgatgatatctagaatatgcatctaggaagctcatgagttcgcagccggctgtcgaatccacgagctggtcgatccgtggcaagggaaaatcatccttcggatatgctttgtttaagtctgtgaaatcgacacacatgcgccatttgccatttgacttccgcaccagcaccggattcgccagccactcaggatgatcgatctcttgaatgacccctgccttgagcaacctttggacttcggcttttgctgcctcctggcgatcagcggacatcttgcgtagcttttgtttccttggcttggcatccggcttgactaccaggtgatgcatgatgagatctgccgaaacacctcccacttcaacagggccccaggcgaagatatcaatgttctttttgagtacctctaggatgttcttagcttcttcttcgcccatgtcgccccccagtgatacgagctttgtggggtcggcatcgtcaatctgcatcttgactatcttgccgtgaggggcgggctttggcgcgtgtttcgcccggtcatgcggttcagcctcaacattgtgcactgttctgttgattatggccaaatcgccttttgaagcagccgagggctgaagccccttgaccacgatcactcctgccgggccgggcatcttgagcttgagataattgtgatgggaaatggcttcgaacttgttcaaggttgcacggccgaagatggtgttgtagttctatgggatgtcgacaacgtcaaacaatacttgctcttcgcgtctgttttcccccgtgccgaaggctactatcaagtgtgcttggccaagaacttgaactgcttctccgccgaatcctcgtagcgatgtcagtgctggggtaagggcttgggtagtcaaccccatcttggcatatgcttcggcaaagataacatcggccgaacttcctccgttgactaggattcgtcggacctcgaaaccagctatctcggctgagatcaccagaggatcttgatgcgggaacattactccttcggcatcttctggcccaaaaaagatttgctggttcagatactgcggagccccttcgcctgccgaagtgatattgtggaccgttcgcagctgcatcttcttctgtcgcttcgacagttggatcggcgggtcggcccttgtaattacttggatcactctgtgttgcgcatcttggcgctattcggccgggggtgcttgttcttgagctacttcatgagttgcttcggccgctgctccctgctgcgtccttggatcttacgcgttgccacgttgccgaatgtttcggcattgcttcgtggtgtgcgaagagcgtccgtggaaggcgcagtagaggtctttcggaccttcttgcggacaggctgctgatggttgcttgcttgctgagcgtcgaactccttgcggagggcttgcacttcttcgacagccatcacaactttgcccgcacggtcggttctgaacttcctccaggtcatgggggcttgaccttgccttggtggttgtgcttggaccgccggctggggctggcgaacaacaagaggaggtggttcggcaacttgaacttgttgttgggcttgagcaacggcgatggaagccttatcatactcagcttgtattgcttgccgtcgcttggaatcctcttcgccccttgcgaacccgtcaatgatgcgaagtaggtgttcaagcgtctgcggctccttgttggcgatttttcttgtgagttcgccctcatgtaaaccggccgaagcggcgtttatgactgatgcctcagttatgtcttgaacttggcaccgggcttgcgagaagcgacgcatgtacttccttatcgactcccccggcctgtggcgaatgccgagtagatgttgctgcgtcttcggctcctcataggtgcctcgaaagttaaggacaaaaacatcacggaattgctcccatgagtaaatgctattggctggcaaattgaaataccaagagccttggtattttcgtcgccatgagccgtttcgatcgcggactcataaatggagaggaattccttttggtcagtttcgcctgagtagcgtgggacgggtgggaacttgaattggggtgggattggacgggtcttgattcccccactcagcggtagccccttttcgccccttgccctgttcacggcaccttgctgcgggtacggcgtggcgaagggcgaaatcacggcttgcgcgtgaggttgggccatggcattcggctgcccggccccgattggtgatgcttgctgagccgccatgaatgggtcaaaagttggctgtgaccatgttatggcgacctggtttggggcttggtttgctccgaagcctggcgttggtgcttgcggccgaacggttggcgcctgagcagcattgatagagtcgaactgcggtccttgactgcacggcgaagcccccagacctggctgattcgaaggcaaccaactaggcgcaccttgacttgtattcccctccgggcgggccgaaggggctgtacttgaaatgttgtggggttggctgagctgctgaaggaaagcttggagctgcgcctgcagagccgaagccccttctaccaatgtttgcggcacttggccaggcggttgaggatgtacttgggcagcgaccggttgagcttgtagttgcacgtgaggggccggatgcgctgctgtggttgatggctgcccggcgaagtacattggcgcttgcgcgacttgtggcggaaggggctgggtcggcacttgtggatagacttggggtgggacatagccagcctactactggaggattggtgccgaagtgaccttggaccgccttgccgcctcgtacgtgtcacatcttgatttttgtttcaggatttataaattatttaataaattattattagaatttatattaaatgttcattaatttacaagtgaagttaaacgtgggaaataaaatttcctaaatataaagcatggatggatttaatttttattaaattctccatggttaattatactctctggaatattctcggatttttcggagctcaattcctaatttttaatcatacaaagagcatttcagtaattacccacatattaaattaatcattaaatggtctaattataatttttttaagtactttgagtgtccaagtattttcaggatttttcttgaaattatttgagcattggaagtatttttaacaattcaaagatcatttaagtgattattttaattggaaaagtaataaaattctcctcccttgtcttaggctgaatcggcccattcctttccttcctctctcttccgccggcccaacccgagcctgcatcctctcttcttctctcagccaaagtccggttttgctccctcttctaatcaggctgagaaaagaaaagcccggcaagaagtctactttctctccctgcgctactgttcatcttccaactcaggcagagcccgagccagccgtgccgtgcacagtgccgccgcctcctccttccaaatctcgcctccccgttgctccttttttccaatttagttgaggggaaatattcctcttatcctcctctatctttaccccaaaaatcggagctaatcgttgagtatcttatccgaatcgaactcgttttcgagtttatctccaaaaccgagtgtttgatttcccggatcgatttcttgcgggaggagtccgatctcttcaatccaaggctataaataggaccccctagtcctcctctttcgtttgcccctctcccgtggtctcccgtgccccgtagcctctccgccgccgccgccaagttcgccgtcaccgccgtaaggtgcgccgaggtgtgggcaagctcggccgctccctccccgctgtcgccggtcaccggagccccgtcgccggccgtcgtcgttcgtcgtttggttcgagggtgagtaccgttaggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgttgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtatattatagatctgacgatctagttgtctcatatatgccccctagagggcctcctgccccaccttatataggatggggggcaggattacaagatagaaaccttaaccaatacggtatctgtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtaacccccgactatgtggttaatcgaacaaaccaaacatatagtcaaggaataaataatccaaccaaccgagtggttttgataattatagtcaaccaagcgacttaatattaatatgtagcatatgcggtgtgaatccctgaataatatgatccaagtgatataccgactgttttgtaaaatatgatgaatgtaacctaaagttggctacattattgaaaattcacatagcaaaacagctataaagaagcttgtatgttgtgaataaataaattcccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgtctagaaaatgaccacaatatataatcagcctaagccataatattggtcaataaaaaggcacacttacgtggcgaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctataaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagctgatgataacgatgagatcctctatcggcagttgcgtagtaggccaaccgtgaagacaaataattggaggagagttgatgttgttgcccaactcgtctaaaccgaaatatttgaagttgttgaagcagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccataatgacaaagttgtattgccgtaatgaagtgaacacaagtcggcggcaacagaagcaaaccggtagtgaagacgcgtagttgtgaagataaaagcaccaatcggcggcagcaaaatcagtcggcgacggaagatgatgatgtccatcagtagtggtagaacagcggcataataggccaatcaacactggcagaatcatgcagccatggaagtgaagaaaacagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacagcggcataaaggccagccgtgcaggcggaagcaccagtcggcggcggacgaggcggccggtcggtgaagacgtagacgcccaacaacggcggcataataggccagccgtgcaggcggaagcaccagtcggcggcggcgaaggcaagccggtcggtgaagacgtagacgcggcggcgaaggcaagccgatcggtgaagacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacatggcggccggtcggtgaagacgtagacgcccaacaacggcggcataataggccagccgtgcaggcggaagcaccagtcgacggcggacgaggcggccgaggcggaaacaccagtcggcggcggtcgaggcgagccggtggtgatgttctgactgatccattcctggagcgtaagagataagcttaaagccatgaatcccttttatgcatatctggatctggatcctttgtcgtattccctcgatgacagcagaagtagccgatgtgggaataaagcagtccatcaatggtgacaaaaacaccagtcggcgccagtggaaccaagccagtggtgtagatgatgaagcccattaacagcggcggagtccgccaaccgtataggcgagaacaccattcggcggagacagaggtaggccggcggtgaagtcgtagacacccaacagcggcggcataataggctagccgtgcaggcggaaacatcagtcggcggcggcgaaggccagccggtcggtgaagatgtagacgcccaacaacggcggcataatatgccagccgtgtaggtggagacaccagtcggcggcggcgaaggcaagccggtcggtgaagacgtggacgcccatgaacggtggtgtgaccaaccaaccgtataggcgaggacaccagttggcggcgacagaggcaggccagcggtgaagtcgtagacgcccaacaacggcggcataataggctagccgtgcaggcgaaaacaccagtcggcggcggcgaaggccagccggtcggtgaagacgtagacgcccaacaacggcggcataataggccagccgtgtaggcggaaacaccagtcggcggcggacgaggcggccggtcggtgaagacgtggacgcccatgaacggtggtgtgaccaaccaaccgtataggcgaggacaccagtcggcggcgacagaggcaggccggcggtgaagtcgtagacgcccaacagcggcggcataataggccagccgtgtaggcggaggcaccactcggcggcgacggaggcgggccggcggt

SEQ ID NO: 71058 - DNA, 1567 bp, Oryza sativa
attatctcgaatacgaataagaatcgaatatgatcggacacaaatacggaaacaaatttttctcggaacacgaaaaccaactcaacttctaatggaaacaaatatcaacatatataattagctcattttatataaaatgaggtataatttataaatattttttaaaatttaaataatattaatagtatggactagtgttaagagataaactactattaaaatctataaaggtatattgaaggttatagaattagaaagaaatggggtatgtctcatgggtcctgcggatatccgaatagcactgttcaccggatatccgaattattatccgtatccgacggaaaatctggtaccatattcgtattcgtatccgggagaaaatatccgtattcgtatccgtatccgaactatccgagaattatccgattcgaaaggtatccgtatccgtttttgtccagagcggacggaaactatccgctccgttttcatccctagtggccggtggtgcagccaccccgcagccggcaggcccacgcgcggtcacgggctcccggctccgcgcatctgccgcctttggtttggttggcacttggcaggttgggtcccaacactcatagcactggctactgcagctgcgcgcgcgagccgtggaggtaaaaaagatctcactgcgcgtctgcgccgcggctgtgccgtccggcgaccaggaatccgcttcttgggtgaagcggatcgatgtgccagtaggcctgcctggccacgcagaagaggcctgcatggatcacgtcaaccctgtcgcgctacgtacgttcgcgtcatgttggacagctgaagcctgaagaaggcgtcacgtattcacgtgaatgcttctggagggttccgccgtcttccaaattactactctaggagtagggaaaattttgttctagggtgtgttagttcacgttaaaattaaaagtttggttgaaattgaaacaatgtgtgatgaaaaagttagaagtttgtgtgtaagaaagttttgatgtgatggaaaagttgaaagtttgaagaaaaaatttggaactaagagcatgttcactttgatatcattttcaatcttaccagattttggtagagttgcgaaaaagtggctacatttagtttgctactaaattttagtaactatataagaaatcctatcaaaattattgccaaattttagtaaggttttttttggcgttaaagtgaacaggcgctaaactcggtcctaattggctttctttgtgctcacggtgaagtaggcttatcacgaggaatacagtactgttcggcggcctatatatacatgcagcgcctttgtatgacggtttaaaacacgtacatacgtgtggattaatcgacgtgatttcggtggtaatttcatcgtacacctacgttgttttacgatggtgacatggtgtataagtagggcctgtttactttgatgtcattttcaatcttactaaattttgataaagttgtcaaaaaaatagctacatttagtttgctgccaaattttggtaactatatggggatcctctagagtcga

SEQ ID NO: 71059 - DNA, 3961 bp, Oryza sativa
ttttgacaacttgccaaaattttggtaggatttcttatatagttacaaaaatttggcagcaaactaaatgtagccactttttgacaactttaccaaaatttggtaaggttgaaaatgacatcaaagtgaacaggccaaagaaatcctgccaaaattttggcaactatgccaaaatttggtaatgccaagatttggtaaggttttttttggcatcaaagtgaacatgcccgtagagttgaactttaaaatccaaaatcactaatatatatactagttgagcgtgtattaatttataaggaggcaaactctatacatatatatatatataggttctatatatgttgtgtctctgtttttccctccaactaaaaagaacaaaattgagagccaatctactgttatatgttgtctcttagtggaacagatgtaaattttaaaaaataattcacaccgaaatttccaacaaattaactgtcctaagtacattttgtcgtacaattgcttgcttacaattaaactacgagaacgtactgcaagcaaattacaaccacacccagacatagacacgccaaattcaatctaaaagagtatccattgcatgcaattccttggagaacaaaacctccattaattgaccaaatgatgacagaaactgattaactgaagaaacataaacaaatcaagtacagttaactcgctggattgatatctgaagcagttctacattcagaactaataacagagtaagtaaagactcgaccgatatgcatgcaggcactcaagaacgaacgatgtgttcgtgcatgcgtgctgcatgcatgcaaagctagcacgtcgttacaccgtacgcgcgttacgtagcttaagcacagatgaagccactagggacgttcttgccgcagtagttgacgaggaggctgagcttgacggggatgtcgagggtgatgccgagcacgttggccttgatggcggtgcagagtacagacggcggcctcaaggtcggcgaggccgccgaggacgccgcagcacggctcgtacggcggctggccgacctcggcgctgacgaggcccagcacgtcggcgcacgccgcgaacttgagcgcgttcttggggcacttggtgttgtaggacggcgtcgatggcgtcgtcgacggcgtcgaaggcgtcgggcagtacttgccgcaggcgctggccacggtgaagaagaggaccaggtttagagccacgaggaggaatgccctggaagccatggctacgctagctgaaagcgtacaagcacttgcgccgttgcacacagggctacgtaagtgatggtctgcaactagagagaggtgcgaaaactcagcagagtacgtgggtatttgtaggggagagaaccagaaccctagcaatctgttgttgtcaaaagactcctcctgacaaaccatattcgcagatcttccccaagattaatacattatgtgcatatatgattttttgtgagagtaacgtacttttttttaagaaatacattacaaatatagatgctcacagttcgtgcacacacatccctattaatacaaaaacacacccttctcatatgaacatatgtgaaagactgatccatcatatattgggattgacgaagtcaccacgagtgtctcactgttgatggtacattggctatcactaaaagaaaaaatagacgtaaatgtgatacttaaatccggatgagctggttccaactagagaaacctaaccagttaagctacgcttatttcacaataaaagaacatcctgaatgatcgatcatgcacatatattagatgcggatttgcgccagtgttgtagaaaacgggcttaccagtcatttactttagttgtttgtatatgtaggcaacccaagtaatataccgttcagtgtctaacgtgaccaccacatgtatttgattgagtgttatccatacaaaaatagtcactcatcttcagtgtgtccatgatcacggttaacacttacctttcaatatatgaactatgatgccgagtagtgagtaagagagatattcgatagaataacttgctaggcaatttcaacttaatatatacccgtcaaaccactcaaagacgacgatcaaatgtgttacatacctcagtgggtacttgaaccaaagcactacatttcacgatcatctcaattactcaaaacacttaatcatgcttagctagtccctagaaaaagcgaccagcctcacactttcatcgcaagctgttcataagcatcacaaatgcataaatatggataagagagcagcaagatacatataacataaccgggttcataaacccgtcatacaacacaaagatagcagcaaaagtctcataaattcatataagcaaaaccaaacccgtatttgccaaccattccacacagacaaccaaccagggcaagagccaagctaaactaccctcaacgccctcagtagggttcatcatatgtatttggatgagtgggatccaaatacatgtggtgatcacattggacactagacgatatattacccagtgtacctacaatgggcatgaactatttttttgacgcgatacatagtacaattatcatttatgagcataaaaactccatttttagcaattgattgaaccttctttttatcatctataaataatcgttcgtatattacacttgatcatttaaagtagcatatttatcttttatgatcttattaatttgtttagtgtttctatatgtttatttagtgtttccctccgtcccataatataagggattttaagttttttcttgcaacgtttgaccactcgttttattcaaaaaaatttgaaattattatttattttatttgtgacttactttattatttatagtactttaagcacaatttttcgttttttatatttgcaaaaaaaattgaataagacgagtgatgaaatgttgcaattaaaaactcaaaatcacttatattgtgggatggagggagtagtttttatttatccaatatgaaccaaactccatcactatttggtgtacaactatgagcatcaaaagctatattttgggttaatgtaagctatgaccattcaattgacatattaggcttatatagttttatgtttttaaatatccaaagaagctcataatattataaaatatatacatatatatgcataagccaaattttcgcacatataattctgattaatttttcatgtttcggttaattgttgagtggtaccctctctgtatgtatttcacatatataattccgattagtcgactgtatttcacaaaattgattattatacatcatatttttatgtatacagattgtttgcatagggccgggttatatattatatattatatatggaaattaaatgattttgatttataagtgtgggtgacaaataataacgagagcctaagagttggcctcaaattaaagttgttaataaattaatattgtttgcactaaaaagggcgcaccatatgcggttgtgtgaagtatatagtgggaaacaactatcttaaggaagaaaatatgtttcaattaagattacctctgaaggtaattaatataagtcagatatagcaatatatatctatgtggaaccaattttgttagtaactcacaaagatgctgatatacatgcatgcaagacaacaaaagaggcggatctggatttgaagaccagcatacatgaggggagcatatcttttttaagactgacaaatcatgcatgcatgtaataattcgcatttcaggacgcaccacctcctatacagcgaagtaagtacatgcaaaactatgccgagctaattgcaacttatgttgatagatattgacagcacgatatttgtcatgcatatgcggatgtgcataaaaccctcgcaacacacatctattgcatgccaacttataacccagccagtcacatactcacacag

SEQ ID NO: 71060 - DNA, 4310 bp, Oryza sativa
  unsure (1)..(4310): unsure at all n locations
tttcaagtgaggttagacgtggcaggagctgatcccttgcacagcaaggtggctctcctttcaccagcgtgggacgccctattagcttatcacatccctcaatgcccaatgtcttcaaggatactaagcacaggaactcttcctctggccagtagatgagcacaccacagaaccagatttccaaacacacaagttgtctaaggcatttccaaaacatgattattggttgtgatgggctcgtggggaagaaaaagttgcagtgctttaagtccagttctgagagagatgattcgtgaatctgatcaagctgcactcttccttctttgtcatccacgtccagtattagcttggatttttttagataatggaagcttttattaaactcagtcaattacatcaaggtgatacaattatcctgagaacacttccggcctctgcataactaagatgcacaccgccgaacaaacaaaacgacactcgaaaggaaaaaagaatgacatggagtattgaggaccatcaatctaacgactaaattgccactcatgaacaactccttggccatctcctccaaaagcacagagttttaaggaccaccaattctaagactagatcaccacccatatccctgggtaaaaaactccttgaccaccttctccaaatgttgacatgccgcaactaccatatcccgcgaatcaggcttctgtaggatagcccatatacgaagccaatggataagagaatatataacctgcaaatgtgaagatatgacttttttatcaaaaaccacattattcctgtatagccaaagcgaccaacaagtagcagctgctcctaacagaacatggtgnanntttcaangnattattatgnaantntgccatcaagncgcagctncncccccaannannaccantngagtggnngccgnncnnttaanncnaacnannatggagngggttgggntggnaggnnaagtccagatgctgcttggatgatggaccaaacagaaagggcaaaacggcattcgaagaaaagatgtctaattgtctcgtcattgcaacaaaaacaacaattcttattgccttgccatttcctttttatcaaattgtccttcgttaacaccactccacggcttggataatgaggacatgtaactggcttggataatgaggacatgtaactggattgaagtaaaaacaaggacagttcggccttgttttcatttagactgaaaatcttgagctttggtgcttcgggtagactcctcagttttggacagttcctgatgtcagccttttcaagcagaggaaatgttgattcgttttccactagtctctctaagccctctaaatcatataacttgattttctttaatgctggaaatggtgtgaaagccatttcacagcatagtgtttgcagttttggacatttctctatttcaaccttctcaagcagaggaaacactggttcattttcttgtcttcctcctgttgctacccatctctctaaagcttccaaatcgtgcaacttaatcttctttaatgaaggaaatgttacggatgccatgtcagggattagtgttagaaactttggacagctcttgataacaacgttctgaagaagatgaaatgtttgttcttttccttgtctaacttccttgcaacatagggtttgcaatttatcaagtctgatcaaacagagaacttgaagagacttaaattgaatgaattgaggaaattcttcgcacattgtacaaccctctaatttgagctccaccaagttttgcagtatacttagatctgtcatccatgctggaaaaatgagtgcttttataggaaattacgttgagcatcagcagcccatgatgtggtttaagagcatcaagaaccttcccattgcaatttggttcttcaacacagcattcactattccacacaagagataggcgtgcaagtttctctttgtttctaagattggctgcttttgcatcttcttgagatacattttctaagccacgtaactctagttcaccacagaggtttaagctgtgcagttctctaagggtgctgcaaccagagctagcaccaaccacaaaatatgttagtgtccggatggaagttaattgcccaagctctggaggcatgcacttcaatcttaagcatccatttgtatagaggtgacgtagacttgtcatatacttcatatcctttgggagtctaacaagattatagcaatcaggaaggtttgatgtctgtagattgtacattgtgcttatgtctgcaggaagttcatggatattactgttgtctgagagatttagatatcttagatgttgtaggtgtcttggcctgattggtaattcttcccttcttgggagctctaatgctcttagctgtagagaattgtacttaaataaatgtgatgttgagacattaccataataccctcgaaacaataaagttcggagagctggagcttcatttcccataaagtcatctggaagagcaatgctggtgtatggtatgagaacgtgatataaaggatgttctcgcatcagatttttcaaattagacgaaccaattatactgagactatgtctttaccccataactagaattgacgaacatgtgcatgctataagcatcattgtactctctgcacgcttgcttctgctcaccggacgctcgactctcctatacaccatctcctccttccccgctgcacgaaactttgtattgcactatctgtgtaaaagaatgtaccttctcaaactatgtgtcctgtgacaaatgattcctcgggcctacctgtcttgccacgatggctcttgcctgcctgccagtggtactgaagctcatgtgtccataccatacattggcatccaatgttctcccacattcaatgctcatagatctctttggggaatatagcacacgaaagcaaagcactgcttcatgtgtgatggcagatcatcatagctcagccgaagtataggaaaaattttatcctccccttcattgcaaatgttgcttttagttaatacatcattccattcttgcatagtagtcctggtacttaacatagaaccaaaggcttttgcacctaaaggcgagccatgacatctgtgcacaatcttacaaagaattccaaaatgttcatcattgtttggcagagttaatgctctcctcaggattatttccttcatgtaaatttctcctagattttcaagattatgcacttcaacttcacccgtgaccataattctagcaacttctgcatctcgagttgttgttagtactgcactacccataccacccttcttaaggcaggtctttagctttccccacttatcataatcccgttcccatacgtcatccaacacaatgagatacttctttccacctacttctttctgcaggtcctgcaaagccttttcacgatctctctctgtgctcatacatatgttgtttgcaatagtgacaacatcaaacacatccgacacacaacaccacctgcggagcgggaaatgcttctcaatttcagggtcattgtaaatgagttgcgcaaaggtagtcttgcccagcccacccattccaacaataggaaggacagtgaggtccgtgttattagctttatcaagcaatatcctgataatcttcttcttctcctcatctctagatctgataacaatatccttgtcaaaatcaaccatgatggaatcagttttcctccactgcttgggtgtttcctgctggtgtacgagtccgaaggagttcatctccgagacaagttccttgattttctccacgatctttcgcagtttcttgcccatcctatatcggaagacaataggattacgagaagggaagaggcttacagagtccatgccaagcatagtgtggttgcggtgccctttcttcttggcctcacgccagagcgactcgtacttgaactcgtcgaagacgtcaattgcctcgtaggacaccttcttgagtgatttgagccaagcgcaaactagaccggatcgatgatttttcttctcctccgcatcttggatgacatcgaggatggctggaagcaagcgctccagagtctcacgctggtcctccatgccatccatcaccttgtacatgtctacaagaaagctggaagccttctccagcaccttggagagcagtggcccaaccaaatattcagccatcgttgctctctcaactctcaggagcaggagcacacggcaagaacccaaggcaagggcaacggcggctgttgctgatatgtagttctattggagagtgattaatggggta

SEQ ID NO: 71061 - DNA, 9388 bp, Oryza sativa
gtcctcgcctccctccgccgtcgcgcgtgctggtgaagccggcgtgcgcacgaggagatgacgcggactccggccgccctctctccctcggcccgagaccgaggtgatcccgcctgtgccgtcggacacccttcccggcgatctcccgacgtggtagcctccgttctccctccccactcttccttccccctagcttgcgcgattgctagcctagaccttcccaaatgcgcgaggacgctgcctcgagccccgccgccgcccggcatggcctcgccgccaatgccgtccgctcccggaggccgccgctcgtcgccagctgtcctcggtgctcctctgtcccatccggcgccgaaaacggattccttgaaccccggatatgctcccaccccttttaatcgaacccccgttgctccggtgaagtttcccccttttctcgccgccggcgtacgccgccgcgattcgtcatcgccggcctccctccggcgaatccgatccggtggctcacttcctctcgtccgtcccatcgttccggtgtactccctctctctcgaatcgtcgcgacgagctccggtgaactcggccgccgtccgccgtccatcttggccgccccttcttcctcctcccgccggcccgcgtggctgccacgtaggcgccacgtcggcgccacctcggctttgaccgagccgagccggtcagccgcctccttcctccccccctctcgcgcgcggtccacggtgcaccaaccggctgcgcgtgggcccgccgcatccctggtccatccagtgcacgcccgtgaaccgcgctcacccgaaaccctagcgctgccctcatgcgccgctcccacggagagccgcgccactgacaagcgggccccacccgggaccccgcaaggtggatacggtccacccggacccatccccctctctcctcccgcgcgccccgcccgcttgggccgcgccttgcccggccatgggccgcctccccgcgcccgcgcccggcccattggctcggccgcgccgtgcttatcccttgggccgtacccgagccgcccaaagaagtctaaatcccatccctccttccatttcttatccaaaggattaataaatcctttttttttccttcctttgtcccataaatcaattccttattcccaaaattccacaaatcatttcctttggtcccgcgcgtcagtgactgtcaataatattcttgagaatattatttctataaattccataaaccatttctcctattccagaaactccaattaaacttccaaaattcatatcacctaattcgcaactccgattgactccgttccacttccagtaattccgtaaaattgagatctatttattggcactactaattagtctaaataggatctttcttttggtcctttgtttaggttttcgattgtttgcgtatagttgcggttatcggattttcgtcgatcgcgggtttcctcgaagattcgtgaagcttcgtgaagaccttgagcaaggcaagtcaccctttgatcaattgcccctataattgaaaattcattattattttgtttgcaacttgcattattagaatcacacacttaacttgcttggcctcggtttgcgtgccaaaaccgacggacctacccagtagtcgcactaatttccgtaggtcatactaccctgattccttgtcgctccacccttgtggtacctcggtattcgtgttctctgagcacgtataccaaatatcccacatacaccattgtttgtcgaaaacttgggaaatgggtttgtgaagccttcaaaacccgacatgtggtgtcggtgtatttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggcttgggaaaggctttgttgcgaacctctgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgcgggcatcatagactaggcttcccgagtggaagcggattgttgtgctgctaggcagctggactctgggagtccgagaaaatgaaaaaggctctgggagccgattaatcaagtggaatggctctgggagccgataagtaatgatctgacccgggaggtcggtacattaccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttacctctcttccaagcttgcattaaacacctaagttctcgtgacttgctgagtacgaaagtactcacccttgctctatataaatatatatatatatagttcctccgccctgaagagaaggcaaagtgaagtgaatattagggtttcgtcctggttcccagccgtcgcctgtggtgttgggtgttagaccgttggttccgctgctgctgctgctggtggtgtttcctcgtccgcgtcgtcggttgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcacgccgttttccctacaacacgctcctatcaggtgccgttgtacggcggtatcagattggggtgtgacaacagttatgcaactttttacaaactatggatggagattcacaaatagacttgaataaatgtgtacttcttatctcggtttggtcttttattttgttgggtgtgtttaattttattttgaactatactcttcgtttataataattgactgtagttatgatgagcaaagttcgaaatatttcattccattatcttaaaaaaaatatgaagatggtgttagtagtagcatatgttcgctctcgctcagataaacacaaacaatagtaggagtatcgtcgtggacatggatagcacagtaaaggatcagaatttcagaagatatagacgtgccagccaggggccccttgcatcacatgccgatggacgcaaaataatgtgtgttgagttggtggctaaaggcgccaaattcatcggtgctgcacactgcactacactgtaacgctggcagtttgcatttgcagccgaccaagtcaaaaaggatggcatccgcaccttctaatctctcactttctcatagcaaaagacaccaaggccattgtttctctgattctccaggccctgtttatttttttttccaaggggtaaaggtaggagctctgccgatttcattaaggatattcggctctattaattgttatctgcagctggttagccatgactaaaatttaaatctaatatcttatcagcagcagtagtgcagctgactggagaagtgatgatacaatgtaaattaccctgagattatttccaggcttaccttgattatgcttggggagagacattaccagggagacaaatgatatttggggccagttccctgacggttccaaactctgtcacaccatgtagctgtctttttaccatgtcaacagctagaacatatgcaggagtagtaaacaatattggtaccaaagcatgctgggagtgggttgagaaatccagaggttctccaatttccgctctgcgttggtggacacactcttgttgtactgtgataatctgtgatgacttgttccgcagcagtttcttacgcatctgctcttataagctgatgatatctgcgtgaactggcaaaagaactaatccaactatttgcaaacaaatattcaacatttacacgacacatagctttgcttagtttctttcacccttcccttaggagtccgctcggtttagccaagttattgcattctttgtacccccacccatgtaaccgtctcggagtgtgtacaaattcttgctgttgttattgatgttgttcttattgttgctgctatcctataattcaccaactcgttttactcattatcatcgaacaaatccaacggtaaatcgatcatctactgtagaacccgatccggatcatccaatcgaatagcaatcagctccggttcaggcagccacaaatcctccgctccaatggcgagatgatcgtgagatagatatgggatctcgcggccactgcagtgcagtgagctagtgcgccgctgatgtggcaacaccttgggccgagtttaattagttcggaaatttttcttcaaactttcaacttttttatcacatcaaaactttcctacacatacaaatttttaacttttccgtcacatcgttccaatttcaaccaaacttttaattttgacgtgaactaaacacatcctcaagtggacacagctgctttagctgggaaaaaaagaaaagaaaaaaaaatctcttgcgccttgtggttcacatcgatttcacgcgcaatttgacggatcacgcatcagtgctgctacgtcgtccacatagttaatccttgcacagctgctgctaattaatcagatactcatgagatcacaagctagcaacgtttatagatggcggattttggatatcgattcgccttcaacatgatctagacatgatgaggcaacaaatcagacaatcagtaattgcttctttaagacattgaattttaaaaagggaaaataagaaaaaaaaacaatgggattttaatatgaatataagtatatatcaaaaggaggattataagacatgggaaaaatacaaaaacgaatatttgattacatcgcagaaaaacatatgaatcagatgagagagaataaattttcaaatgatttgagtttttactaacttttgtctaaaatctgtatagtatcgtgcattctatagaaattttaacgaaaatgataggatttaattctttgtatcaaatacatttaaagaaaattcccttataagtttaaaatctctaatttttttatgagatatatatgggcctaaaccgatgagatatatgtgaagattatattcaagtcaaactcgctatccgacttgttacaacaaatcaaagttgtacacctttcgtctaaaaaaattaacttttaaagataaatccaaacatgtagtggaagttttttttatgtgacaggaagagtacgtgggtacgtgtgaaggtttggtaatagcatctacttgctaggattaacagaaacaataacaatactgtcttcgttgacacaggaaaggatcagaattcagaagatggatatagacgtgccagccaggggccccttgcatcacatgccgatgcatgcaaataatgtgtgtttgagttggtggctaaaggcgccaaattcatcggtgctgcactacactgtagcgctggcagttgcatttgcagccaaccaagtcaaaaaaaaaaaaaaagatggcatccgcaccttcgaatttctcactttctcctagcaaaacgcacaagggtccgtttgggatagtttctaactgttgcagtttttttcaatcaaaagatcttccaaataatttattttttttagattttaagaagatatagttatagaatctagaaaataaactagaatccagaagctggaaaacccagcttttttttagtttctgagaaactggctaccaccagttacttttcagaattttaagctccctaaacagtcctgaaagccggtgcttctcagattctccaggcctgtttagcatagattttcggctcaattgtcatctgcaggctagaataagacatgtgttcgctgtatagcaaaaatcatcgaggcaattaatctcgcgtgaaaaacatatatagtaccgatcgatatcggattaattagttcatcatattacttctgcttcacgctttgggtatcactatcagcagttaacaacaccgtgtgttaggtcagttgagtatacgcagaggtgatcaagtacttgatcaaggccacaattaattcgagacactgttgggtgagagtgttgctacagtgctaaatgatacctacccactatacatgctccatcaaacagttgaaaggatcataacaaccagcttaattaaggccctgtttggaacattagctcagggctaattttgagagctaatgtttagtcatgaattggtaggctaaacattagtctagggtggtatgtttggatccatgggctaattcaaggctaaaaggtggaaagggtaaaaagagaggagagagaaggagagacagttgcttttttatggtcccacacaaaattagcccctatagcaccctttggaggggctaatgttttgaggggggctaattcatattagctcaaaattatcccacttgtttggatcctgagggttaatttgaggctaaaaggtgagggctaaacattagtccatagaaatttaaaaaaatttaaaatataagtcacgtataaattactattcatattatcatctgataacaataaagtcctactcataaaaaaatttaaataagacagacgatcaaagttggacacgaaaacttatatttgcgcttaaaatgggatggatagattactacttatatgtaagtagagtcaacaatgaagccaaagatgtctcatggaactaagacgacgaagagcgtatatttggttgttggttaatttgtcgaggtgtgttttatgttcaacagtggtggagccagaattttttcaaacctagggctcaattagttgaatgtataaagttttacctttatcttctagtttttaaaaatttaaaataaaatttcaataaatatttaggatcaggactagtgctacagccctagctgccctactcgtgtctccgcccctaatgttcaatagtagcaacgtctgcgatgaagttcagatgaccacccagtcagcccgggagctagattcactactaagcatagaactaacaacttttctatttcgtatacagctaattataacttaaaacccgttatacttattaatgataaaaataatttatgtgtaatttttttatatatgtgtttttatttactcaaaagttaatactataaataaattacaatgaaaaaaaatcaaaatcaactttgtaattaagttggagtagatcctaatcaaaatcaatgtgagttggaaaactcaactaaagaacttagccttaattgcttttctcgtttgatctgattccgtgttctaaccgcccaagggaaatttaatcatccagccctagtatcattgttctgaatctctctacacctgtaaagtgatcaaggaaattaagaaacacggtgcactgatgcatggttcatcaactaactctcagggaccagcgatgatgcagacgtaatatactccatcatgcatgtgatactagcaattctctcttccattcactctctcgtctagtacatttgagttaatcagtcagtttggaatcactttacaacgaagttaatcacagacaaattcaacatgcttaaggacggacaaagatgattatcaaagacattaaactactactctttgtcatctgaggatactgtagttttatactgcaattgcagcaacattatactattaacgagacctgttttgtcattgcgagatccactccaaaattttcaaatgctcgtggttttgcaaacaaattgtaaccgaagacagacatgggtgtcagagctgtcgccgttggaaggtgacatgatcgcagccgtccactccatcggccgctggctaaccaaccaaccccgtccgccgacatgctgctgtccgcctcctgccgacttgttcttgtcttcctcctatgctcttaactctgaattttgttaagagatagaaggacctgtagtaattatttatcaataaaattttatcaaatttgtcatatcaaacatctcgccacatatttcccacaatcagagccctttgaatcgtaggaatgaaaaaacggagaaacagaacaaatataggattctgacaggaatgtaagtgtaaaacagtggatgcaaaacacaggaatgatcgtttgattggatcacaggaaaagcacaagaatcgaatgaaagagatagactcaaagaattcttaccaagaggttgacctcttgctaagttcccttcaaaacctatatgcaataagccattccataggaattttgtaggatttgaaaaacttcaatcatttgaatcaaagagctacataggaaaatttcctataggatttcaatcctatgaaattcctttgattcaaaggggccctcagtttattggaacgggatcttgtcacaactaatgctccgttcgttaccaggggttcccaacctccctccctcgtttttcgcgtgcacgcttttcaaactgctaaacggtgcgtttttttgcaaaaaaaaaaattctatacgaaagttacttaaaaaatcatattaatctattttttaaaaaaaatagtaaatacttaattaattactccctccatctacttttgatagtcatatttccaaatctgaaaattttatttttgatagacatatttcaatccaacaacttatcatcttaatgactttcttggatttaatgcatgactcttcattcttccacacatgattggctacatgggcattgagaaatgtaaatattaatgaatcgtttgtttacgaggaatgactagtagcatatttaaatggatgataagtagaattacttatccttggtctgtgtgccaagatgaaatatgactatcaaaagtagatggagggagtatataataataggtgctttgttttgcgtgccggggaggaggatcttactcaccttcgctttccgtttctcacatcggcgaatacccctccgctttggtcaaacgcttta

SEQ ID NO: 71062 - DNA, 11589 bp, Oryza sativa
agattattactagatgaactcagctatgatattaccagcattgcatctacatctgctaatgacatcaatagtctgaatacaaaccagaaggaaatcttcaattctatttctaactcagtcataaataatgagggaagaacattctttgtgtatggatatggaggaactggaaaaactttcttatggacaactttattaaactttgtgagaactcaagggaaaattgcattagctgttgcatcatcaagaattgcagccctcctacttccaggaggtagaacacctcattcccgcttcaaaatccctttggacatacgtgagaattctatgtgcagtataaagaagaacacacacttagcagaacttattcaacaaacatctcttattgtttaggatgaagcacctatgaatcacaagtattgttttgaagcattagatcgcacacttagagatatattatcggacattcgacctaatgcacagcataggcaatttggtggaataactgttgcatttggtggagattttcggcaaacacttcctgttattcagaatgcaacaaggcaccaaattctgcgagcttctattgttaattcatgcttatggcatcaatgtgtagttcttcaactgactgaaaatatgagacttagctcacaaaacctttcaccatccgataaagaagaactacgggtatttgcagattggcttttaagagtaggaaatggtacagagcctcatatttcaatagaaaatgaaaccaatggtacttttatagagataccccaatctcttctgttgccctcagattccagaaatctggatagcttgatttcctttgtgtatgacttaggatatgaaccaagcaatattacaacatatttttgtgatcgtgcaattttatcaccaacaaatgaggttgtttcagaaataaacaacaaaatcattgctcaagtaacagctgctgaaatgtcatattatagctcagatactattgatgatagctgtgcaaaccattcaactcgagaggctctatacccaacagaattcctcaacacaatatctttgaatggacttccagaccatgttttgcatctcaaaattggtgttcctataatgcttttgcgtaaccttgatccttctagaggtctctgtaatgggactagacttattgttacacagctcacaacccgcatcattgaaggggaaataatgactgaaaaagccaaaggttcaaaagcatacatactgcgtattataacgacatcagcccaatctaagtggccattcaagctaaaaagacgtcaatttccaatatgtttttcatatgcgatgacaattaacagaagctaaggtcaaacacttcaaaaagttggtacatacttgccatctccagttttttctcatgggcaattatatgttgcgttatcacgagtaacatctacaaaaggcttgcgatacttataaacaacaatagttcataaaatgaacattgcacgcaaaatgtagtatatcatgagatttttcaccgtatcaacaatgatatgaattaattaccaaggtattttgtaaacaaattatctcttatatgcaatgtatgttttctgatattgtctactagctaaccttagacctcttatttcaggaacatttccatagatgggatcagcaacaaaactcaaacagataaatttgggacagcaaaaccttaaagttttcggactacttattagactatgggatgctaaaaacatggcctcagccagtacaccaaccatatttagcattcatggggggattcttgatgaagaggtatactatcctacaccaaaaaatgattaatcctatgcttaacttccaatctaaatattactgacaaaacaatgcagttttagacttataccagttctaatcttgcagggcactatgatgcagtttactattccaaagaaacttgaaaatgaatttcgtccatcactaactctaggctgtgtctacatgtttgtggatgtcaatactgctgacattaaaaacaaaaaatatatttaccaccaccaaaaatacatgttgcagtttaagtccagcacaaaggttcatcacctagaatcaagaggttcatccatcccaaactatggttttgaattctgcccatttgatcagataccatctaaaagcagaatatcaaaaccattgataggtaatacttgcattttctatcttcttttatttaattattatacaactaatctcaaacattttgcctctagatctgataggagttatcagccatgttgggccatatgattatgctggcaaaacatcatccaagaaaaacagaaagctcaaaatccgtaacaaagagtatgtatcacatatgcattatatttttatgttccaaatgtatatgacacagtagtttataccttttgtttcaccaatttgtagtgaacaagaacaaggaatagtcctctggggtgaatatggagagtcatttgatgaagcttttgttctacagaaatctacagaccacaaaatagtagtagctatacttgttggacttacagcagggacttatttaggtcagtccctcaaataactttttaataccccctctcataaacaacactactcacttatgtgctacaattttaaaaggcaaaacagaggctacatcaagtttagcaacacaaatatattttgactccgatataacagagattgttgaatatcaaagcaggtaacttatatagcttattatcatactgattttaatttatattttgcttcaaaaatgcatcaatcttccttcaagctaccaatgggatattccaactctccaacaacaaatgccacgagttgagcatttaactccacttcaagcggctggtaagctatacaaacttgaagaaatatcaagactgcccatttctgctttcgaggtacctcattcacactacatcactaaataagttgctaatctaattaaataatcatttcaatatttcttacacactagggagggaattcatacagttgcattgcaaaggtatcagcgatagtaccatatacaaattggtactacaaaatatgcaaatcatgtactgcatcatacaatagcaactccgacactccaagatgtcaatgtcagcattccatgccaaaaccaatgtatgtgacatatctataatactaatttttcttattaattaattcgtcttacatttctataaacaaatctaatatactcaaacaaactttcaggtacaaacttcctttaacaattaaagatgaattaggaactttggacgcagtagcattctacaatgtggctgaggatttggttgaggtaaatgctactcaagctacccagaacttgaaaattgatgcaaccgaacatgccatagctcttgatacagccattgggaaaacaagactgtttcacattgccatgaatacaaagtactcttcacacttcactatcaattatgtcctcaagaagagttatcccgttgaaaatgaaaatacaagtttgatgctacctactctggaaaatacaaaggtagcaaaggtatacaaatgtttgtccttaccatatcttctaccaaccatctataatctaaaaataacttttttcaggaatcagccaccaaacaacttgcaacagatgaagggctaaccaccatggaacattacaggttaaccaacatatgccttttttacttattatattctgcttaacatttctatatttatgactacaactaatagcagcaaagaagaccaacatcccactacgccaccgtccctacaacctccagaaacaactctagacaacaatacagtaaaccaaattataccttcagcaaagagagctcttcaatttgaaaaggagttacacattgatcaaccaaggtactgcactgatacaagttctttttgcagaatatacaaactattcttcaactaaattcctttcatatatgcatcagcccagcaattgcaaacactattcaggttgcaacaaatcaactttatcattcccaacaagtagatctcagcaaggaaaaacaaccgtcaacagaattttctccaggacaaaattctaagcgccataaaaaagtgtacgtgcacaccttaagtttcagcctataaacatatatatgtgtgtcacgcgcgcgcatatatatatgtatgtatgttttgctactaatttgactgctaaattcagaatggaagcctccaccaatggagaggaaaaccagctgcagcagccaaagatagctgatcaacagccatcgggtcacaaggaacaggtacaactcttcaaatccttcacaattctcctacaacatggccttttatcagcaacatatatagtttttcttaaaaaaattagacctgcaccaaatctgtcaccatcactgctaacaatttccttaagaaatttaaacctgcaccaaatctatcaccatcattgctaacttatctttgcaaccattacttgcaagtttactggcaaaaccaaccaaatctgaaatatggcatttatatctattccatattttatcctcaataataaaagactcaagatatgattcttaatcatatctgattctgcaataaatgagaaaacaaaattagtatccttattatcaccagtgaaatactataagaatcacccacaacaccaccacatgtgcactgctcaatttctcataccacagtccttccttcacaaaatttcttctgcaaacacaacgtccattgccaacacagatggaccaacaaccagaaaaaaataggttagctctcgctatccatgttcagctatagcttcctaattacatagttttcaagcttatattttatatttaacatgcttcatgcatttcagtgctctgtacattgtatatgcctatctatacatcataaaacgcattactcttcttcaggaaccatgaggtgcaactcatccacaccaactacctgcaagcagtttccaagattattgcatccaaatcaacagctatttctatcactctccaagggaaatcatccaccgacgacctctccaagctgcagccaactcaagctcacgttgtgaattacatgaaaaataagcttcctcacatgcatatcattctcgatggagaaaatgtcaaaaacaatgagatttagaacttacagtttcctactgtttccagctcacagtattactacctacctacagtttgctgtaatcgaataaacaaaactttatgggaccacctatacatttgttgacaaattttctcctaaaaatttgacagatgtaattataatacaatcgtagtgtaattacactgtaacttgtatgtaattacactataacttacatgtaactatagtgtaacttgtacgtaagtttcacgtaattttgaaacgttagatctattataagatttgttttggtgaggaagaaaaaaaatcacagcacacacatatgtgaaagaatttgttcccacaacctctattttaccgaaataacatgttatggagagatttttgaaagttatatacaagttacattatagttacagtgtaattattgcaagttacagtgtaattacactacgattgtactgtaattacatctgtcaaatttttgggggaaaatttgtcgacaaatatatagcaaaattgaactttattttatatttgcatgtgtttcactcaacttatatttatcctctggtgaagatcttggtgttcctaacaatattctgcttgcaatgtttctagtaaatctgaatggtgttgtcattgtgactataaatttccaactccttggactcgaaatgagttttttgtgcttggcacttttagcaattgatgatgcaaatatcatctttaattgatcacatagcagaactgcttacttttgaaattgtatactatactatattcctgtttggttaggtagcagaactactcacttatatctcacttattcatgtttattcatacttacatgcatattcatcctttctaatgtgcccgccgcaacacgcggggtttcaactagtatgtataatgcatatgtcacatcaattagatagaaaccactttgcaaaaccaccctacaatgttttatgaatggtattttatagttcaggggttggatgtcctgtttcaaagtttaggagagaacttggacctttttccctttttaaaactgaagatgtagatttgccttatcaaatattttgacatgaactttcacatatattattcaattaaaataagtggtcaggcacaagcttgacatgaattttaacaccattaagtcttcttaacggaaagggggcaaaacataagctttagctaaaaaacgaggacagaatcataaacctggaaattggaaaagtagaagatgcccctatgagaatttaagccacccaaacaagtttcatctatgagaatttaaagaagatttaaagtttcatctaattgatgaacagaaagaacagacgagcttgtttagtttgcaaatttacatttattatttattccgtgcacaagaacataataacatgatcttgatacactactaactatatattataaataagtttctaccaatgatttcatttccctctaattaactgtgactcgaggacagcagctttgcaatgctgctacctacgcgcgcccaatcttctccaccagccgcctctcaatctccatcctcttcctcatgagcaccgtgtacttctccaggagctccttgtcctccacaccctctccggttgagacggcgagctttgcacccaaggaggtcttctccaggttaccctggtacatgcaggagatggggacgaagctcccttcctcattgcacagccagccatgggcagctctcagtgccgcgccaagcgaggcagaatctgatcaagaagcagcgttagttttttgcttgaatttatgggtgacattactagtttcagcaaacaggaagctgcgcaagaacagaaaaaaaaggtggagttaaggtgctgtaccaggtctctgaactgtaaagacaggacagccaaagatctgcgcgattgagtggaggatgcgctcgttggaggatgcgccaccggttgcgatgatccgcttgggagggttaggcatgccgaatctctcggcatggcctcgcattgacagcagctggccttcgattatggcgcgaacctaacacaacaagggatgatggtgataaggttaatgggctcgccacgaagaaacaagtattttgattgtctttgcaaacctcagatggtggatcaaattcttccacctcacgttccaccagattgttggatgtgacatcattgaggttttcaacaatgtatcgatggaagccaactgcatagaataaaccattgtttttcatgatagagaataatgtaagaataccgtgaagagatgtaagaaacactaaaatatgattacctggaagtggcggcagaatttcatggtctttgtagtagaatcctaattttccgcctatatgttaaataaagaagaatgacaagatgtcaaaagcacagttcgattcacacaagaaaattgatgaaggaatattaataagataaatttaaaataacactatgtatgaaaaaacgtagcaagtttgaacaaataatagttgagactgcagtgaacatttaaattgctgatttattttgtatgtactgaaacactataaataacctgatggaaaacaaggttgctggaacagaaacgagcaagaaaatgttagtaagaacttatattaagaaatttcatttcagtaagaacgtaccatttagaggtggagttttctctagataactgttgaaaacatcccaggatttctccgcgcaactgttccgcacatctacaaacacattgaacatattctaatatcagaaaagtcccagtactacaatggattacatgagaaaaaaggatggaaagtattataccttctcgggtcaatgaaccatttttgtagcacagcatcaccatataaccatcaggttcaacagggttagggaaaacatggccttcaagacttggtttagcttcagcagttatcccaaaaacctaacaggcaatttggagatgagtaacccaggagcctgagaaagaaaagccaattctaccaaaagtggcatctttgcaacttacagtatcactagtaccaaggctaattgcaaggtcaccaggagtattcagagttaaacctaaagaagacacatcaaaataagaataatttaatggtccgtagttaacaaatgcattgaaaagaagaaagaattacaaaatctcgagaaagaaagcaagagaagcacctgcaaggctattgggattgtctccagaccattgaataactaagcaattcttatcaaactgaagcctgcattttcataatgcatcactcaaacaaaatttagggcaacaaatatttgtttgttcagtcatcagatgatatcagctaaagttttggcacagctagctttcccattcacatattatttcttttctatatgttgaggacaattcacctaaatccccttgacaagaatatgaacagagggagtgtaatctgaatctgtcagctatgatagagatgttccttattttcattatgaatctgtggtcgaaaatgtagtagattataagaaatgattaaagagagtaattagcccatttgatgccaagttagggaacagccaaatgccgaaacaccttgcgattattcaattccagaatttcaaacaccttgcgattattcaattccagtcttccagaatttcttttcttttacagttgtactgagtgcaagaacaatggagaatggtaaaagaaactcacctttctacaaaataaggagcaattcgaccagctactgcatatgctggtgccaactttccaagcttctcttcaagcccaggagccgttgccttcaggagagagggcacaattttgatattttagtattaaaaagatcttgaaggcaaagttttttagttatgtgagaaatcttgaatgcatgataaaggagctatcaggggcagacctctaaaacagtctttgaccaggttctctggtttatatccatcaagttcatcccagcaccatcagtctcatcaatacttgcatagttccccaccaggattgatgccatgaacgaactcaccaaagatattctctcagtatcatcataaacttgcggaactgttcggtatatcttccggatctgaggcccagtgaacctctcataggcacgagatcctgtcaactttgatagctccaatgcgccgcctactacactttctatttctctgcattgcttagttgtgctactgtccatccatattggtgagtccatggtagaaaaggcatccttcagctgggataacaagctcttagtaggatccaaggaagacaacaccgcatgactacccttcttccaataaacactgccgtgttgttgcccactccctgaaatggccacaaccttgctaaagttgatctttggctttagcttctcaagtagcaattcaaaggcttcaacccacattattgttggtgaaaatatgtggccatcatctgcaggatctctgtaaacaccaccttctgttttgtagtgcggtaagtcagaatcaaagttaacaatatctgaagctactattatcaattcgttgttcagcacggtagcttttagggacctgtaacaagagattagcaatataagattccactctgatggtccctaaaaaggtaaaaggaacagcatggaatacacagaaatatagatgcaaatatcgatagtatgtaaggtgatgtcaaatatcgatagtatgtaaggtgatgtcatgaggcgatggctatcaatatgcaggatactgaaacaaagcgaacacatcaattggaactgatgccaaaatgtggtgtatcttgcttctttctttaaattgagctttatggatttaggcagactaaaaatgaagtttttttttttacgcaagactaaaaaaaatgaagtgactctggcgtgctcggttcaatgaaattaccttcactgtcaacataaaaaatagctagcatggacaaagacttgatcacttaaatacaggaactcagacataaggctgaacttcgaagattcagactataacatgaatacaggaattcagacataaggctgaactgtgaaggattcagactatagcaccaccactagatatggaactccataagcccctgttctccctataattctctggtttccaaattgcatgcaagtcgtcatttttttctaaaaaaaaaaatagacactgaatgcaactattacgaacttaatctaccccaacccctccctgatagaatacctgcgcaattgctcacatatgctgatatgcatctcccggatttgcacaatgcagatgaacaaaataaacattttttttatccttgaataaccgtcgtcattttgccaatcacctcaattccaagcactacccagtttccccccaattcgaaatcagcctccacttacactaactagtacgttctagcagacatcaaattccgcatctagaacaccgaccaattcgcaagaaacaaccacccgcacccacacaaaagccaaaaaaaataaaaagatctaagcccccaactgaaaaaccaagagaaaccatcgggcttactgagtggagctgtcgaatccgaggaagagggaaccctccgggagggagctccgccccaccatggctgccgcctcgcctcgcctcccgcgcgaatcccccctctcagattggaaccggaagaagcagcaaagcaacaaactgatctggggtactactgattagagagagagagagaatcagcacgaacaaacggcgcggcggtttatatacactgatctggatggaggtggagtggactcgtttcaaacgcgcgactgatttgttgttaattcgtttggataaggattagcggcgtgatctggagtggattagcgcataaaatgatgatggattagcatttagcaagcgcccgcgcaacattctgttggggtattcatcgctacgttcgttgaggaagtctgtcagataatctatctatccaatgctcacttacaggtggggccagcgttttagttggtaggagtagattccatctatcttatcttgctctaggcccctcctcatctttgacatcgtagctattgtactgctgctactcgaagcacgccagcatggaacaactgaattttgatgccgtctgccgatctattcttagtacttcacacaatcacgattctgaatccaattcaaaagttctaagtagtattgcaattcacagggcctgtttggtacagctccgactcctaaatttagctgtaggagttgggtctggagtgaagtcgtggaactgcctaaatctagctccacaacactagttcattatgtgaaaaaacttcacatatctccactcccagttttaatggagctggaattgtttggctaagctccagggatagagctgagctgtgccaaacagaccatataatataat

SEQ ID NO: 71063 - DNA, 6379 bp, Oryza sativa
attatggagctaggcatggggcttaagccctagctgccccatgtctgattccgcctctgtacttacacgcatgtaaatatttttccctctgcttaattaatatataacaccagctaagtctagctcgtttttttctaaaaaaaaagtagctagctgttcaagaataccacacgcaaaagtacctctttgtgttgtaccacgaactgcattagtcataagtaaaacactcactttaagcaagctactccctctgtcccaaaaaaaaaagacaaaccctgaatttccgtgtccaacgtttgaccgtccgtcttatttgaaaaaattataaaaaaaattaaaaaaacaagtcacgcataaagtattaatcatgttttatcatctaacaacaatgaaaatactaattataaaaaaattgcatataagacggacagtcaaacgttggacacggaaacccatggtttatctttttttaggatggagggagtagctagcagctttcgatctgagatgaaatgtggacaatttaggccaaatccatagaaatgggcaagtggcattgtcagcgcgaagtgagagggacaagcggtacaatgggtaatgggtacccctccataaaaaaaacttaacttaggaggggatgagaccactccagtccaatgaatctggactacccctttgtccagattcagattcgttgtcttagaaggattccctcttaggttgagtttttttttgacagagggagtaagtttgatccccaccatttaaaccgcgctctctacaattaccaaaaaataatttatcattctactggaagtaattaaatgttaaatcacatataatttatgtatagaatccatcaaacgtactcgtaatgtcttaaaggtagtatattctttcctaaatagagtacacctaaaaatgattgctgcgaacattgggcaaaaatttgaagtggtttgtttccactggtcgctgagttgagtggaaaaatgacaggaattaattgggagctactgccatctacttaccgactaatacttcctccgttcatattataagacgttttagcattgaccacattcacatattatatatatatatatatatatatatatatatatatatatatatatatatatatatatatatatatatgcgcgcgcgcgtctagattcattaatatatatatgaatatagataatgctagaaagtcttataacttaaaacggagatagtcctagacaaccgaggctacgtgtgttaaattttgtaagaaacactgtacaaacataatgctcacagtatccctacattcacccctatgaaacacgtgcgcacacaacactctaaaagtctagatcagtatatcttaatatttgaggagtcaccatggacgccttgttgttgacatatacgtcgtctatcaccaaaagaataattaatcataaatacaagcacccgtgtaaaatctagtaattgagctcgggtatactgatttcgtcacaatgaacctaataagctgagttgtgctcactttacggtttatcagtgttgattactcctcatttggtaagaaaatatgggtcagtgacactggcaaaaagagttctattatcacaaaaaaattgatgaggacatcctccactattacccgctggcaaagacgcaaaagtcgggtggcgaccgtgtgagcctctgaataatcccaccttacttagcttggaaggagaaagccaccttaaaagagagagccaccatttccctattggactagtctttttgggagattgggtattttcccgagtgggtgtgactaagaactgttggggtccgagcaatcttaagttattgggtctcggccgaccctacctgagccggattgttatcaaaaatgatgttcgattcacattaagaaaaaaaatgtcattacgaatgaatttttggaaataaaagggaacccaaatcacatgcatggaggccagatcagatgcatgaccgtggacagtgatacgaaaggtgtgtgtatcttgagctggcaaagataaaactggcagtgagccagcgacaagggtcttgtccagctcgtggctgtggacagggcgcagtcaatgctgtgttgccccatggagtacatggactggaccatccgttctctctgcttttttctagaccccctggccgcctttctgcgcgctctgtgatcactggccgaagcacaactcatcaacgtcacatttgccggccggcagatggcccggatagcctgaacaacgaagtggcgcaacagaaactcagtggcccagaggaggagcacgaccagcgatcgacggggagatgtgtttggcactcacaaatccatgagattttgtgtacgtgcgttgctttgagggtgcttgcatatgtgactcttcttctgccttttggtacatgcagtatgagtttccttttacctgaaaccaacggcgggaataggagtaagcaacgacgctccagatcggcagagcatgcatcatcgtcatttccttttttccaagttgccaagaacaaacaagggctcgtgacagttgcattattgcagaacgggtctaacacaagaaaacaacatggcatacgacacagggttatgaatgactaactgttggagagatattctttttttgatcttgttggagagatattttaattgtacgtgtggctcatactgattcaaccattctcccacactgcagggtagggcctagcgtggaaatgtatgcgctgtagcgttattggcccttgggatatactagtactgattcactgaactactatgtctgcagctgtactatctagtgcaacacccagagcatatagcaatagcaggttataagtcaactataaccacgtatcaagaagaaaaaagaagagagagaagaaagcatgctataaatttgtagccagctttaacacggtgtatgagaggtggctggatattaatggtgtagtatatttttataactaactattacatgaatagactattaaattagctataaatgatttatagctaacatttgactatactagtattaaacttgctctcaggaggtagttcacactgaaaaaatgttagtttcctaagaggtgtgcttaattaatttgtatatactctcactaaggtgtactccctctgtcttaaaaaaacctaacctaacctagtacttaaatgggatataatctagtatagcgaatatggacatgtgtactagtctatatcccatctaagtactaggttaggttttttttaggacggagggagtagagcacaactaaaatcggaacatgttgagaactagttatactgtcctctctgtggtttagttttgagtgatttactgtatttaattgtctaccgcttccgttcacaaatatatacgagaggtgggagtatggttatagtatttctgtgagaactaaatgagggtggcaattcggtgggggtgtactagctagctactccctccatcttacattttggaacggaggaaataggctacaagttctttacacaatattcattgataaattttaatcgttatgggtatgttcactttgatgcaaaaaaaaccttcctaaattttggcattgccaaaattttggtaacttgctaaatgtaaccacttttttggcaactttaccaaaatttggtaaggttgaaaatgacatcaaagtgaacaggccctatatttgtgatcggtgggtactattaagtttggcactaagaacattctagtagcaccttttttttaaggaacaaaaaacaaactaaaggattactcatctttctctctatacatatatacacacacgcttgcgcgcgcaggcacacaaataacacatcacgctagagggtcgtaactccaaatacaccaaacccaaatctccctacgagataacagacttttactgacggagtaaaaccgtaaggattaacaaaatattgtttggattattctatcctcacgaccactaccaggtacgcgtcgacaggaataaaatgtgaggaatgcgagattaatttctttcacaatggaaggtcgatagaagctaggacaccaaatcttgacgagaactgaccatgaggacatcatcttaacaactgcatgccttgttggtgagccaataggagcaatcgtccggactagaaatgtttgatgtgtctagcctctattatttgtatcacattctaccattatgggatgtatttggtttgaggataaggtcagaccggacataacgataatggttttagggacatgggtatacaactataactaatccttaattgcaaatttaagaataattaaactaggatgtaaatatatgactcaatgattattacttgatatgttttaccgaattccctaataatcatagtaattgaaattaagactccaaactaggtaaagctatatatttattaatttcaagtcataaaattatttgattacgaaaaagaaaaactaaggctccaccaagtaaaatttcaagtaataagtaataaatgtagcatcttacaccaactatgtctatgtaaattcattgttttggaggttttttttttgcgaggacattgttttggagttattaaatgaagaaaaaaagtaaagaaataataaacatatttgaatggtctatatataatacaagacaagtgcatattagtaaacgtttattttgggtttttgaaatattaatatgaatagtaagatacaccgacagttccctaacttgtgaggtggtataacttacctcacttatcttgtgagttagtagttatcttgtctctagggtgcatatatcattaaatacaagacgtgtggttgtttgatgccaagttggatgtcatatttacctaatacgatgtgctcgaaagtaacacgggcaaggtaggcacttaagaaaaggaataaaaagcaaattatcccccttatatatatgttttgcgcgctttgttctttatgagggcttttttttagaaaaaaagaagtattacattatgtgtttctacgttaaaagagaccggtctgtatgtttgtcgaaaaatttttaccgaccgactggatgtcagtatagatatttttttccatctaaagtcggatgggaatgttaatttggacatggtgtagtgaccgccatggcgttcaacttggcattttggcaacgatcgaacagcccatgtaacatgtgtcaatgagatttacatcctcaaaataagatgagtagctcatttaagtaattaatttcgagatgagtaactaaattgcacacaccacacaaattaattgtggtatcatggtgtattttatttattctagagttcggaattgtttgtgatagtaaataaatttgcatgtgagtatatatatatcccattttgaaaccaactacaaagcatatagaaaattttaaagttgttcgatagtcattattaacaattgaacgtgttatttcataacctggacgaatgtatgggctctctctattacatattataagacattgatgtttgttttatattatttttgttttaagtttaactaagtctagaaaacatagaagcatctacaatacaaaactagttttagtaaatccatccttgaatatattttcaagagtacatttgtttcatgttagaatattattgattttttaaatgagctttttcaaactattcaagtgtgacttactacaaatcaaatgacttataatatggatggagagagtatgaacgattttgattctagagatgtagtaccgaaagctagagtattagcattactccctccgtttcatatatatatggtatatattttagttttgtcctaaagtcaactatttttatctttaactacggtatctaaaattttgtatagtttaacaacatacgagtacatattataaaagtatttttttaaaactaaaagcataaatcatataacgatgttaaacttctcacaaatttggcacgcgcggagctgtagtcgtgcacgcacacatatgtacacacacagcaaacaatcacaaacagaagtacatatatatctgaagttgcaaaccaaagctttattagaagttggtaccggcacacaagctagcaccggcccttacaacaaatgcgcacgtacggatagcgggaataagagtactacaaagaagacaaaggagagagtacagagagaatccaaactggtaccgtgatacgtacaaacagccagcatgcacgatcgatcatgcgttgcgttgcatgcaaagtacgtacgtaacgtagtagcaaataaacagagcagcaagcaaatcaaatcaagagtcgtcaaagccaaggggatcctctaga

SEQ ID NO: 71064 - DNA, 613 bp, Oryza sativa
atcatgaggaatttgggcatagaaaggggcagtcccaaatcctatggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagccaaacttgcaggataagttgaaacagttggaaacaaggtcacaaattttgtacttttgaacaaccggtttcaaaagaaataaaagaaagttataaaatcaacatgctaaatttatttcattgcagcaagattaaactaaacaatattgtaaaacttttgttggtaaaatgagccattagtacagtaatagatgtacagtactaataacgctagaataaattttgaacgagaaccactaaaaaaaatattaggaaatgcatgtgccattagtttggtttaattaaaagagaaggggaggagaacagttctacttttccaatatttttagagggcttctatgggtaaccatttggcataacctagggtcagggagctctgataccaacttgt

SEQ ID NO: 71065 - DNA, 683 bp, Oryza sativa
atcccactgaggaaggtggagggggtgggtgaaaagtgtccagacctgtgatgacatcagacagcctctgagctactgcagagaccccctatacctatggaccacttgattgggtgacattttcaaaatatatccaaaatctgactatttctcaccacccccagcactgccatgtgccccaggccaccacctcctatccccacagggctccccgctgctgatgtggcccctcccaggctattctccacatggtagccaaagtgaacttctatgaacttctacaaacagatcatgcaactccttccccagaaacccccaagccttctcttcccactctgagaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttccttctttgcttacttgaggtctctgctcacatgtcatgctattatcaaggacgtccctgacaccctgtatgacagcactgtcctgcagaaccatctatgatatggaaatgcgtcataacctgagcttccaatacagtagccactggctacacgtggctactgagca

SEQ ID NO: 71066 - DNA, 2522 bp, Oryza sativa
gtctttcctgcaactagcttgttggccacagaatcaaattccgggcaactgctccacagtgatacactagttataaagtattttggtgatgtctccttgactgactttgctgcaacaattatgggcatgtttagacatgcaaaaaaaaaaagatatcacatcggatgtttcatcggacgtcgaaaggatttttgggacatgaatgaaagacctaatttcataactcacctagaaaccgcgagacaaattttttgagtctaattaatctgtcattagcacatgtgggttacttagcacttatgacaagtcatggactaattaggctcaaaagattcgtctcgtgattcccccctaactgtgcaattaattttttttaattctatatttaatgctccatgcatgtgtccaaagatttaatgtgatgtttttgagaaaaacattttgggaactaaactaggcctatgttcataggctgatttgtccgagctactcaattgcacttataatcgacactaatctggtggttcacaaaaaataattgccctaaaaaattgtaaattccactgaaactctttttttaatcaaaaccactcttgattaaaaaaacaaaacccgctgcaattagtggtagtattttttttaagagagtggttactcctaccgcttgaactagacacccaagatttccaaatacgttgcgacaaaactattttggcatccataataaagatcatgatccaaccttgttcattagaaaaagaaaagaaaagcaggtcttttttttttccttccgatttactgcatgtcgtgcacgatgaggagcatttccctgctgacttgacccagcgaccccatcgtgagtcatggcgtggcattgccggatattctgcgaatgtgccatatgtacaatgcgatgaagccatcccattttgttaaaaaaaaagaagctcattagttacaaaagagtttccatgcgccattccttgtggcttcacatagttcagttaactagaagcgttttccaccatcagatcagtaatcatctgtaataacagatttgacaaggactactcatctgcctttctcaaagagcaattttactgtatgagacattaacacatgatgaattcagcattcactattttaaattttaaaaatagattaatatgattttttcaccacacccctcgaataaattttattttacaaaaatcccacaccgtttacccgttctaaaagtatgcacgcgagaaatttcttacaatcctcggttgccgaacacaaccaccacgacatgctccttgggcctgcatctgtgcagtggtgcggcgtgcgacggcacttcgtggctgttgggccttggtccactcaatcgtcctggctagacctaaaggggttgataccccagaattataagaatcattattagaatcacaatggcccccttaactagtggcatattccttagttttcggcccaataactattaaaaccggtgtaaattgactctcttggtggttttagagaaccgttttgttgacgtgacgttcacgtgacatcttaatccacaaattaattaaaaaataaagtcgggtccacgtggcatcctctttctctactactggcaagggtatggataccacatacctaatagtagttgactaaatctcggcaggacccaccacataccatgtcctatatggaaacaacctgcggatatggaggaagttccggataaggaaagacaaccagagttctacatggaaacgacaagaactattcggattatatccatattggtttccctagttctacttgaacaaagggacacctatgggtataaatacaaggccctctaggaggagagggggacggacaacacgaccacctcaattgacacccaccatagactggagggaacaacagaggccacaacatacaagacaacatacaccaagacaagacgccgaatatcgacttcagggatagacacggctagtcccctatggtgtctctggatactgtcagtagagacgaaagcgtttctcatataatcaaggaatggtatatatctaaatccaatctaatttcacctataaaaaaagattactattccttggtaatctataggaagggattgtctttttctctgatatcgccgggcacggattcgaggaggaagactaccctgttgtcgactactagtcagacctttagaccgccatgtggacaacagttagataggctaccccacatattgtactggtgtgattatggtgaataagagcaataccggcttcggccaacaggatatagggttattacctgataatccaggggcccgagcatgtataaaagtccctgtcaccgtctgttttacctcagtctcgcgtatatcctagcaccgacgatctccatactatgcaaacaccagaagggggacatctaacgtcgacagtggcgcgccaggtaggggtgttttggtgctccaggatttcgacgagatgggttcaaaagatgga

SEQ ID NO: 71067 - DNA, 1024 bp, Oryza sativa
aaagcccaaaaagtgaagtggggtcccccttatgaagggtaggtaaagcggggcacatgtggtatccctttaagctataaaaggaggaccctgcccactgagatgaggggacgactcccagaaaatctgaactcaagaagagaggaagcaagtgcgctctctggagtgaagaaacccttgtaaaactcatccataatcccaaacacaggagtagggtgttgcgctccatagcggcccgaacctgtataatccgactacgtgcaagcttgccggtaatcttagggacgagcgagtgatttccgagaggcgggcctccgcccccggccaaactcacgaaagcggggtcccatgactccccgctattgaggatcttccctcgacacgaggcaagggtgggcgtgatggagttgggtcggccggggtgtccggttgatcggcttccggattcaccgtggcacgagaggggactgcccgctgccttgcgaggagtgggggtgaaacctgaggtgtggtgcgattggttagatttaatgttactttatttactcaacagttttactgttttgctcaataaaatgttttacaaccgcctttatacaaatagccacaaaccgtccttgtatccccttgcacgtctgcatcgttggtgtggcttgctgagtacggtagttgtactcagtcttgctattgttcccccttttcagaagtgtattgcttctgagctgaagacgaagttagaggaccaaggctcagaccccagttgagttttgcctgtggagtggagctgaagctccgctaagatcgcctttttccgctgctgctgctttcgtttcggtgtgaggactaactgcctattatgtaagtattttacgctttatttacgtttggatctgtatattaatttgtcgttttgtgtgccttggttgatgcctggacatggatttaatacacaaaatagtctagaaatttgggctaaatttctgggcgtgacacccggcatgttgatgccgacgctagccatcac

SEQ ID NO: 71068 - DNA, 2043 bp, Oryza sativa
cacgaccaggaacagagcgaacgccttggacgccattgctacgtacccgagatcgatcgatcacaagcgcagctaatcactagctagctaattaagagctcttgatcagctgaagatgattaggctgcttgagatggttttgatcatgggattagggaggtatttatagtcgagccccgggattaattaatcgaccgttagagctcatgtgaaccctgccctgccatcatgtgagcgtgcatacgagggcgatctggattggctggcagaacacctgccctagcaaggctcgtagattaattaacaaatcgtacgtacatctacgctgataatgtgttaaatcatcggccgaatatttggttagctgtgaagcactcgatcccgcaaatgaccaagattgctgcacacgacacatcgcgggcttgtttccttatgatcattggttgttattttatctcgcgatcttggcctatcgggcgtcgcttcgcgcggtgcagcgtgactgcgtgagcaagttggtgattttcttttgccgtttaagaatgcttgctccgtgatcacacaagagaggacatcacatgaaccgagaccggaggaatatcggggcatggtgggattggtgggtgtcccagtccaacgggcaagaagattctaagcttacctgggtttgttttcacgtacgcgaaggacaggggaagatgccattgcagcgtggcttcctgctggcccggcaactttaatctacactaggcacgtggctactaggtcggcccgcttagatagctaaggtaggctaggtaggtccgtggtaaactgccagcccatgggcgcctgggattcttcttgggccaacagaagcagaggttgggcaatgcgaagcctgaaaatcctcctcctccttctctctctctctctctctctctctctctctctctctcacgaacaaacatcctcttcttcccgaacaggctagattcaattttttttaatgaaccagtgagccaccaatttcattgaatagaagaataaaattgtacatgcgcaagcgcaaattagaaactttaccgtctcaaggccttgggccgaacatgttaaaggtagcccacctatcaaggtgtttcgcgcccgccaagacccatgtttgggcatcctccttaatttgggctatcagactagccaccggaagctcttggtgctgaaaaactctgcggttcctttcattccaaatatcctaggcgactaatagcattagagtctgcaaggctttctttggcgcttcgttggaacatgcggtggcctcccaccacttgagtagcgtcgaggcttgttgccataacgttggtcttatttgttcacatgttgtccagtctgcaagtgtcgcctagattctttcacatatctacactccgccaggaggtgagggccgtttcctgattccttcgacaaaggggcagatggagccattttcgattacccacgggttgccaatctgtcggaggtccatactctattttggataacaagccaagcgaagcgaatgttttacatttgcgcggcgcctagggcttccagataggggcattgaaattgaagcttttatgccaagaagttgtgcgttgtaggccgatgtcgtcatgtattcgccgtgactagttagcttccatgtgatcttgtccttttcgtactctgtcaactgcaggctatgaacagcaccctagacattgacaagttggctaattagttctgtcgtccagcctgaggttaccggcaaaccgaggtcaaccaaccattggtcgggaaagcgatacttgttgcaggcttgcattcttcttttttgcaatcgcgtagactagtggtgctatgtcctttagccgtcgcccctgaacaggctagattctcacttaagtttaagaatcagtacttaatttagaaaagctaaaagaaactttcccatattcagtatatgttggttgattgcttgtcagttgtttcttataattttcaactccaccaaataagatcgtactgcttctaatagaatgg

SEQ ID NO: 71069 - DNA, 906 bp, Oryza sativa
aaagttgattttgacgttttcatcatagttcacaacatatgtatactaggggttgttcagaatgatgttatttttaaccataacttctttttaacaagattgccaaaaaaaagtgtctacatttagtttgttaccaaactttggtaaatatataagaaatcctatcaaaattttaataatattatcaacttgccaaaattgtaaggtttattttggctataatatgaacaacctctaattttatctatgtattacttttgtttgctagtaaatgttatggcttataactagttataggcgaaatgatggattaatagtttaagggagtttgagtatgaatagttttggatggttaactgagttttaggtccgcgtcacttatttgtataaacaaatttgttttcaagacaagggaaatataaaatattcttgttggaccgggtatatgttgcaaatcgactcaaatgattgatttccattgtttttttccccattcgatattaatgcatcggcacttgttgctttagaaattgtcccatattagaaattgtttgctgccaagcgtccatgcgcaatagtcaatggaataagtgtccacatgttgcgacaccattattcaaattcgatgaaaggtacctcaacgttgaaatagtgggggctttggaggtggccatcaatgtgttcacttttgttctcaatgtgatgtgtaagaatatatctttggaggcatccaattgaggtcattctcctcttttgcattgagatgcccaaaaaaatgcatggcttgaattaagatgtttttttcttcaacaaatgtcactagagtaaatgtccaatgtgatgcggtatatgtgtcttatttattatcatatataataataaaaaagtagaaacatgcaacttgaa

SEQ ID NO: 71070 - DNA, 651 bp, Oryza sativa
gataacgttattaccagctgcatatttgtatgctgcgtttgctcgcccgtgaacctgacttgccgagcacaagaggaagggaggaggaatatgcttttgtttttgctctaccttttttctcccatccgtcacagctgctgctgctacggttgcttggccggtagtagctgtaggtgaggcaaaaaaagacagagcacctagacagaaacacacatgcatgatgactgtgtgtgagacattggagtatggccgcattcagcaagcaaggcatagacggcacatgacgtgataccctcacgcagcagctagtggcatacgtaatccatttgcattcttgcttgcagctgggtgctaactcctgttaatttgtttattacaactagtagtacctttgagggctggattagttttttttcttaaaatacgattcaaacgcaagcgtccacaatacatgtacgacctccctttaagagttatcatgaagcgtcttactgtcgatgggtaagtcgcttaccattaaaaggaaaattactagtaaatacaagcactcatgttaaatctagggggtttgtatattggagccaaaataaatcttattttggcaagttggccactaaatgtaggtattttttatagccttaaaaaaatagt

SEQ ID NO: 71071 - DNA, 539 bp, Oryza sativa
taaaaacctgtgccttgtctcgttggctattaaaaaaggggtgaaaataataagaaatgcaaaatgtctgttgttaaacattatttcttgaaggggcacaacgttgaactatttgtttgtaaattaatctttgactgtacgaaatcattgtccactaacagtggtcaaattagcatatactaccaaccaccgccctatcaacacagtggtagattttgtttgtggaatatgactactcaccattaaaaaaaaagaaaatactgattggattgctacgtatacgtcacgtaggataaaaccgctctggattgaggtaaggggggtaatttgtccggaattaaaagttcagggtaaatgatgtctggttttcgagtttagggggtaattcgatcaaccacgatagtttagggggtaattcgtactttttcctataaaaaaataacgttactacgtgcaagatattttcttttatccttgtcatttactttaatataaaaaaaagagagtaaatttcataaaactgcaaatattttgtacag

SEQ ID NO: 71072 - DNA, 545 bp, Oryza sativa
caatctactgtatcttttggagctttgagcccagcccagcacaaaatattcgaagagctcgctgctgggcccacgcggcactcttttgtgccgctgagcaccgggacccaccttgatctggccggatgggaccacccatacaaaattctctcccgtactttgaactcgattttgggacaggataggtggccgtgcatacggtccccgtcctttgggcatctgtaccgtacggctctcacgctgctcctgatgttcattaaggcactgatctactgcaatttctgcagaagattagtacagtactattacctgtttcagcttaagataatgatttttgtaaacatgtttgttcagtggtccattgaacggctggtgagcttgacaggcaggcagcacatttcgatttctatgaagaaagagtaaactcaaccataatgctaagcaggcaaagcatgtagtagcaagtgcaacggcaaagccatgatacttttatttatcttacagcactggctgtacatcttgtgctgagaagctggttacacaaa

SEQ ID NO: 71073 - DNA, 3083 bp, Oryza sativa
acatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaacggtcaccaacggctcgatctcctggtttggttgctctccaagctgagggactggtttggactttccagaagatgctttcttcagcattcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgctggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgctgcttgtcgcccagggaggatgatgtaccgcctgcgccatagaataatggcatggcatgtgtctcgtagatgcgtctcaccgtctcctccagggtaatccagctcgaggtcctcgtatgcgccttcgaccaactcaacttcgaccttggagtatcctgctggaatcggcctgcagtggtaagtacctgaagggtccgttgggatggccatgcccgacgccaccttcatgttgtgagagagtatttattagtaatcaacatatataagcagcaactagcggaatggctaaatcttacctttattgataagttcttgaaaggaatatgcagctcacatggtgtccgctgagtgatgtcatcaacgggacaggtcgattcgtccagtgtttgcatggcgtccatgctctgtgatcctaactgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcgaaacgtgccctgagaggaggcttccactgcatctgttagtcgtcgcgcagcctcttgtatctgatagccgaagaccagtgagccatcagctaggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgtttaagtactggtttggatcctcgttcccctcttcttcattccagtactggctgcttccctccgcgattgtatcgtacaatatctgttccttatcgcggtcagccatctgttgatacaagaaacatctgctaagtcacgagacatttatgttttaacaatctaagtcatgtatgctaagtgtaattgtcgtacattagaaccctacacaaccttacgtgctaagtctaattacaaatcgtgatataagctaagtctaggtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctatttacaaataaagtaatattatattaaaactcaaataatattacatgctaagactaaaatagtaatgtatgctaagtgtttcgtgcgtatatgctaagtctaattaagactacaatagtcaattgttaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaa

SEQ ID NO: 71074 - DNA, 536 bp, Oryza sativa
aagtccaagttcaatcaccaccaagaagcctggaaccataatgcatactttgggcctgaatccgaggaaggcggagctacaatgaggtggacactgatgacagcagcagcatcgacttcctcaagttcctgagccaaataacgcgctagataattatgtgcagggcaaggactaacaggaggggcagagagagatgttccatgtcttcgacaaggactagaaaacaacttcatctttgccaccgagcctcgccacgttatgtccaatgcatcaagaaaggctcactgatgagaaggtcgacaatgatccgcgaggctgatggtgacaggcggatcactacaaggagtttgtacttaaattcagaaaaaaataaaagaagcaatttgattaaaacacatacaaaaattataaaatcattaaaactataaaaagaaacaagattccatgtagaatataaaatatcaagagtccatataaaagtataagttataaatatatggaatttggaataataaaagaagtattaaaagaagagt

SEQ ID NO: 71075 - DNA, 9404 bp, Oryza sativa
  unsure (1)..(9404): unsure at all n locations
acaatcacgtctacatcttatcgtgccatattcaatgatcaaaagcaacaacaaatagatgtgaagtgcacgtgaggacgcaagcagcaaaagagcgatgaaaagttgaaaacgataaagcaatgaaaacgatggtgaaagtttggaagggaagaggagaaaagaaggcggctcccagcatttggaaagaaatatactactccagtagagatgaaggcagagacaaaactgtagcacttttaataggaccaaccatatccaccaataggggaggagcatacatggaccccatggcattcaaccccacctgaaagtgggatggcctaacgcatctcatgtgacgaaggaaacaccctggagtatacaccatgagaaaacttcctaatactacatccgataaggccccacaatacagccagcaagagtatatagaccaggttcaccaatatgcaaccgagaaaaattgagccaatgacagcacgcggcctgcaccatcccaagctgacaaccgcactccccgagctgacaaccgcactcacgctcgtttgcgcgcaagatcaagcatgcacagttgtgcctcactacataggcacattccatggtaggtccgaaagcaatgctaaccatatggcctacacgccagcgacaccaaagccatagaccaactgcattgacaatgcatcgcccaccgtcaaacacaccgaaaattcacaaacgcaattgaacgacaccgcacaaattatcacggataaaggccgcacgatctagggcctgtttggttggtgccacattttgccacacttgaggtatgttagtttgaccaaatgtggctagtgtttggtttgtttctataactttagcataccacactttctactcttttggtcccactagtcatagaccattttcttagccaaagtttgccacaagtgtggccatcaaattttgagccacacaatttgcatcttgccacacctttggtaaaaaaaactatggtaaattgaggtgggcatccaaacagcccctaaatcaaacggatagggtggcaagcagccacaaaagcccaccaaactcaccaggatcctagtcgtggttgacatgtgaggagtcaacagcatccatggcagcggcaaaccgtggtggggaagagcagaaaacatcaatgctttgggctcctgcatgtaaattctcccatcgccgccaagctgctactgccgccaccaccgagctcaacacacccgacaaccctgaatgtcctaaatcgaactttcccatcagctttggatctggatcagacagagagggaaattgtgaagaaagaaagggtgggtgagcttgccctttccctctggagctcaccactgaggaaaaaccgctggtgtggacgccattgatgagccaccggatccgctggcaaagaaatcgcggctgccgcatccaacacccacagcctccccttcgagtctgcgtcagcggcggcgtagcaaggagagcaccggcagtgagggcgctgcgaggacaccacccatccacaacatcgatccccttcgagcggagaatggcagcaacgtagggaggacacccggcggcggccacggcactgggaggacacccagcggcggccacggccaagccaaatccaggcgccgcgcaggagagagcgagagagatgagaggggcatggcggctgggagttttttccttttttttttacgcgcctgggattctcgcgaaggggagagagagagagaaagaaaaggaaattttgcgaaaatgcccttcagtttctaggattcagggcgcagtccttttttcctctttttgtctcctttgtattgaatttcgtaggatgcaaagggcctaaacgcaatattttaaaccgagaaaagaacagagaggacgtataacaaaatatctataaaagagagggcttttctgtaaaatttgcagaggcgacgcggacgcatgaaaggccgtgaaatccatccgctctccagcgcgcgtccacgcgtcgcgaccccgtgatggccacggcagcgcaaaacgctgagggcgctgcatttcccagttggtttgaagactttagatagtcgaacaaacaggcgacaaatcgaattttcgaaaaaaaaaattgtccgtgcaaattaacaaatgagcaaatcccaaactggcttaagctagctagtaggctagtagccgtggcatctggacatgatgggcgggtcggcgaacgggccgtcgagcacgccgcgcgccatgatccggtacaccgcctccgtcatgtgcaggccgtcccacgagatgcgccgcgacgggtccgcgcactgcgtcgcgccggggtcggagcagtgcacggtgaagttgccgttgtacggcccgccgccggcgcagcacgcggtcagggcgtcgtcgaacccgctcgccgcggggttcgacacgagctccatcacctcgccgtagtagtcggcgtaggcgatggtgacgcccgggtgcgcggcgcggagctcggcgaggcggcggcggaggagcgcgttgtggagggcggcgaggccgtcgttgagcccccggaggcagcccgtggcggggtcgcggtcgccggcgccgccgtcccggaagaggaagaggaggcgcgggacgcagccgagcgggaagaggcccgggacgtagacggtggtggcgccgagcccgacgagctcctcgacggcgccggcgatgtagcggacgacgcgcggcaccagcgggcgcacccactccagcgtcttgttctggaacagcgggtggaggtagtcgttgccgccgaactcgcccaccatgaacaccgacctcgccatcgcctccttccgctctgcaaaccattttaaccattttggttcatcaccaccgtcattgctcaaaatttcatgatttttttaaaaaattaaaaaattcgaaaattttgaatgaaaaaaatgaatttgaacaactttgttggtaggctaaaacaaattcgattttttggcctggagtttcagaaattacaacgcgttccaaagttggtgttcgctttttattaagataaagatgaagttatggcatgaaaaacaagaaaaaacattagtacataattaattatattttaattattacaaagctgaaaaaataaattatataatattttaaaacaatttctatataaaaatttttcacacgaagtatatcgtttagtaattttaaaaaatgttatcagaaataacgagatctgactacagtttatgggctattctccgtacgttcgtgattaacagtgccgacagtaatgcagttcctcgcgtacaaacaaggtacactgacctacagtctcaacgaaatgctgctgattcaatgattcatcggcccaacattccaacaaaatcatcgatataattcgctcatcgtcgtgttacattaacagtgaacaaattgaatcgtacacgcagcatgcgtacgaattaaacagcaacatcaacatcaattccagttaattattaatcatatcgctgagattaataatcttatctagtttcatattataagacgactgactaagtcaaactgtttcaaatttaatcaaatttataaaaaacatagtcatatttttttacctaagataaatttattataaaaatatatttaattattaatttaataaaactaattttgtaacataaatattactatatttatatataaatttaattaaatttaaagcaatttaaaagtcaaagcatcttacgaattgaaatagagggattacttaattagtataaaattggcgatgattaaccttgttctgtggaggcgagcatggcaagaaccttcttgaaccagccgacctggacggcgagggagtagggcgtgatgccggcgacgctgaggtgcttcttcttgaacagcagctggttcagcgccgtcccgctcgccaccgcgaagttggcgccgtaccggaagtcctccctgctcttcccggccaagtacggcgtccagtacgggaaccccagcctctccactgcatcaatccatcacatcgtcgtcatcgtcatcgtctccggcggcggcggcggcgctaggtagagatagctaagctaagctcatgggtggtttgcgttaccgatgaagtcgacgatgaggcggccgtcggaccagcggccggtggggcggcggaagaaggtctcgccgtagggggagcgggcgacggggcccggcgaggtggagtagtggatgaagttgccggtgtcgatcagcgagttgccgaaggtgaacaggtggctgtagcacccgccgctcggcgccgtcgccgtcgtcgtcgtgacgttcgccgccgacgccgtggctgcgcacaaggctaaggcggcgacaagtatagccgccactgcgggagcagacaaccgcgccggcctcgtcgccatggttggagcttggatatgcaaaatggcttctccagtggcgcctctcctttctcgatttgagcctatatatagagagattattatgactcggctcactgcaaaaaaatgcttacgccaaattaattaccaaaatgtttcggttagaatgtggctttcatcgggaagaagacaattttttaaaaaaaatattacaaaatttcgaaattagcttttcgatcgagctggattcattggttatgatattttttaagattgcggttgactttctactgcgtttaaaattttccatttgttttgcaccgtatttcgtcaactcatgcacagtgatcaccctttaaagtaatgctaagaaggatttggcagttggggggtcagcataaacaagaatctcagacggattaaaaatataaaatttgtactataagttgtaattgatgtggcgatttggtgatcgaagaactgaagagaaacaggaattatcatctgctgccttgcgagtatagtatgagtgatagagacgcgatcacgcggtcaattaatttcgtacagaaggtgtggttcacgtggcgtatatattaatcatttgtgcagtagactgcttgttttattctaattaagaaatgacgttcaagtgcaatccttctgaaaataaaatataataatcatatcgagtgttattagccttactccctccgccccataaaaaacaaacatagaaatgaatgaaacactttagatatacatatattcagatttgttgtaataatgtcccgttcatttttttatgggactgggagtatggttgaagagacatcacctgcaaaacattatgaatagtacgaacgattgattttgcctgtatctacgcggctacgcccatgccttcggccccaacaataatgggcctcacgtggccagcattacccttttggcccaataagtacggccccacacgtaggccgcaatacattcgggcccagataatatgggccgcatgtgagcccgcgattacgtttcggcccaactagcggtctacgaggcccataggcgggtgagccatcgcacctatagacttgccgttctcgcgacgtggcctctcccccgatctctctctctctctctcctccgcatcaccaccaccgccgccgacgagctccggtcgccgccggcgagaggcgccgcgcgatccgggagatgccgccgctcacggggcccaagtccggggacgctctcttcggcagcgtcgagcgcgtcgtaagttcccgcccctcctccccccctgtttgcttcacagggagtcagaaacccccactggatctgggccctgatctgcttcgttttgctcgcagaacgcggagctgttcacgctcacgtatggggccatcgtgaggcagctgctcacggatctggaggaggtcgaggaggtcaacaagcagcttgatcagatgtatgtgtggttcttctcttcctcggtgtctaattttctggttcaattttagggagtttcgtgggtactttggaccgatcgtgttataggagtaggaattcggaaatattcactttttgccacccctcaaattacagtgaagcagctgcaatggcctcagtaagaggatctatgtagactttgctatggaattttgagcaaactaagtaacgttcaggtagtctgaatgattgaagtatttgtaaaggtaacttttagtaaacttcttcatgaaggtgtattacagcgatttgggatttagaggttcaaccttatacctggataatctgactttccaatttagtgcagattttacactgcgacaaaatggtaattgatcattttgatatgacatttcacgggctcacggcaccttatattcacaacactttcatgtgtcatggtccaatgtggggaaataatatgtacaaatttattatattccagttttggaacttctttacttagttaagcactaatggggttagtgtgccacgacaattaatatctccatatgtaaggatgatattaactgaatcttgactttgaagtagtagataataaatcaagtggttatctggcgaatattgggattcttatttagtaatcaatatctatggcttgctggctgcattttttcataatttactactaccatctgcctttgccttttatctgtttcctaaataagtcacagctatatttattttcacttcgcaggggctacaacattggaactcggttggttgatgagttcctggccaaatcaaatgtatcaaggtgtgttgacttcaaggagactgccgatgtcattgcaaaggtatttcgttaaacttgttattatatggttcagattgaataggaacattatcagtcggtaacattattacatgtttccagagcttattgcccttattcagatatcccagacttggtggtgcattaagatatgggtgtatggtctaaagtttttttgtctctccttaaaacagcttggattcaaaatgttcttgggtgtgactgcaactgtcaccaattgggatgctgagggtacaagctgcagctttgtattggaggacaatcctcttgtagattttgttgaacttcctgatacttgccaaggtcttcagtactgcaatgtgctaagtggagttattaggggtgcactggaaatggttagtttttcagctacctctaccttctccttccctcttcatgttgaacgatctatagatgcatgacaggatgttgtcgttttcgtatcagaattctcatggtcttgttatacatatttaagttagttcataatgactagatgactgttaaggtgccatcagcaaccaacctgctctattatgtggggttatgccctcgtgtttctcaccataatagcataccaaaatttcctttatcagcacatgatatttttgtacttgtttatcagtcgagagaaatcttttacaagtgctactctgattgaattgcaattgtcatataggtttctatgaagacagaggttacatgggtccgtgatatgcttcgtggggatgatgcctacgagatgcgagtgaagcttaccaagcaagtcccagaggaatacccctacaaggatgatgactgacttgacgatttcgtggatagtttctcagttctcacatgatgcttgtttgctcgtctggatttcccttcttttctttcctctgtgactgtgattctggttcgacttggctggatgctacatgagatagctgtgcattatattttacacttgcactttgcacggcagcatgtattgtagaaatctatcataacttctgaatttgtttgctaagtttgacaaagcgtttacgatccatatgagatttcttctagctgtgctgcccggaaatctatataaagaggctttttagcctgatttcatggcacaccttgttcagcggttgtgcttctccctgataacagattgttagggaatggtctcatgtcagtgataaaggcaccgtgtttttaactacagatgatctcaatcctgacgataatggggttaccccttctctgtggtgagctgcggttaccgagtaaaagcaagaaaaactagataatttttttatcaaaaagtagaaaaaatgcttaaattatttttaaacttggtcaatatacatgtgtttcttttttcagttacatggagacgcgcaaacattactacacatacaacaacacaccagagaatgtcccccctaatacacacttaaagagatggaagtttgcgtcatatctctggtctcactaaatagaaaattctgttgaaagctcacttatgtacataatctttgtgggcaacaggatttgaacctaataggagtatataggtggctccccttaagtacaagcaacgataaaagaagctcgcttcgcggtttccaaatagaatcagctctactcctcatcgttgttctatatgaaatcaatcaattcgaatattcaaattctaaaatttaattttaaagttaattttaaaatgttttaatagtaccttttttggtgcaaacttttaagtctctaagaatatactcataaatattttttggtggctaataatcggacccttctgttcaaaggaacggttaaatggttaatgaataccccgtgttgctgtggaaaattaagttacataattgtacaaaactaaaaataatttgatataattttgagcctaaaagtaattgagattgcatgtttttaaaagagaagaaagaagagacaatttagattatagatctatctttcaaatgttagaaataattaggatgatataacttatcgatagaagagaaaaatggtactacatccatattttaatgtatgacgccgttgactttttatacgtttgaccattcgttttatttaaaaaatttacataattatcatttattatattttaacttaatttatcatcaaatattctttaaacatgatatacatatttttatattttgtataaaagatttgaataaaatgaatggtcaaacgtataaaaagtattaactaaggccgagagtgcgagtctgcgagacagtaaaactgtaaaaattccccaatctttcacccacccaaccagagaagtcgagaggaactcatctccttccgcttgacttgcccccattcgattcaaaccgacccctttttctttttgctttctgcgttcctgtcaccccttctcgcccctattattcctcctgtcctttcctttcttcgcctttcctttctttattttcttgtcttttttttttttaaataatattctcttttctctttttacttatttactttttnnnccctcccgcccccccccctttttatnnattnttttttcttttaatttgttccctctccctcttccttaacaactacgccttttccttttttactttgctttctttattttctatttatcctgctctcttcttttcctctctcccctttttttaatatcg

SEQ ID NO: 71076 - DNA, 20331 bp, Oryza sativa
ggtggtggagcgggagggtccccagtgatacgactgggaggcctacgacgagctcgttcgcatggtggagcgcgccggcctccgcctccagatgccggcgttctcatggtggtgggacaacgcagccgtcgcctccctcaccttctcccgcatcgccggccggccgtcggagctcctcgccccgacgacctcctcccaaccgcctgccggcccgcctagccccagacaggcagagagagagtggagggggaagggagaggagagggaaagagagacactcacgacgtggcagcctgacatgtggggcccacgtgggtctcacgctgattcagcagccacgtagaccaaaaccggggtcaaaaccatcgaagtaaaccggttttaattagttaagggacactggatatctggttttgcggttgggggacgattttgtaactcgatgacaagttgagggaccttaggtgtaccttttcctttcagatatttctaggcttatgagttctttcttgggcaacaggcccaaatgtattgggcttgctgatgggtttatggcccattcctctaggctggagttttttttttatttttacatttttattaaaagaattaaaaagtaatttttggtttcaaaaatttacaaatctatacattccacatcctcctttttttttaaaaaaaaaaccctccaaaagatgttgaggggcctaaatataaaatttccaatatagcttgttaactctatgattttgtaatttaaaatatacaccatataaagtcggatgaaatcaaactttatatcaaaatcgtagagctcaaggagatatacaactttgtagttaacaatatcgtttagatgtccaaatattcgttacaaaattcaaaacaaattttaacaaaatctcaaatctacatttcaaacgacatcggatggagatcaacttggcaatctgtatcattatcatcgtattactgagagcaagaacagtagtgtcaaagaactctgttccggtaagctaagaactaaacatgacttgcacagttgcacttggcaaaaatgtggtttaggatatgtcaaacatttttttttggtaatatacatggactaattaaaatgaacttccactcaatagtttgtttgcaagcaacaagactgtctggtagggagttttctgcacgacaacacaacccaatggaaacgttggttagagttgtggatggtatgcagtttcttggcctcttgggcattggaaagtaaattttattgtaccaaatctctgtataaataatgagaaactctgaatattaaacatttcattcatgtggttactgaatcgacaccgccacaccggcttcatcaagcggttgagattattagctgttgccaaggggatgatcagtttcagtttcagttaagtcggtgcggtacaaacagctaagcacgtataatgattgaaatgtatcttagcccaattcatctggagtagatactttagaggatgcatgttcttgacttcttggtgaggaaacctcatttcggctgaagaaaacctagttggcacttggcattgtcagagctgacttttgttcttctcttctgcattttgcctggagttcatggctaatcagcaatgacacggtttgtaatcacaagttaatgtcttccccggtcgctgttgttcacaaggtgagagacctttcctgaaaccagcagagggagctttgccgctgtctgaagcaaaaatgttaagcaagaaatttaatactgttcaatttgattaaactcaccgctctgcataaatcacggagtacatgcattatattaggcaatcaccattttgtaaacaaatcatgcatcctgccggtggccatgttgaatgacgcgttgctctccctactctacggatgtgattattgccagcgaatctccaactctgaaactctcaagttcagtttatcagagggttcgcccactgaaactctgaatttccggagacacacatgcagacttatccaagcaacattcgctacaaacacctcaaattgaactcccatatataatttcatcagtccaataatatgttaacgcgttgttaattaaaccccggacagattgcataatcactggaaaagcaaaagtcgcaagtcaacctctgaattattggctcccatgttaccgttcatgctggcttagcttaagctaatcctacattaccacgcatccaaccaacgaactaaccatacaaaatcttctaaccaccgtacgttctcctcgcactataaatacacaagcttcccaagcaactgaagcaaaaaagcacacacaacttcagttcagtactcgtagctgcttctgcatttttgctcgatcgattcatcagccatggcgactaagctgcttgctgctgtgatcactgtgctagctttgctgggccatgtcatgggccaaggagggtacggcccaagcccaagcccaagcccgagcccgagttcgagcggcggcgggctcgccgtcggctactacgacagcgtctgccccaacgccgaggagatcgtgaggggcgtcgtcaagaacgcggtggcgcaggacgccggcgtcggagcggggctcatccgcttgctcttccacgactgcttcgtccaggggtgtgatggctccgtcctcctcgacgcgacggcggcgaacacgcagcccgagaagctggcgccgccgaacctgacgctgcggggattcgaggtgatcgacgaggccaaggcggcgctggaggcggcgtgcccgggcgacgtctcctgcgccgacgtcgtcgccttcgccgcgcgcgacgccaccgtgctcctcagcggcagcggggtcgacttcgccatgcccgcggggcggctcgacgggcgcgtgtcgctcgccagcgaggcgctcggcatcctcccgccgccgacctccaacctcagcgccctcaccgccagcttcgccgccaaggggctcggcgtcggcgacctcgtcgtgctctccggcgcgcactccgtcggcaggtcacactgctcctccttctccgaccgcctcaactcgtcgtcgtcgtcgggctccgacatcaacccggccctcgccgcctccctgacgcagcagtgcagcgcgaacgcgagcagcggcggcggcggcgaccccacggtgatgcaggacgccgtgacgcccgacgtgctcgacaggcagtactacaccaacgtgctcaacggcagcgcgctgttcacgtcggacgcggcgctgctgacgtcgctggagacgaaggtggcggtgctggcgaacgcgatcatcccggggctgtgggaggggaagttcagggcggcgatggtgaggatggccgccgtcgaggtcaagtccggcgccggcggcgagatcaggaagaactgcagggtcgtcagctaattaatacaattgcatatatcaagccatatgtttaatacatgactgaaaaaaaaaccattcaattacgaacttaaattgagctgaatttatacattggtacatgatttaatttattgatttataccagaagactgtattgttactcatatttgttgttactgctaaaatgttacagtaatccgacatattgtagtataacattgtaatctattctgttgttatactctttttttttataaaaaaattagtacataacaatttggatatgacatgcaagagatgagtacatgtgcaccggagttgtaaattgactttcccaaatgttgcatgcaaatagaataccaaagaggatttggtacattttcatccgagatgacagtaaacgccagcaaatgaaaccaaatttgacaaaattaatcaacaaataaacacttctcccctgcaagaacagaaccaaagcaagccaccaacccaacagtagatcactcgcttcactctcaaattgttcttcagatcgtggcacaaattgttcttcagatcgtcgcaatcgaaataaaaaatgaaagatggattggaacgagaccaaacgtcagatcatccatggcggccactagcttagctcaatcagtagctcgctagttgacgaccctgcagttcttcctgatctcgccgcggtgggcggccttgagctcgatgctcgccatcctcaccatcgccctcgcgaacttcttctcccacgacgccgggagccgcgcgttggcgcgcaccatcctcgccgtcgccggggacgacagcagcgcggcgtccgacgcgaacagaacgcggcgcgcgagcacgttcttgtagatcgaactggttgtcgagcgcgcgcggggtgaccacgtcctgcgccaccgtcgggtcgtcgccggcggcggggctcgccgtcgccgggcaccgcctccgcaggaggttcgccagcgccacggccatgtcggacggcggcgaggccgaggcgaggcggcccggcgcgaaggaggagcagtgggagcggccgatgaagtgtgcgcgccggagagcacgaccacgtcggcggcggcgaggcccttggcggcgggccgagcttctccggccgcgggttcgccggcgtcgggtcgagcagcacggacgcgtcgcacccctgcacgccacggggcgcacgctaatcaattagccggcgagcacgcacctcgccgtgcgtcgccattggtggatcgatgtgcttaattacctcgacgaagcagtcgtggaagagcatgcggatgaggccggcgccggcgccggcgttcttgacgacggccttcttcacctcggccctgacgagggcctccgccttggggcacgaacgccggtagtggcgccgacctcgaggccatggcacgccgccgcggtggctaggaggagcaaggcgcatgcggccactgtagcggcaagcttagctccggccatggcgatctatccctagctagctactgaagtgctgcttatctggcaccttgcgaacatccaacaacggcatgaattctttcatcgctgctagcagcctagcaggtttaccagccatgtaatcaggccccaggaacatctgggactgcgactgaaactggcccatatggcccaaatcacaaggccaccgacggcctacctagattctgattgcaatcaccattcacttcagatttgcagcactgcagttttcggcatgcagcttgccaagttgcaggcagggagcgtcgaacgctgtaaaatgttctggagattctgaatttctgttatctgatgaactgtgaacttcgactcaaggaggcacagggcatcgcttctttctctgaccaaaggcaagtgatttgatttcttttagaaattcagttaacatcacacgactcaaacaaaacgggtgaaagctggagcgaaaatgcaaaatggagttcctgtttctatcaaagcaagagggaagaaaggatgacagatatatctgaactctgacgaggacgggtgttgttttgtttactggcaaatcaccaacgcactggcatcagaaatgcaaaagcaacatcaacaaccgtactggatgcaatgcatccatttcgacgatctgtcgatttttattgaaaaccaagtttgttttcaggcatgtttagaacaagtgatgtagtggaatacaagtggcatctgaccaagaacacactctaagcagccaatttcctcataaatacaccctttggagcaagaccaatatcatcgatgacaatacagttttattcagcctgcttccaatattgaattgttatttctttttccctagttcaagacagcaagagcttcaagaagggaagcaacaaaatgcatctggacctcctcatcgatcgtcaagaacaggggcacatgtacaaacagagatttgatgccgtgttgctctgcgaaccgaagagaatgataatacacatagttgcatacaaaccgaccagcatcgtctgatggcattacatcgtagcctgtcttccggagtgacttggtcaactcatttaccggaagcgtagtctggttgttcatgaaaagttcagataaatgtgattagtctcaagatcaacagtactctcaatccaaaacttgaaatatctgatgattgacattttattcattcaataatgcgcatatgaactatctttgtttgttatcatacaggcaacatattcaaaccacataagtccattatggtaggttttaaacattccattatgataagttttaaacacaaaatatgggtattctgaacatgtggggaaaataatagggggcatttgtgatattattttgtagagaagatcgtgctgtaatcaggcaatcacagattaccattgtccttttgaatatattcctaactgatttgttcgtattgaaagaaataggaagaaaagagatgttcaatagaacttctgaaaatcaagctcgcgtaggtaacgtaacagtgaagaaagtgatcgcagcagacctatggtgttctatttggcagtttggacttctttttttcattcaatgggaaggtgtcttgtggggtcatggccattagaattatgtggggggaaaggactagtgaactatgaaaagataatatgtaactctgctgttcgtagctgtactttcaacaaacatccattaatttccagacaaactttttttaacttgtacctctcttgtccgtgagatggctccatccgatggtacaataggaaccctctgcacggaacaatcaaaccggtaaacacaatgtcaagatatatagacaaagataagtaattggacaaaatcacaacctgaggtttccaccctagctcatctggacaacggaaggtggcttcgttaacagcctgattctcaagagcaaaccttgttgcaccactattaactccaaaatggatctgaacaagtttcaaatgataattagtttgactattcgagtggcattgaaggcaaatagaaacttccttattctttttctgataggacagcattgcaatacgcaaggtgctgactgcattacatcattatgtaatatggaatcaaggaaggtggataccaacccaaattacttgcccctgagccgatgacccattctctctttctgcaatggcagattccaaaaccttatataatgtgccaagtgccccctgccctgcagtttcaagcactgtgcagcttccaagtacaaggtttttcggcaatcctttcttttctacgaatgatttaagattgcccacaattttctcagttgggttctcagcaaccccatggaacttcttaaatccggtaacatggacagtaacaactgaaggtccttctgaacccatttacccttatgagttatgagagagaacagaaaacactatcccaaaaatctgaacagaacaaagatcaataaatggataagtattagcaaggcataaactacaccagacaaaaagcaggatgtcacgaccatcactgcatcattatgaacttgctaaaatcctaagcatcaggcaagaagaaattatagcgggcagtttcatatgcctcaatgaggctcctgagcatacaacatgcaggttgcagggaggttaacagcagggcacacaaaaggctgtaacactgtaaaagtaaaaaatgtatgacccctaagtaaatgtgaacaagaaccagatgattttttttatctgcacaaggacgacattaagaaccacaatctccagaactgatgaagcaatcattgttcttcctttcaaccaaaaaaaagaaagcaatcattgtcctaaagattttattaagaagtgaacaactcaagaaataatatagtctcacagaaggcgagaacaagtaggacaggtaacctaatgctttggttcaaccgaagacaaccttatccaaattcaacactaaacagtacaaggttgaaggctacatcacatatgtgatttttgtctctgcaaaaccaagcctgaccagtgaccacaagaacaagagcacaaaaattgttctaaacagcgaagctcctacccagaagaaactaacaagcaggtacttgtagacttgtggtgggtacttgccatctaactttgccacaaccaactcaaactcaaactcacaaagaacataaattcactaaataaccatcacctatcctatacgaatcgactgaaacttcctgaaatcgatctgcacctatagaaaatgcacgcaaagaatcctttcttgaaggatgttatgctcttaatagtcaactccacgtctctaccgaaaacttaacagcgcagaggaccgcacaaatcctcaaaccccaattctccaatcaaacaccaggcaaggcatgaacacacaccaactgcagcaaaatcaaagaggaaattcactcaacccaagaaccaatccagccaaagcgaccacctttgaggccgatcacctcagaatcgcacccccaaaccccaccaaaaatccactgtaagtcagcaagcaaagaaaccacagcctacacgagcatccaacaacaaaaaaaaaaagaagaagaagggaacgaattgtgcacgggcaaacaccaccacccaggtccccaaccatcagcgcccccaccaaaccacaccatccaaaggctcaaagcacaaaaagctctcaccttggggataacgcagcagcagcggcggcgacgaagaaggaatctcgtagcaatttttctcctctttcttttttttttcttcttctcagtcaccgcaagaagagaagaagaagattcggggggatggaaacgggggagtggacgatgagattgcagcgaggggaaggcggagggaggcaaaggcgacgccttttaaagcgcatcgcgcaccaccacccagtcgatgaggagtagaacagtcgaactgcagaaaagcaatcgagagaggaggagagcgagacggaggagaggtctctcgtctcgtcggggctgtggctgacaggtgggccccaccgcgatgccaacgccgcttcgtggactcggtgcagccgcaagatagctgcgcacaacatactactgcattgattgaccgtgatacatggttgcatgcaaaaaaaaaaacacgaaattacggatactttagttaaattataaaaaaaatataaatttaagatgatgttttataaaactatagatttagcactagatttatcatagaacatatttaaggtgaagtatcgtaaaactacattttcagtaataaaaattattataaactactacaggttttggagtttaaatccttagcactagtgttatgtttgtgggtcataaacatctaagtttgtgattagattgacactaatacaatagttacctgctcagttttctttcagatggaaaacgagcactgttagttttttttttctttcaaataactgatggggcagtttgtttttggatattattcatcgtacagaaaaaaaaatgtaattattggcttttttctacttggtttattattaaatgcacttaaacatttttatatatttgcaaaaaaaaaataaaaaagatgaatggtggaacatgtatcaaaattcaacgacgctgccgtgtattaaaaactggacgaagtaattttatagggatttagactgtataatggatatactactcatgtacatgtacatgtacaatggatatactcatgtacagtagcaggctaaattatttccagaaaaatctgcatgtatattgtatcatatcatattccgttttgcaggttgcagatataataatttagcaaaatgctgacgccaaagtttggcaagtaggagcagagataaggccaccagattcaggctgcagcatttggaattcatccaaaaggtttggttcagaaaacagaacagaacagaattgcttcagaaaagaaaaaggaagaagaaatcatgacaaaaccagcgtacgagcttgacagactgagcccacggctctctgttcttgcaatctccaatgatttgcagcagctgcgcgtgtactctgcttatgatcttatggttgatgcagaggccacagatcgatctcatatgtttcttattagttctcatgagcaaggtcgttaaaatcacgattctaaatcgaaagttctaagtaggatgacaattatataattatatacataaaaaccgtaaattcttcgtacaaagaattgtagaatcacacacttaaaaaacgcgaatattaggaagaacctaatatcgaataattagaaggggtgatgcttcaaatccagatcgtctagcctaccattttgtagagctaaccggaagacctctgtgttagattaatgggctaggcccaattaaatactaataaattccattggcccacattaagtgctatgggtaataataccacattggaaatctaagtgaagaggtctcaacttaaatacggagctagtggagagtctctgttgactggttgagatggtgcgcggataaccaggcgggcgcgaggcgaggcagacagctgttgcgccctcttgttttgtaacggacggtaataaacacggagaattgatttcgtatcaatgaacgattgttttgtaacggacggttacggaattaaacgtcgtgaattgatttcgtcggttacggaattaaacgccgtgaattgattccgtattaacgagcgctctcttgttttgtaacggacggtaataaacacggagaattgatttcgtatcaatgaacgattgttttgtaacagacggttacggaattaaacgtcgtgaattgattccgtcggttacggaattaaacgccgtgaattgattccatattaacgagcgcgtcagttacgaaattaaacaccgcggttgatgactccgaacgttactctcgcgctcgcatatatatactccgcagcgaccagaaaggactgaagaagttctttaacgactcttgcacttcgagttcctcctcctctgatcctaagctgcagaatccttccccggttctgttcacctgcgcgcgcaggtgtaagggacgagcaggtgcctccggaactctgtccacttgagaacttgcacggataggcgggcaatcaagtttttggatagcgcttcaagcgcgactgctcttgttcttcgtggctactgttgttgcatcggcgccttcaccaagatgtcaatggagattggaaacaagaagatgaacgacatcaacggaggcaatactgcctcaaaatccagcagtgggacgtgttctcggggtatactttcattctcccgattctattagatgtttctttgttaatactcttcgcaatggcagcattgcattactatgtaaatgttgaagcttatttcatattaagcatactcaagttgtatacatctaacactgtcactagatctactcatattacaaatgtcatgtttattgtcttaatattttggattaaaatatgccgaattatgaccaaatttccaacaaacgtttctcataatcacacacttcaattaagatcgtacaattgtaccataattttgaaattttgacagatccattgccaatttctgatgataactactcggaggcaagcttgatctgaatcttgtgttcttcaatcaggcattgccaaccaccaccaaacatgtcctgcttcttttactcttttgaaccagaagtagtgagctactacgaagaaccaaccaacctacaatagaaaagtggattaaaatagtgtcagtataaaagaaagatcattaacaaataacaaccataaaatggtacacgcatctttgctgttgctcagttggattttcctgaatgattcaatcgtctgtgcagataagaatagccttgtagccatccaagttggtctcttctgacgtagatgtgagcccaaaaaaaaactgtggaaaaaaaggcaaagcccccgggatcaagaagttctcaatggattcgcccactgtaaagtgtaaaggcattaaaaggagagatatacagcacagatagaaatgctcgtttgcatcatgcgaaatcacttggttgtaacttaaagttcaaactagggaattcgctaaaaatataactgacttcaaaatgagaaacataactctaggtgctaaaaacaattattagcacctgaagaactgggaagagaagcagagaaacgttcgtacactgagagcaaagacgaacaaattacaaatgcatcaagaaacaatatgatacacaacttgttctcctgcttataatctccctttaccctttattctctctttttttttgggtactcctaactttcttgtgctcttatacaaacaagtacctgctaataatactgtattatatataaggaccataatgttttctaagcagcttaacatagtaatgattatttcttacagttatgccgtagttgcttttgcaaagattgtgatggcatagtactaacttccagtgaaataatgcatatgtcttgtactcttgttagagattgatggaagaagaaagctcaagaaaggttgtgaatatgtgcgtgtttttgcaatctatcactgtggacctttagtagtcttagccctactaaagcgagaactgacgatttatttgtagcacaacaatcacttctgtaagattctgtattttgattaaaaataaagctgctccatgaaatgtagtactagtgatcacaaaatggtagattctttttgtgcttagttagttcaatccatgtgacacgtttttactactaatttcaacactaatcaaagatgattttgctgaagcttctttattttgtaagaacattagtatgcactgtaataaaaggctaaggtgccatattcttccattagatcaccagctttactcccttctggaattgtttatcaggctagattcaccgtcacttgcttgaaccatttatctaaactctatgagcagaaatggaaataattacagttcattaaacactagtaattcttggaatacagactcaggtatactgaatgcttatggtttttgactggtcaatgtttaatccctactagtgggtgtcatcagtaatgaattgattgaacactccaagaaattcactgcagtagtgcacaaaatcattttagttgtcccttataataccaaccattcatcttgcttcatatgttcaaccactggtggtttatgtccttccaatactatgaatgggttggcaataaatcacataccaggcaaagtatcggcagctaaaagcctagaataattcaccagatggaataaattaataagtaaacaccatgcaacccgctaaataatccataaacgtccttttaaggtcagagaaatgctcaggggtttttcggctagcttcacaaggtggtgggctagccgacctaagttcgaaccctcatcctttctatttatttgatagtagttccttccttaatattcactttttttaggtcacaccactgacattagtgactaatcacatatattatatgtgcaaaaggctggaaaagaggtaggtaaaagtgccaaatcgtataccggattgcaattgataattgatagggacgcaagcatctgttttattctttgcacatgaagcaagcaaaaagaatctaatatattgacatgcaattcttttacacgttcgtgaaaaaagaagcaggcaagaaaaatcatgcataaattggatttccgtcttctagaatctggaatgaaaactatgcacactagtaatatttaaaagagctatcatataattaatgggttcatcatcgctttcacctggaatatagctgcgttggagccacatccttcttggaaacccagcaggaatttaaacaggaggcagagaacaattgcagcctttattattattattttttttgcctatcagatgcctttgttttggtgttcttatcttatcctggcaatggcatacggcatgatgcacatttcatccatccaaccgtgatagcgaaatctggcaacaatgtctgtctttttttttactctgcaaataaacaggcttgtcatcaagattgaatccgaaaggactaattcagctcatgcttctcagttctgatcagttgatctttccaacagagatagcttctcgtgtttgtcgaaagttcagtttcaggttcagagatccatcctcaattactgaaaaccacacatatatttttcccaagaaagtgtgcaaaattcagaagataagtttgatgaatgattccgtagactactagcaacttgcaagattaaccgagacagacaagttagagagtcaatccatttttaagataatgaaaatggattacatcttcagcttaagacacacaaccataagtttgctaaaaaaaaaaagagtgtcagtccataatatgattatgacaccacaaaattggaattaacattatcagggaccaactagtgatcaagctactgaatgaataataatcggaatgcaaaaccacacagaaatttccgataaactaatccactagaatcacaactcctttttgctcagattaattttagacgaacctaatctagctggtccctttcatatccgaaaagaaaaagaaggaaatctgggcaccttgtgatgatgcccaaccgcccatttctccctacacactcattccgtcctccatctgtttcaccaaatcatggcattaaaaatactcctaatctcgaatcctccgttaggttggaaagacccacgaacagatcgatcggtgttttctttctccttcgagcttaaattctcacggaatcaagcactgagaagacgctgcaagcgagaaaatctctacagatgtagcgggtgatttcgttctagaaggttctagaactagtttatttaagtaaatttcataatcccacgtattatgggtccaaaattgcataaaaccacgaaaaatttgacacgtgacacgtaacatcggatattatagtcctaaagtttcacaaaaccgtaccgttaaccattttgacatatgccatagtagatagtacatgattatgtgccacattgccaaaatccttataattttgtgtaacttggatcataacagatgtggttttataaaatttacttttttttttcctcgttgatgtggttttataaaatttactttttttttccctcgtcgatgcatcgcgtggtggcaaaatgggccgcacggcatggcctggccatccatccgcagtggatctgggcctccaaagtgcgatctaatggtcacgagaggcccacgataggtcacaatccaattcggcccattcactgtatcttttcaagtgggcccacgagcccacccgcggccgcgtccgtctccgcccaagcggtggcggctcatataccgccgcgagagagagaccattcccccccgtctcggcctcggaagtcgcgcgcacccccaaaccctagccgcgcctccacctcccgattcgccgccttttcgttccaggtaattggcagcggcgtggaaccgaatagtggatgcgtctatgctacccgattactccgtaatctctctcctttttttttggtggggggtaaatcatcttcggtgtttgatctgcaggtgtgtgttgattagtagaagagaagcggcggctgcgacgaggcggaatcgaccatggcgacccgtaagtttcagcatgtttgaggttttgcggctcgtggtttttgtgattaggtagctctatattcatttctgttagttacttcgatgagatattttgtagcgttggggattggcaacgacggattgggcgattagtactgttgggtgattagtcttgtggccagatgcctagatgagtagttttgtgactgaagcagcatcacagaatggatttcggggctagtcaagtgggtttaatgtttgttgagatttttctgaatgatcagtgtttagaatgtaatgtttttgaggacaaaagtggtagcttgttacggtagcttttagtaaaagatctttttcttagcatctcatttgttgttctatgctgaaatttctacacttaatcatgtgatgtagcgcacctctaatttggttggttaggtttcattgctcatactgggttctgaactggtgggtgatgtttgattcaaatgccttttacacatcttccgtatctaatctgctttttcttgaatacacgatctgtaggtattcagtttgagaacaattgtgaagttggtgttttctccaagttgacaaatgcctattgtcttgttgcaattggaggatcagagaacttctacaggtgcatattttgtcagtttaagatgttgggaaattatttgtggaagcgtgggaatgcctaactcataactgctgcattatttgttattttgcagtgcctttgaatctgagctcgcagatgttattcctgttgtcaagacctccataggtggtactagaataattggtcgtctctgtgtcggttagtacttgagcttggatatactaagtggattaatgcacttgccttcttgtttttcgtttaccaatttgaatctttgatgtccaggaaacaagaatggacttctcttgcctcacactaccaccgatcaaggtactctatttttgtatcttttctcctataaatctttgctgccatggctacatcgtttctgctagctctgtgctattgatgtcatccacatgttggctatatgtgtcaataaattagtaacttttcacatggatatagtttttcagtgtatgttctttagccacactccgtttttatggacttataggaaaacagaaaatcttttctaagctaaataatgtgtacatgtactgaaagaaaattttatctacctgatgattataggtactataattatcattgaaattactctataattattatcagagttacagttacttgggtattgcacagagggcaaagttgttaaggcaattatggacttacactgtctgccgcattattatttttcttttgtacgagcacaggcacatggcttgatagtgttgtagtatatttggaacttgttttcatgtaatatccaaggccttctggatattgtgactatctgctagacagatacaatcaatcatgccagttggatatacattccatgcttgtgttgtcgaattgattttccttagcagcttgattggtttatgatgctgtgttatgatattttgtcatggacaaaagtttcaccatgaatttgtagtaattctatgttccctgtgtgtttgaattgttctagagcttcagcatctgaggaactgcttgcctgatcaagtggttgttcagcgtattgatgaaaggctatctgcgcttggcaattgtgtagcttgcaatgaccatgtcgcgcttacacaccctgacctcgacaaggtaagcctatcttcgtatatctctctagtgatgtttcttgacttaatgcttttccctattgtctcgaactaaatatgcctgctgctcaattctccaggccactgaggaacttattgcagatgtgcttggggttgaggtgttccggcagacaattgcaggaaacatccttgtgggaagctactgtgcgattacaaacaggggtggcctagtatgttttttctacttcatttctgttccattcgatctgtgtttgttacaaatgttctttttcttattgtacaacaattgcgaaacaggtccatcctcatacatccattgaagatcttgatgagctgtccacgctcctgcaagtccctcttgttgctggaaccgtgaaccgaggcagcgaggtcattgctgcgggcatgacagtgaatgactggactgctttctgtggctcagacactacggctactgagctatcggtcattgagagcgtcttcaagctgagagaagggcagcctgccgcgattgttgatgacatgaggaagtctttgatcgacagttatgtgtaaaagaccaaagttagtgaatgtgtggttgtgggagtattaactgtgctaaaatcgacacaaactgtactcgtgtaatcagtagcagaaacataccgtcctggtggtgaatttctgtcttctgaattacagacttatcttttacctttgtctccttgaagcctacaatatattttgcagcttaagatttattgattgagcaacacagcaaaaattttggctaatatgcgacatttacgttcctgcaaggtgttcttcaggttcaaaacgacttttctcattagttactgcaaaaccattttatgaactcaaatttggcaaacagagtatatgagaagcttacaagaacagcagaacctcacataattcacattacgaaaaggctatcagaacatcagcgaacaagttctcgcaaaacatcactctatagaagtgcacatagaatacagaaatcagcaagctctccttaaagcataactctagcaggccatcgataatgatgtggcattggcaccaagggatggtgctatcgatacactaccaggccagactggcaagttgcttgctttggcattccagaatgcaactcatggctagttccttcagctgttcttccacaacttccatgggaagggagccatcaacaacctacgtgacacaaccaatgcaacaagttaatcagatttatttattactaattggttgactatagaactaattattatgaccatactttaacgaaacaaccaaattcttgagatactattgcattctactggtttctacacaatcttacaagtcatggtatagatcatgaatacagaaaaatgaaaatgaatgacaggcagatcactgcacttgcacatccaacttaaattaagtactatgctggttgattaccttccatgttgaatcacgaagtgaatggtaatgctcaccaactttcttttggaattcaattttttcatatctctcacccccatagcctcctctttcagctgctttctgaaatggcaaatacatatttatgtcatgcaacatcacatcataagggcttgtttgattaatccccatgagaaagggagtggaggggattaattccacacctcaatagctgtggaattattacctccaaatcctgttcaatccctttgggtgagcgataacaaggcaagtggggttagcaaagaatctgcggaacagttttcatgttttccacaaccgacaacatgatgaagaattgaggttgacttgattttttagagtttcaatgcatactagacagacacgaaccttaggggtaaaagtaaaactcgatggccaatgggttctctatttatatgcttatgtgattagattagggacctaatggggctatcatcactacaatatgcaaatgagtcaaaggcatgaaactgaggaaatcctgcctttcaatactaacaaaaggaatctatattctagaacatagccataggaagaatgagaacaaatagcatacctctggttgtacatccaaatatactacaagatctggggctataagtccattttcaggagcctacaaaaggaaaaaggagggattactgctataaacaatttatggctagaaaagaaaaattcataatatggccacatggtaccctactcaccttgcaccactcaatgtcaagtcccttggcagctgaaaatgccactccagaataagaataacgatcaacaatgagagtagttccaccaagtagctttctttccatcaaagctctgaaaatggcagaccaaagcaacacctccacagttacaacttagaaccacaaagaccttgcatcactgcacatagtgtatcactgaagaaaattttccacctataacataagctgttcgacatatcgtttatcttacaagttgaaaagaacaaaccttttctcccagcgattcgcactgaagagcaaatggattgtcctatcgtcaagttccgactcgttcgcaaggtacgcggatatcatctgcccaacactagtacctctatcaggaaaccgccacccttcggcctggcaacctttaccttgcagaaaggacagcagccgagcacactgcgaagatttcccactcctatccagcccttccaggactatgagggcaccacggccaccctgagagctcccactctccattctcacgctccggaacacgccgcgccactgcggaagcaagccgagaccacacccagccgctgctttgacaccactgcaaagcagaagattacacgcacagtaagcccaaacagagaccaaccacacttgcatcatctagcctaccaaaaacttcgggggaatcgtctcacctgctccaagaaattgctttcccggcgaggcaagctaatgcagtcatgcacaacctggttatcctacttactctcctcccccccaaacctaataccctggaaaagcacgagatagctgc

SEQ ID NO: 71077 - DNA, 17095 bp, Oryza sativa
agaacaatgcaagatcatggctgattaatctgatatttgatggttttatctctaatccaaacatcataccttgtacttgtgatagccatcacatgccacatcacctgtttctcctcccggattcctccctgatgcagcagatcacaggtcaaattggcacagacaggtaaaaagaacaagaacaaccatatatttgaaaacacattttttccccgccaacttaaagtgcagaggttaaaagctaggccgttatagtttatcatgtacagctctctcaaacaaacttagcaataatgctccgttgtgctttgtgtgcctttgacatagcgactggtttatccattatctgaagagaaagatcaaacttatttgagctatcaaggaaaaaaaatgtgaatttccccactctcagatgaacccagtgaactccaaactagaatagcaaacaaccattactattgtgacattgtgtgcaaaaaaattggtctcctgttgcaacaagtaattaggaagcaattaggaatcaagccaatccaagttgagagggagagagggagtacagtacatgagtgagcgtaggtgtcccagatgcttggtgtcctcccatcctctgcagctgcaccctcatactgaaaaatccaaaaccaaaccatgcaaattcaattcatgccctgaattgaatctgcaggtaggagcagagcaaccagtagcaggaaaagatcaagctgacaaaaaaaaaaagagatttggagagaaagagacatccctctaaacattttcaaaaggaaattatgagcatttgggaattgaacacaggatctcggggttgaaaccacacagcccttagcactacaatatcaagtgcatcttaagatcaagctgacagaactcagaatacctggaaagccgcagtcccggctccaaacgtgaatccgtcagggaaatcgtctcgcgtgaactgcagcgacctcacgccttgaacaacaagaagcagcagcagcagaagccatggcgagaagaagaggagcagcggatgcagaggacgcctggtctccattgcgtcctctccagatgcacagccacacatcagcagcttcttcttcttctttctcctcttttcgcttgctatcgttccttcctctccaataattcactagcctcgatcgtgtcgttttggtcggtcaataggatgatccggcaaccaaaaagatgaattttgttttctattttactcgatcgaatgtttttgttctcagctgcatatgcgtctcgattcgtgtgggtgctgtaccaatcgtggcaagaagatgattgcatcgactaacaagaggccaacgtttaaagggagtacaacccagtatgaaccatccaatgttacaaaagcatttttgttgaattttgcgtggacagatcttgtcgatctcatcagtcgaattgcgagccacaggatactcgccaggagattcgtgctggcctggtcgttgtcctgtccttttttggcttcttatcagtgtgtctgcccgtctctggtactcgacttgctacgtaatcatcgtattcgtgaatactctctccatactcataacagaagtcgttttagaacaatgtttaagtcaaaccttgggaatataaattatgaataactcttaagttgttgagtttgaaaatataaaaattatatgtataaatttatcttgaaaaatactttcataaaagtatacatatatcatttttcaataaatatttttatagaaataagaagtcaaaattatgttttggagaccgtgtcgctgtcctaaacgatttgtatggagggagtatgccttttcatttttcaatccattttcgtccatacacctatttgatcggaatcatcggatgcccggtagcgatttttctagacacagttccataaatatactttcttcatgctaaaatataaagctcccatcggttcgcttttttaatcaaaaatgacacagcttattaacaatcaaaaaataatttggataaaacttttatatacacattcatagcgatttaaaagaaaaggtcgtaaaataaactacaatgaaaaaccacaaaatcaacttcaaaattaagtttcaaaattcaaattttagtttaaaaacggtggaagaagcgaaacaatgggagcctaagacaaccaccctaaacacaaagacgaaaagaatttaatcacctcgtctcattggttagatcacctagatacatgcaagtggtggggtttgatgatagaggacttacatgtgctagttaatgtatgtatgcatgcactcctttatattatgaaatatgatgaaaagataattatgccttacatttcaagatatgagtacattgtaattggaaaataaatctgcatcacctttatatctcacggggtaaaataatgttcaaaaataatttattgaaagcccgtcgcaagttacaacagaaaactttactatagcacaaacaatattgtgtctcatcgttatagttttcacatatcagcaataggaacatcgaaatatttgtggaataaaacggaacatggtttttccgggattgcctgcctcgtctagtgcgcatggccggcattatattgcaacaaccatgcagcatacaggcctccactcggcacggtctacgccagggtcgcgtcgcctcacctcgccaaaatgataatccttgagttggaaaaataacagaacattggagccacggaagcaacaaatttcaaacttgacatgtataatgcatttaatgttatacagacaaaataattcaggtaaatctaatcagtcaaattgacattccaatcgaactacaccgagattacaagtgcctaactaaatcaaatcacacattaattattcaaaacaagaccagattcccaactcatcgtactcttgtaactaaatattttcgaaactcaaggatgaaataaaaaaaaaatgaagccgcagccttaaaaatatgtacggtcccaacaaagaaaatcggcattctttgtacaggatacaataattaatgtgcaataagatcatatctacaataaactgacacattctggctcacgagaaaagcttattggctaaaatttgacacgagcattcggtttatacaaaatcctgactgtaaaactccataaatgaatgctgaagaaatattaaacaaatcagagcttacaagcaaatactggagaagtacctatcaagatacacatcacacttgaaggcaaaacaaaatggcaaggaaatgcagtaaaacctgaagggtaaataaagtcctagcatgctaatagtgctaaatttaaagcaatcccaagtttccagctagaaagaaactcgcctttcaaaattttgcgtaaacaacaagagaagtagagcagaaagtggctagagttcgagtgaaacaggccaaatatttgaaactgcagattctttggtccaaatctctgagagggagagggagagagaaatcgagagggcaagaagatatcaagaaccaaacaagcaaacatatgacaactatatgctatgttgattgaacattatacgcaaggcaaaagaagcagaaattcacaaacccagctaatatataaacagcacagttgaaatgaaaagtaagcttgttttctacttcacttcatcttctatatttctatggtgaatccagtcatgcagataaggaagagaacatatgcacatgcctttccatactgaaataaactgtacagttgaaatgaaaagtaagcttcttttctatttctacagtaaaatttagccatgacagatcatgaagagaacatatgaataggccatttgcccatttcataccgaaatttggatcgaatctggaagcagcaattcacaaggctgtacagcaaatcaccgttgtaacaaatccaatcttaactaacttccaacagtgcaaatacttacagaggagaatagataagcaatgccttgtactggaattgccaaacaataattgcaggcaagtgtaaacttcttaataattatggcatttcagctacagtagagaatattcagggaatatttaaatacaggcactggctatgatgaaaagcaaaacctggtgtttcctgtgatttcccatttgtagtttcacttacactgaaaaactaagagggatgtctgcaaacgtgaagaaaacaaagtagttgcatttccatcagtaattcagaaaggaaatggcaatattttaaagtaacaaaatcagaacttagatgttacccaatatgtgcacaattcagatgttatctgaatccatattctaaggctgtgttcggtagtaagggatgggaactaatctctcccgcacataaaaacggagcggtccattagcacgtaattaattaagtattagctttttttttcgaaaaatggatcaatatgatttttttaagtaactttcgtatagaaattttttttcaaaaaatacaccgtttaacagtttgaaaagcgtgcgcgcggaaaaagaggggagtgggttcccaactccttttgccgaacacagcctaaatgtttctctgtttcataaatgcatccacaattacccccaaaaaatcactaaaatttccattgaaaagcataagaggcaaaggatttcaagcataagtaatacattttcatcagtacatatattcactcaatcctgaaacatattaagagcaatggaattcagttacaacataagagcagaggcattcaggcacagatcatcactaaacctgaagcataaagaaatagttgcattttcatctgtacatagtatgatatcaactgctgattctgactatccatggtcagtactcagaaataaatggaaggacgcagcatgtatttgcttgtattagtttcaggggtgcggtttttgtgtgtgtggaacagttacaaaaaggttggcaagattcagtaagaattccacatgtaagagtaagaaagtcattaatgacaaaaggaaatgtatctttttgcataccgttgaagtttactggagcagtgagtaaatagagagcataactaatccaagcaacaaaaaaagaatcccacacgtgagaaatacatacaagcataccagcatggcctttctttcaggaaaatagagagaggaaaaaggtcaaagttgacaagcacaaaatattctagcaatatgattactgagttgaccaattggtgactaaaccatcacaaacgtataatcagtgttaacatagttgaatgactaactcaatatttttccctggtccaaaagatttcatttccgaaaaatagtcccaaaccaaatgctattgaactagctgatgcttgaggaacctgcatttcaaacatatagcagtagttagccatgttatgccccagcaaaactcagcaagatttaatatgctctagtagtagaagagtttgagacatttcgatggccaaataagctgtaacaagtgtaaaggagcaaaactgatgcaacatgaagtggctctacagtagtatgaactccataaatgactactccctccgtcccaaaatatagcaacctattggattagacacaacctagtaggtctaatccagtactaggttcctatattttgggacggagggagtatgcaattaggatcaccaaacaaatgaacagaagcaactcaaaacttattagaagcatacatgcttgtcttgaagcatcacacaagactttaaccatcttagttgttatattgaccacatgtgacagtaataaattgagcttcttttaaaggctatatattcttacttctttacttttcagttgagtatgaacagagcaaagccaatgattaataaatatgctgaactgacactattaaaatatgatgtgtgtgcaactgagttcacctgagttgctcttattgagtatgcatcatggagatatccttcatcttacacgtgcataagcatgaggcaccacttgctgatttacatcttcttgatcttcagacaatccatagcctctttggttccaggcagcaccatgtgagggttggcttggggaagccccatattcaggcggtgccccttgatttccaaaccctacttgtcctcgacgagcgttaaaactgttctgaccttgcagagcatgatttccaggagcctgagcatcaaatccctgctgtcgaggctgtgtgtgaaatcttggctcaccctggggagacccaaaacgattatgctgatctactgcttgaccatactctggtctgttctgatagtgaaaaccaggtaatggtggtggtgcttgaggagcaccaaactgtgcctgcggtggctgagtggagccaacagcatgctgcgatgactgaggtccaccataactaggctgttgcacttgtggagcattgaaccctgtatgccatggatgagatgtgccatacccaggctgctgagtctgaggagcactatgcattggttgtggtggttgagggtgaccaaaaccaggctgcatcggtggacccgagctataatcagtttgttgcacttgaccaatgccaactgattgttgccatggacgaggagaacccatcccatggtgtgttccttgagttgcatgaactccagaatgctgccatgtattgggagtactgacatttggaggttgagtcatggagacaaccccaggttgtcgtggatcaggggcgctaggtccatgctgcaacgggcggccaccaaactctgatttatcaacttgagggcctccaaacacaggttgctgaggtctcaaaggcatcccctgaggctgtatcgcttgggatccaccaacgccaggatgaagtggttgagaaccatatgtcggttggccttggtgaggcatgtagctaccccgtgtctgattggatgcaaatcctggcagcccctgaggtgaattgcgagggcgatactctggccttggctgaggaggcaatggcactggtttctcttcaaaagctttctcaatctcttcctgccggccagcgttcttaaaaatgtcaataacagaatcccggaactcaggaggaggagtgacaccgccttttgccatgtcactcaccaactcccgtgctttatccaagtccccttccttacacaatgcattaaccagggtctcaaaggtggttgtgtttggcttgatctccttgtcaggcatccttccatataccttcaaggcatcatccatccggccagcttctgtaagcccttcaaacatccgattgaagaaaccaatattgaacttcgggccatgctcccttccgtctgccatcttatagaaatactgaattgtatcatccacgcggcccaccttgaagcatgaatcaaccaggtaagtgtaggtgtacacgtctggaagcaccgacttggtttccatttcctcaaaaagcttctctgcctcttcaagcattccattctcacaaagcttcccgatgatgttgttgaagcagccaacgtccatctggacgttcttcctgggctgccggtggaacacctcaattgcctcatggaatttgcacttcttgaagcactgattgaccatgacattgtaggactcgctgttgatgccaatgaagctcggcggggtgtggttgtcgatcatggtctcccagaggtcattcgcctccttgtccttatcatgcttgaagagcgtctcaagcagcacattgcaggtggcgggggtcatcctgaacttcttgtccaatagcgactggtaattctccatggcctccttgtccattcctttcttccagtacccctccatgaaggaggtgtgcacgacaccatcgtagaccaagcacctcccctggagctcctcaaagagctcgaatgccttgtcccagttatcttcctcgatgtaaccggcgatgagattattgtacacgagggagtcggcgccctggccgcggttgagcatctcgcgcaagagatcgagggcgtcctggatgcggccggcggcgacgaggcccttggtgaggtggcggtaggtgacggcggagggcgagaagggggccttgtcgagcatctcgcggtacacctgcagcgcggagtcgacgcgggcggcctcgcagtgggcgaggatgagggtgttgtccgagacgacgttggggacgatgttggatcggctgaagaagaagtcgaagagggagacggcgtcgtcgtggcgccccgcgcggaccatggacgccgccacggcgttgcaggtgaagacggtggggcggacgcgggaggtgaccgcggcgcgtgcagcgacggaggcgccgtcgaggtcgccggatcggatgagggactggacgcggttatggaggctgaggcgcgggccgacgagcgcggaggtggtgtccgggaggcgcggtgcgttggggtcgcgcggcgggggcggggcggaagggtcgcggcggagcgcgtggagcggcggctcgatgcggagcctccgcttgcgcctccgccgctcggccgcggcctcctcggcggaggagaaggcgaagccacgggcgtggggtgcgagcggcgcgtggggagggaggaggtggtgcgtggcggaagcggcggcggcgggggaggcggtggaggaggaggaggaggagagggaggggtgcgggtggagggtggagaggcggcggaggaggaggagacgacggtagagcgccatggcgtcgcggtggggggcggcgacggcgggagacgaagtttgtggcggtggtgagggaggcggcggcgatcttcaacaagaggaagaaaaagaaaaaaccctcttattctgtagctagggtttagtgggtgttactgtatgaatgtatgatccattttccatctcccggtgtgagcctcctctatatcggccagcaacgattcgttgggccgtcaagttgggccagtgctacagtttcctactccctctgtacaaaacaaaaacaaaaaaaggaaaacgtacacccaaggtccctcaacttgtcattgtgttacaaaatcatcccccaaccgcaaaaccagataccggacgtcctcaactaacaaaaccagatccttcggtggtttttgaccccggttttatcctagtggcggctgaggcagcgtgagccccatatgttagtgtgaacacatcatcctcctctctcttttcctctcttctctcccctcctcatctctctctccattctcttgtacgccggccgagcaaggcaggagaggcgtcaggcgtctgcagccggcgatgggcgacacgacagcgatgatggcggtgacaggcgacgcggcagcagtgggaggagccgttgcgggagggcggcgagggaggggcggtgtgctggcggcgggggaaggagcggcacgcgggctcccccaccggccgccgcccatgaggcccacaacgcggcggctggggaaggagctgcgggcgggcggcgggggaggagcggcgggcggccgacggaggagcagcgcgcgggcggcgggaaaggaggaaggcgcgccaaccacacgccgacaccaacgaccaccatgcccgccgccacctccatcgcctccaccactaccgcctactggctcgcgcgagcacccggcaatcgtctccttccggtggagcctcacggggctgtggttctccacctgggccttcctcctcggcttcctcgcctccaacatcgcgctcttcctcaccctcctgcgcgtcgccggaggccgctcccactagggcccatgcccgcggcacacgcgctcctgatggccaccgtctcctccgtcatcttcgctggcatgctgctctctacgctcaccgagatacgtgacacacggtggtcgtggcgcggctggagccgcaccacgccgttccgctggctcctctgcttcccgccggggacacgctcctccggctacatcttcttctagtcctacgcacactacctctcccgctaactccacgccgcacgggggatcttcatcgtgctgcggcgccgctgtggcggcgccgcgagggtgttcgcgcatgcggcctccgtcgccatggccttcctctggcgacggcggagacggagacggccgctccccatccgcagccgcgctcagttgccgccgctgccaccgcctctccgccaccgcgcgacgggggcggcgacaggaggagcgggcgtcgtggcaagcgagcgcgcgggaagaagctgggcggcggctgcgccggccccgtgctcagcacaacatcctcctcgtcgccatcctccgtgctcatccgcgcatcggcctcgcgtgtgcaacaccgaggactatgggcgccaccgcgcccgggcaacttcatcgcgggcgtggacgcagctagttgtagccggggaagagccacctagtgtcgaagcagcgacaccgacatcctcccttctcctccgtcgccgcccccgttgcctccgccgacggctgcggccaccagtgcgacgccgccctcctttcccgcctcgccccagcgacctcctccccaccttccagccaccctgcagagaggagaaaagtgagatagagatagaggaggaagagagaaaagaggggagggagatgagctggcattctgaattacgaaagactaggcaaaaactacaattacaacggcactccaactaacctaagctaccatgatgacgaaacacaggatagccaagcccaaaactcagcaaacgccgttcatatgaacaagtaaaaggttgaaagaaaacaagacccccacacattggcaaagacgtgacgttatcgatatcacaccacaagaccgggctactccgacttcgccaagaaacactagggcaacgacggcaacctagcctgcgtcaaagcacaactcaacaaggctcatgtcatcgttggtatacatcatgcattcatgcttgctgacaccgtagctctgacttcattagcatcagtctcgttcatacatggtcgagccagactgacatgcctcgctgataaaaaaggcttgctactccactctagagtgaaacgcggctgatgatgtccaactcgggtcatcgttaccaagctcacaaacacgcagcaactttgactttccaagaaaacaatagtaaaaatctgcctagaaccaaaaatagcttcgactcaccgtggccaccttcgggttcgccgcatcgagctgcaccctggttgcccctccactgtcgccaaccaccaccggaaccccatcctcttcgcgtgaggtgagcaccacccatggtgagcaattaaagagagggctaacagggtggtaaaaattacatttattaccgataaaagtttgtcgagatttcttcaagaaaaaagagatataacgaacaatcaattaaaaatagaaaatgtcttactttaattttaatttgtttcgttagaactattttcgaaacaaactattttctagttgtttttattgtctataaaatgacatgatagtactatagtaggtatttcgtggacagagatagcaagtacaagacacttagctcgtactgccgctaattaacatgccatttaagtcattattagtagtgaaacggtaattaacccatgaacactccatagaaaagccccgcaaaaaagaaaaaaaaatactccttagaaaaaggtgtagaggtgacgggctttcctaccaaaacttagccctacggccctaccaatgttttggtagttaaaatagtacttgtgcttggtttggatcgaaaccaatttattgataatacccatgctagatttgatatcaatttatgttagctttatatagcaaatcaaatataatcttaccctataaaaaaagttgatagtgccaaaatttacatactcaagttttggcactgttaaagaatctatctattatattatattattaaaggaatagaaaaatgagcctccacgttcgctctcatggcctagaaattctcacattaatcggagaaaaagaaaaagcagagtccatatagaaatacaatttagaaatagctgaaattcggaattaaaaaataaggaatattagaagaggagactagagtccatatagaaatacaatttagaaatagttgaaatttgtaatttaaaaataaggaatattagaagaggagactagagtccatatagaaatacagttaggaaataactgaaattcggaattaaaaataaggaatattagaagtagagtatagagcccatatagaaatacaattaggaaaataacagaaattcggaattaaaaataagaaatattagaaatagagtatagagtccatatagaaatacaattaagaaaaaaaaatagaaattcggaattaaaaaataaggaatattaaaagtagagtatagagtccatataggaatttaaaactaactaaaattcgaaataaacataataaaataagaattagagttttgagtccatataaaaatacaatttacaaataactaaaattcgaaattaagaaaaacatggaaagaagagtttaaagtcaatataggaatacaatttagaagtaactgaaattaaaaattaaaaattaaagaatattgagaattgagagatgagtttagagtccacatagaaatacaattagaaataataaaaattcagaaataaaaataaataatattggaagaagagcctagagtctatatagaaatacaatttacagaaaattcggaataaaaaaaaagcaaaattaaaccatataggaatatatataatttacaaataactaaattttaatattaaaaataattaataactaacgcgtatataaaatagaatatgaatattacgtttcgttaagttattgcaaaatttaaaattatgatgttattctaatatatttgaataatataaggagaaaacataagaaaatatagactgcgcgggccaacatgctatttggtcgactgtcagcattttgcccttgacgctcatgcatcccagccgtccacgtcccggaggaataacacaccctccagccttctcctcctcaatccaccgacgccgccgccgccgccggctacttctccggctactccccatcgcatgttccgatagtccaagagcggcggcaacgacggctggcttctccagcgaatccattcagctccggctggcctcgacctgaccctgcccccggcggcatcctcgaccggatccgtctagcggcgacctccgcaatggcggcggcggctcgctgccccggtgaccatcgcgggggtgggcttctcccacgacgacggcggccgcggcagcagcagcacacagcgagcagccggagccgggcaacctgccgccattgtcaaggccgacaggtaataaacaggtatgcgcagcctggttacagtattttacgcccttctgaattttgctgcgaaagtaactgagattatcgatgatatgaacatgtacatcactagagaatattgcgggtcccgtgattagcgacattgctgtgtgcaacgtttgttccttttaggtattattacgttcctttcatgtatctttggacgctgtcgattagtccagtgactcctatcccaattcctcttgccacacaccacttatccgctgcagcaacctcgcaatcccctcggcgctcgctggttccagccaagctgcttccgtcctccttcacttcatctgtgcaacagggtaaagcttccagatcttgctttgctgtttttttttattagttcatatccatcttattctactacaaaaatacttgatctgtctccggtgccgttcactgatttcgttttttctttgttgttgtttctcgatgattttaggttattcatccggccctggtggttttgccgtctgcaaacacctgtcttccattcgcatttcagaagaaaaagaaacacacacacaaaaaaactactcgtcagagttttcttcctaatttcccatccaaaaccagtagttttcattgaaaacaaaatcatttgttgttgtactgtccccgtattttgttcgtagcaattcccatccaaaaaacaaaatcatcctagctttttactttcaccttgttcccatcggtccttgtttagatcttcctagtctaagtttaccaacatttctccatcttcacatccaatatctctgtacctaccaaaattacaaagagagagaacagggagacagcaaattcaatccgatggcggaagtggcattggctagcttacgattggcagcatcaccgatcctgaacaagctcctcgctgacgcttcaacataccttggagtggacatggcgagtgagctccgtgaactggagaccagcatcatgccgcagttcgagctgttgattgaagaagctgagaagggcaaccacagggccaagctggacaaatggatacgggagctcaaagaagccttgtacaatgccgaggacctgctggatgagcatgagtacgacatcctcaagcgcaaggtgaagaacggaggcgaggatccttctccagatctagagcatgcctcctccatcggttccatcattaagaaacctatgcgcgcagcatcaagcagcttgtccaatctgcgaccgaagaacataaagcttgtacgccagctgaaggagctcaaggccatcctagcgaaagcaagggacttccgtgaaatgcttggcttaccggctggtagcagtgtagagggggcacaaactggacatacaaaaacagtggtcgttactgcagcgacatcaaccccaccaccaaaggtgtttggtcgcgacgcggaccgcgatcgcattgttgatcttcttacccaacacaagacttgtgctgaggctagccgtttcgttgtctccattgttggacctggaggcatggggaaatccaccttggctcagtatgtttacaatgacaagacgatacaagaacattttgacgtcacgatgtgggtttgcatctcacgcaaacttgatgtccatcgtcatacaagggagatcatcgagtctgcaacaaaagagaagtgtcaaagggttggtaatatggacgttctccagtacaaactaaaagaaatactgcagaaaaaagagaaagtcctgcttgtgttggacgacatttggttcgataaatcccaggacgttgaggaatgggacctgctacttgctcccatactatcttctcagaatggggcaaccaaagttctggtaacttctcgatctaagacacttccacctgctcttttctctgaagatgtcattgatttggaaaatatgaaagatactgagttccaggcactcttcaaacaccatgctttctctggagccacaattcgagacctccagatgtgtggctggttcgaagagcatgcagtgaagattactgaaaggcttggaagatctcctttggcagcaaaagttgtaggttccaacttgaaaagggtgatgaatatcgatgattggaaaggtgctctcactataaagatagacaatttaagtgaacctaagagagctctgttgtggagttatcagaaattagatccatgtcttcagagatgctttctgtattgcagtttatttccaaaaggttacaaatacataattgacgagttggttcacctttgggttgcagagggatttattgatgcacgtgatacgaataaaagaatggaagataccggcatggattacttcaaagagatggtctctggatcctttttccaaccattttctgaaagatttgatagtacggtgtacattatgcatgacctccttcatgatttggcagagtcactctctagagaagactgcttcagattagaagatgacaaggtgagagaaataccatgcactgttcggcatttatctgttcgtgttgagagtattatacaacataagccaagtgtctgcaagctacaacatttgcgaactcttatctgcattgacccactagtggatgttgggagcaatattttcgagcaggtagtattgaatctgaagaagttacaagtactttatttgtcgttttacaacactagaaagttgccagaatcatcggtcagctaaagcatcttcggtatttgaacatcaagaagacattgatttctgaactaccaaaatcattatgcgatctttaccatttagagttactttatttgcgtccgaaatcgaggttacctgacaaactctgcaatttatgtaagttacgacatcttcaaatgtactctgatggattggagctgtcacggattcctgacataggccggctaactttgcttcaacgtattgatagttttcacgtcctaaaacagaagggacatgagttgcgacagctcaggaacatcaacgaaattggtgggtatttatcgctcagaaatcttgagaatgtgattggcaaggatgaagctttagagtcgaagctgtatcagaaaagtcgtcttgaaggattgacgcttgagtggaatgatgcgaataacatgaatccagagaattgtttacatgttgagattcttgaagccctcgtgccaccaccacagttggagcacttatcaattagaggttacaaatcgactacctatccaagctggttactcgagggttcccagcttgagaatctagaatcctttgctctttataactgcagcgctttagaaaggctaccatccaataccaagctctttaggcgttgccgtgaattgagccttaagaatctcccgaatatgaaggaactatcatttcttccagcaggtctcacaacgttgtcaattcgtaggtgcccactgcttctcttcgttaccaatgatgaactggagtatcatgatcatagtgagcatatccactaggacagagcaactggttgcacaatttgctttggttggggtgatgggcccatttttagatgcactgtcatcggatcattcatctatgaagcagttggcagcattgatggactctgatatatcaaaaaatcttcaaaccattgaacgcgctctagaaagagaagatgaagtagtgatgaccaaggatgtcatcaaggcatggatgcgttgccacgagcagaggatgagctcatttatgcaaggaggattgggctaccattggtcccaccgtcaggacttagtgatctctccctta

SEQ ID NO: 71078 - DNA, 5939 bp, Oryza sativa
tgcttagagagaggagatatgagttgtccatgtacttatattatcgatagaattaactattcctattatgtaacggtacgagttctctacgaaatcaaataatataattaattgtataattaacaaattaatgaaatattatacaagtttgtctataaattatctaaataatgtgacatggaaaacttatacagtcaactgttatttaaataactagtcttatatatacgcatatattataatttgtctctcgcactactatgcaaatttttttcacatacaggtgtatggcttgcctctaacaaaatacctatcaaaaccatttttcataagcaagtgcttaagacacatgcaagtagaagatatgtttttggcagaaaagaaatgattctcatagatgtcgattggtgatatgggcccgggggaatcagggccatagggaggaggctgccccacatagccacatggccctccccccgaggggggtcgggcaagaggcggggtagcggccgccctctatgtgcccgggggccgggctaccctgaccccctcaacacggtgccgcgttagacgggcgctcccagtgcccacctaaccgcatttaagacggtttgagcaagcgcaccatgctgcattaaatgcggcacgtggtgcacttgactgatctgtgaccagtcgaatgaccgatgtagccggggtagtgcgcttgcgcactggctccatgtcaggcggcgtgccgtctgacaccccctgtcacgttgtgatgatgagaggctaactgccggagacggtttgcctaacccagtcagggtagggtttccatttcccagcgtaactgaggacccaaaagtcttcattcattaaatgccgaatgacgggatggcccgcacaccctaactacataggacatttacttgtcttatgctccctccttctcaaaataaatataacttgtatgtgatatgacatatctttagtactacaaatttgaatgtctctatctagatcgtagttgtaggatgtattacattcactgttagttttgttatattctaggacggggagtacaatacaagaatttttaaagggtgctatccgtattgtggagcccactagtaggatcttattatggattaatttaatattgaccaaaaatgccatatcaatcacaatccactgttgtaggtgctatatatatactccatgtgtagatatgtactcctgttcggctcattgcatatggttggctacctaccgatcgacaaccgaaagacttgctacagtatagctagcaaaagctatgtaggaggttaggaacatgcatctagcaagctagctagctatagccctcgcagcagttgaattgtatgcgcagatgcaatggccaatgttccgaatccatccagatgcttcatccgtttttagacaagatttgacagacacatgatacgtgcgtttccaaattaaagaagtgcgcatggcatatattctgagatatctcaaaggagtgcttcagatatgtaaagctcaacacattctgaacaccatgcatccattttcttttttatatatgcatgatgatattttactactacctctgtcccataaaaattacatttctagctaatttaggataaaatagtaggattagaaaatgaccacaataaccttatttaatgaacccactgcatgcatacattccatatatacaaatgattaaaatgaagtttgagagaattaacccatataattagtatacttaataaaattacaagcattagcagtccaaattatgtgggatggaaggaaacttatatagatgaatcaattggttggaccccacatggctagaaatacaatttttgtgggataaagccttagagctagaaaagcaatttttatgggacggagggagcagtagtttagttctccatccatccattggtaaatatacgtaaacatcaaactaaatttcttgcttgaatatatatggtagaagattacatgcacttaattactaattagcatcgcgtccctgaattacatataatgcatatatacttcagatagtgagcacgcatgcgtgcaatatatatgtgcttattataattaaggcctataactatatatgttgcgtaaattaagtaggccatgtacacacactcatgcatgtgttattccgattcagatcatacatgggataattaatgctgactgctagctagctagcttgctagttcgatccatggattagcatgccgtcgctgttggatcgatcggtgtagcttaattagttaattaattactaattatttattattcgttgttttgggtgattgactggcccttgagagcctcaagctgtgccttgcccttggggccattcttcctgacgtacaccctgtactcgtcgaaggtcatcggacggtagtagagcgacggccgctccggcgtcaccagctccggcgccggcgccaccgggacgtcgcctctcgggttgtagaagagtgcgagcgagatgcgctcctcctcggcgttcacgatcacgcggtgctccacgctcttgtacatcgagttgctcaagatctgtacgtcgtccgtccatgaattccatccatgcacagtacaagaagatattagttcctgagaaattaaaatagaagaacagcttgaaacattattgatgcaactagctagctagctagagtactatagcaacgcaagctgtatatatgtgtgtattttgtacgtagctagctagctagccagatacatacgaccatattcatgcttatgctcatatatcaatgcacatgcatcatggaatattgatatatactcgtatatggattcgttggccatgcattgagtgcagttgggtacttgggcggttcgtggtatgattcgccgtaacatgcacatgtctgtccgaggtagagagtagtaagcttcaaaccgacgcacagaaaactcgtatgcatttatggagctagcgatcgatcacaatccgcgcattttctgcatggttggggctcatcaccgtccatgcatgtgtgctctcatgccgcgtaacctgcgcgaaagatcgccgcatagatcgatcgagctagccggccgccactagctagtcaactctaatttattcctgatcatcatttgactcgaacttaactaattaatcatgagtaattcttaatcccaggtcatggaaaagccacgatagtgattattgctctttgattaattaattatataagtcctacatatatgtgtacctcaatctggtcgccgacgttgacgatgaaggcgtcggggaggggctgcacggtgacccagtggccgtcacggcggcgtacctggaggccgcgaacgtggtcgtcggcgaggaggacggtgaggatgccgggatcggagtgggcggagaggcccagcgtgaggtccggctgcgggcaccgcgggtagtagttggcgcgcaggcccgcgccgcagtccgccccaccgaacgcctcctggaaccgcgtctcgtccagccccaggctcgctgacagcaacctcatcagccgctcgcacagcttgatcacctctctcccgtactcctcggacacctccctgcacgcagtaataattagttgattaataagctgcttaggttaatttcagttggcatacttataatgcgctaaacctaatatggcacgtactacgtactcagtagacacgactaccaatataatataatcttttagtttgtccataaatataaaagttttatcatcctaagacatatatagctacttagtttatttttcccctatgaacttttgcactagtttatttattcatatcacattttatactatagtttgttctttcgttactcgtttatgtgttttttctttaaaaaaatattatccattatatttatgaacggaggtagtaagttgagaagataataaaaaaatatgaggcaacatctacataatggttgtgcgacggttctatattgtggttgtacaaccatagcagctgcagctgccatcaatatagatcttctttatatttttactgtatcagtgggctgcaaattagcgatattgaacatatccataaactacaaggaagaaagaaaaggtggtagtggatatgttgagaagaaatgtataaaataataattgtgattgtgaacgtttagctgataatatatgttgtggagaaaataaaagaaagtcgtcaccctattaattgaactatctctaaaccacacaaaatggaaagtgactatagtactagaaattttacagtgcccgccctagtaagctgggaaattttgttttagcggtgaagtgagactgggccggtcaagagtgaggactaggacattttacatatgtacagtggatgcattcttgtgtcttgcatgctttggactagtatgcatcacactcttgctagctggatggaacttttgcatgaaagcacccttcacctacttttcgttgcatgcacgtgttggatttcatgaactgagaaattaaggtgagtcagatgaacgtacccctgtcccttttctacaacaattttcatgctgctaataagttttagatcggcctactctacctatatgtatgtattacgtctacccatgccaaacacagtcaagacacacctatataaatagcaagtactgcatcttctactacagtgcaagtagagaaaaaggtacaacaatcatagaacgaaaaggaaatcaacggatgctccaggcagttaagttactctgttcatgacaatcagtacactgttctcaggtaaaagctgaccgaatggatgttgatttatgtatgcagtacgatagtaaattaaatatgtactgtaccgttagttttttagcgtgtgaactgttcaattttgtcatatttttaattaatgaatgccatgcttctaattaattttggcgtgtggagtagtacttattattagtacatcactaatcaaagatgccattattaatgttctaatagataaataaatgaataatatctaaaccctaatgaaactaaaggtatgtttggtttgtcgaaaaaaaagtgacggaattttggccaaacaagctcctatatatatatatatatatatcatcacgaccacaccggtataaaaagttgatagggttgatctggtaagatttattagcaaaaaataaatgtgccctaaattttgttagaatcagtgtataatgaacgtatacacagaacatatatatatggagcaaaatgaacgttctcgccttaccaaacaatttaaattacggcaggccgtacactaatttaaataattctgagatgcacattatggaaatttataaattcagtgtaacagtcaaatatatatgcacgatttgatcagtactcccacccttttgaaaaagaaattcgacgtaccaagaacgcacaagaacctctgcaggtaaaacatgcatgcacatgggcaaagctaaatgagaaatatctctcgaaggaaaaaaggcgaatatgcaggtacagtacttgcaaagagatcgaggtgatctaagctagtgcttacttgcagatgccgggattggccggccagtatttggccgggctcttggcggcgtccggcgagaggacgaggaagtagtagtctccccagtcgaggatggcgcccttctcgacgccaagccggctgccgtacccctcgtacgtccgcggcgagttggcgtacttctgcttctcctggagcggcaggcggaagaagccgtgccacgcctcccgcgccgcgcgcatcagctccggccgcaccccgtggtttaccacctggaagaagccccagccccggcacgccgccgccacggcctccgcgagctggccgccctcgtcgtcgccgccgttgccgaggtcgaccaccggaatgctggcgcc

SEQ ID NO: 71079 - DNA, 991 bp, Oryza sativa
acccgatattaataatatagtaagcaactattgtataaattagctattacattagttatagatgatttggagccagtagttagctaatactattaaacttgctctcacgcagatctggaccgcactctccaccctccctcgtggcccgtgcgcgcgcgcgcgcgcgcgtgcgtagcgtacggcgcatttcctcggcaccttccccaacttggccctgtacgacgttgttgactgcctgcggttacggtatggacgcgggtgccgagctgcctgtgggttggtgggtgggggtgggtcgctcgtatcgatcttgtcctcgattttatttggggggttaacttgccccgacgatgcgtgcgcggtgcgccccgcctgcctctctcgcccaagtggcctccgcctagttggcacgcggccggcgcgggagcccatggacgggccatgcccatgccatgcatgcgccaccccaacccaagggccagttgggagtgatttccttttggacattttgacttgacctgtgtgggcaaggttcagttaatcagttcgatttcttcgcacgtatttcgcgtgcatgtggatacatatatacgttcctgcgcaggacttttctttgccgaaatcttacatggttttatcgtttttattaccggtttgtttcgatttgcaaggtgcggctttagttgtgcatgctagaaaacgagtgtacagggcgaaacttcagcttcattgagaattgggatgacgccatgggattctttggccaagtgcgtaacgtaagtgatgatatgcacatgcatggatgtggtcagctcgatcgaagcaagaagccagcgtcgggtcatctggtcgctagttttgtttgcactttgcacacggcttcatcattgtctcgtggccttcgttttctattatactcataaatgggatgagtttcctgttcggttgatgatcatgttctgttttcagcgatcgtgttctcttccgttcc

SEQ ID NO: 71080 - DNA, 6486 bp, Oryza sativa
tcagcttaagcagcagttgagttttgcgcatcagtattcaatggtccaatatctccaaactcaaaggtatcatcaacagaactctcagggaaaggctctatgctataaccttccttcagatatttgtcgctactgtttttcatattcttttcaatgctatcatccagtttggcattgtctgtgatatcgtgtacaagtccaggacctaaagacaacaaacatttacagtaaacctaatgaagcaagcagcaaatgatctttatacaggataagaagatgactggaattaaattgcaaattcacacaaacgttggtaaacaaacaacagttcagcaagactgataataaaataggtttggcctttctttgttaaaaaatgtctcctcaaatgtgcatttttaaatccagattcatttcatttctgtagtgttaccaaaaccaagttacatattatattgaagagcagaagaaaattttcaattcttctaatatacagagaaaacccatgtgaagcataatcgtataacagcagtaatgtttctggaagaggttaccactaaaatgcaccatttttttttagctctgtgcatatttaacagcaaatttcagtttacaacagtaacaaaacatctctcattcagcattgtctgcaccactcatacacaattcaagttgaattggatcccaacaccaattatagttgaaatttgaattggaccaccatttccacaaacacaattcaattctttttttttttgggataactacacaattcaattctggcatccaaacggtgcctaacagtatccaaactctttaatgctgtaattcaaccctgttctcccacttcaataaataaattcataatatcttcatcggagcaaagagggttaatgttgaaaattagtacaaatactgtatttagtggagtactaatattgaagggtgaaatcaagcagaaagtttaagatttcagaagtacttacttgtaaaagcatctgcatcaaccctagtaccaaatgaactgagcatttgaagctccttctccactacactcagctccgatcgctcatctccttccccagaatctcttggcaaatgacactcaagcacaacatccgcagggtgcttcaactgaaacccatccatgccacactcatcaagtatctctgtctggtcatcaatgatctggtacctcccatagacagtggagctagaatccttcaccacctctagccccccgttcttcagtccctcaccacagcatccgcagagcggtgatgaacatgtgtacacctcagcacatccctcacagccgtcattgccaacatgttcatgacggtggtcatcaccggcactaagcactcccatctctatcctccctgagccatcgtggacaccaagaacaaacttgtcctcctctttgtcttctccattgtcgtcgtccagctccgacttgctatggaagagatggtcgtcgtaaagccaaccttcttggaaaaagaagtcggtggcgtcgtactgacgcgctgtgccaaactccatctccgatgacgacgtgtccgagtgccgcggcgaccagactccatatggattcagcatccctaatctcacaaacaaaatatatcaaatttaggaccaaaatcgtgacttaaacacccacaaatccgcaaattagaacactcaactatactgagaaatcagaatttaacgacaagcagtatcattggtgtacaaaacccaggggaaggggtttaaccagcaccctactagatcaaaagatcacaattttcctccatgaacatatgcacagagatatgctggctttgatccagcaggttcgaattggacccaaagccaaccatagccgccaaaaacatcggcgcacagatcgagatttcgcgcgacataactgacgacctcggaaaacgagaagatatgggtttaacgctgagagatgatgaaaaaaaaaaattcagccttgtgccctgatcccctaactacctgagggcgaggagcgcatgctgacgaaggcagaggacgacgccgagtcagagctggagccagggcttgcaggcggcgccgccggcgccccaccgcctccggacgtggacgccggcaaccggaggggcgggagctggggatctaatgcggcatcggaatcggagccggcgtccccggcggcggacgcggcgcgggcgaggacgtcgtcgcggagcgcggaggcggcgcccgcgaacccgtggtcggtgaggaacgccatgacctcgtccaggcccggcgccgccatgcggttggcggcccctctcaagcgcgtggcgcgccgcgtgaggtaagctgttgcgtcggcattgggacttggaagcgaagcgaggcgaaggcgagaggcgagaagccttccttggtctgcgctgcgagtgacggagggaggacgagagcgaggactggaaggaagcttggaagaagcacaaaagaagtcagaagaaagagagagagagagaagagaaaagcatatgcgcacaaaaactttccgttgattgcgctcagaccctccagtaactctgatattacattttacggcttcgagattttcttctttccaaatacaaacagtccagtcgatgtctcgtgttctcaaaaaaaaaaaaaaaaaaaaaaaaaacagaggagagtcgatgtctcgttgacacgtataggtcataatggaatcttgaattataaactgcgtctatatcaagcggtagatcttaggtccaaccgtggaagagatcagaacctatgacaaccgttgcttgtgtttaaaaggacacaagttgctcaaatcgaattgttgacgactaatgtatttggatttcggagttttgaaacacatgctataatgaacttaaccattgtagtagtactatagtactagtacttctttatgttcaacatggtacttagaaattcttacttcttactagggtgcaatttaggtctgtttagaacggggaaaaataactttctcctgcaaaaactgaactggctgtggcaaattaatgtgaatccttgattttttaagattgttttttaatcttttaaaatttaaaaataaagccctaaaagcttatgaaatttgaacatttttccacgcaacttaaactagtgtgcaatgacaatattgtcacaccagtaaaaagtgatggcatgacaaaaattttaacgtggcagataatgttatcacaccaacggctcatggtgtggtaatattgtcttgccatgccattctaacttgtcatttagtaagttttggatgtatcttccttttttttctactcatagaataggcaaatcaatgggctgatatgcatctctgactactgatggcgtgataatattgttctgccacaccattataacttgtcatttcaataagttttggatgaaccctccttttttctatgatcagaatatataaagagtgggattcatggcatgacaatattgcccggtcacaccaatctaacttgacaataacttcttgtttcggcaagttttggatgaacctttccttgtctctgcgagcgaaatagataaccaaggagctaatatgtgtctttaccaatagttcatgacgtgataatattatctgccacaccaatttaagtcgccttaccttctctctctcttttttctctacaagcggaatagggcaaaccgaggagctaatatacataaccatttttgttttttttttccacgggcagaataggataaccgagggctggtatgcatgttttgccccctaatataacatgtacgccgtgttaaggtctgtggcccttggggagctagggatgtgcctcccttttggggttttttggctccagaaggagggaaaaagcgcgaggagccgtgggtcctctcccggtgggcctctcgctgtaacctgcagaccgaggcagggcagagagcagagccaactgatgtggagacccctcccggacgccacatggcggggccgccccccatcctcggagccgctgcccgtgttgcttgcaccgctctcctcgcctcgctgccgtcgcttcccgcgccgtgccggtgctccgatctcatccaccaccacaacggcatcacccctcctgctcgcgtccaccgtggtcgggcggatggcgcgaaaattattaaccggctcggtgtccaccccaccccattcaccgctcgccagtgaaggctggacccgggcgcccgtccgtccccacctctgccgcccgttgcaccgcaccaccaacccaccccacccaacccaacccggggcgcgtcgcctcgccaccttttccgcgatttgctcgcggtggccatcgagaaatcgcgtgccaccccgcgcgcgcgcggagccgcggggtgggctgatgcatgcatggcgtgagcgccccgcgcgacgggtttggactttggactgtgacgcggccgatggcgagtgggacggggaatcgccaggtcggtactcggtaggtaggtgagccgggtgcagcattggtttctgctgccaccgcgcgcacctagcccaggccgtggggatgtccccgtcccctttgtcttcaaggccgtgactgccggctccggttgcctggttggtaggagtaaacgagcactccgtaccgtgcactactgcgctgcatgtatgcttcctgctggttttatatacaagttgctcctaaatatgcggtactggcatgatgatgattatatagtgctggtacttgttttcttcccaagagatgccgatgcaatttttggtttgtagcagcatatgccaactgttacgttcttgtctgcgtgatggtacgatatcactctgtgactaggattattacatggggcgtgaccacatatacagtgcaagcaagcaagcgtgggtgagctctaccgtgcagacgagtgatcataattctaatagagctctcgtctaatgatgacattagccattgctgggtggtaaagcaagaagcggatgagcaagcataatcatgacggctgaattctataggcctgtagttcatcttgggttatcaatcaaccaactttcagttcgcttagaggagtaaaattagaagcgcgtgaatatactgaataacaaccgcagtaaccaaggcctattaataaacaccggggctacaaaaacaggtcaccgaacaaagtttaattcaagaagtataatcaacacgatgatcgtcgtctcgagggtgttaggcgcaccttcttcagacaggacacccgaaagatcatcagagcccgtggtcggcggtagttgcggaaaaggtcattttcttctgatcagcgattcaggaaaagttagccctccctgatgtggatctcaatcaagcagcagaccgtgcgtcacaagattgataattgtactagaacggcactgaacgactgaagaaaacccagacaaagataaccaactctaacttaatttgatccaagaaaaggttggtgatatgcctaatgactaattgagcaataacaatgggcgcaccattgattattccaggctatttaagcgattcacatttcgcgctcgctgtcactaggagtgttacctgcctaaggggcagtgagcagtgaagagagaggactgtgctgcacagttattcatgcacagtctgtgcatgaataacttcatcttaaaaagttcgtaggcaatcaataatgtaatgtgatccggaacttttgcttaatcagtgtgcctacctttatgtcatctaagtaccttttggtggcaaaagataatctattcccgagtgcatgaaaatgtgaaccgatattaacttggtcccgaatcatatcatctctttgcagtacgtaggttcacgatcttaggttctcgagccatcagacagcacgggactcttgctgagagaggaagtgcaccttttggtggctcaaattaaacattacttgaccagccgatgcctattcctctcatttttttctgccggtttatcaagttaatttggtgaggttttggttggtttcgaagggaaatccggggtggcgtgatgtgtaatctactccttttgcttattgcacggctcatgtcgctttaggtcctgtttatttggagaggacaaaagacagagatagagagagaactgaaagagcagaaaagtatgcaaaataaatgtatgtaagttacaccgaaactagtatcttttttacattcgcctcctgatgttgatgtcttctacttttactttatgatgatgtcgtttttattctttatttttatgatttaaaatagacaactaaagccaaaaaaggttcaaatgtcatcctcctcgctatatcattgggcttgtagagacaaacgtgggccaatgctgccctggtcggtacaccctttctcttttggtaaaaaataaattagttttattattttacattacagtcccatgttaatattagtagtagctcataatttaagtagataaagcattt

SEQ ID NO: 71081 - DNA, 655 bp, Oryza sativa
ctattggtgtagctaggaatttttcttggctagtccgacttcaatagttcaaatcacttaccaaattttttaaacacggcaaatctcatatacaagtacaaatttgaataaaaggcgacacataaataacaatagtatcttataacatcaatagccgactaatttaacaagcaagttcaaaatgagcaaatattacaataggtcaataccaatccccaatcctctttatgtttcacccaataagctaattccaatcctacaataacagcagcgatttattcccattcagccattcacaaatcacaaattggcaacctaagctatgagctaactaattagccatgacaataagcagtgaggcaaaattattgagttacgtcacagagtcactgaccttcagtgttgtccaatcgccaatcggagtcggaggtggagcgccgcagcggggagccggagtttggagacctgccacgaaggattggaggagactggagaagacgagacgggcaggggggccaggcggccgcggcggtcggcggctggctgagccctcaggcactcggcgcctctgcgcgactgcggctgcgcgtctcggcgtccgtcgatctgcgccgatgcggtggctggcggggcgcgagaggcgggccaggcgacc

SEQ ID NO: 71082 - DNA, 737 bp, Oryza sativa
  unsure (1)..(737): unsure at all n locations
ttgatatctactgccacccagccgcnaggagaaagggccccctgcatgtctaaatcctggctctgccactgactcgtaaatggaactgataaggttgatgggctattcagctgaatgaacaagattttgatgcgtactgcatgaatattcggatacttgttggatggtaccaactagtctttacttttaaaattacagatttatttgcttattgagagggaacagttgagtcaaaagggctgtaatgctgtatggtgtgaaaacagctgcttgctaatttatctttgcccaatatcaacattttgtcagcctgttacacaaggttggtttccggccaaaacctcaagtgttatctgaaaccatatcttatgatggctaaacccttcagttttgttttatttggtcagtaataccacatgttagaatctaatttgaggtgcaaatagtagcaggggtctctactgactatatttttttatagatattaaaatctctttaactaatttcaaagattattatgctgagatgagcattatgtacgagaatatttctatttcattggttaattgggcccctaccttttatgtccaactacccaatagttatagatggggcaccttttttcctttgatacttcagacatgaaggaaatagctgacaaggattttgaagaacctcaagatgaagataaacatggggataataataagggtgaagttggtgaccaaatgagcaat

SEQ ID NO: 71083 - DNA, 626 bp, Oryza sativa
tttttttttctgactgatatcggtacaagcagatacaacgaggagaaggataaaccctggtatcttagcctcgtagtcgtagcccacgccatttttggggagtttttcgtgatctctctctaataaacggctgtgaaatgtgaacggaacatcacgagcaggcgaaaagaagttgttctgtatgttctagaagcgtctattctcattgtcgtcacggaacgcggaacgccggccgcacgtaccgtgggctttcaggccgattcacgtcactgtttacgcgcgcaattctattgctcgcctaataagtgctgatattctctttttttttcattatctaaaaaagtgctgacattcttcttttccttgtatcggcaggattttttcctttttccctttcgagccatcgggtgcatataggggctgtttggatgcccacctcaaattaccacagttttttaccaaaggtatggcaagatgcaaattgtgtggcttaaaatttgatagccacacttagcaaactttggctaagaaaagggtctatgactagtgggatcaaaagagtagaaagtgtggcatgccaaagttatagaaacaaaccaaacactaactacatttggtcaaactaa

SEQ ID NO: 71084 - DNA, 3574 bp, Oryza sativa
aatatcccgcggaaaaattttgaggtcggaagagcgaagccgccatagaagaaatgggagaagaccacagcctcgtgtgtatcgggggtcggaaaagcctcaccgcacgctggccgccacccgatgatttccttggcagggagaacgccgtgcgccaccatctccttcaggttctcctccgtcacgtcggatggcgcccattggccttcaaagttttccttctcttccgccattgattttttccgaatgcgttgatttgattcgagggatggctagggagaggtgagggattgaggcagtggatcacgggaaggattttgatgaacttttcgaaggtggattcgagtggaatggtgaaccctagtttgccggtgcagctctgtactgtagcagggagtggggaaaatggcgagagttccggcggggaagatgaagtgtcgcttggatcttgggatttcttgttaagggtatcggaggtgcaaatgggcttaggcctgaacagtacctcagcccagtacttttgacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttagaatgacttgtttttaccatagtcatttccttggtatgttatatgcctgttttcattatggtaaatagtcaaagcctaggctattagacttattcattaccataatttttataatttttggtgggtaatctttagagttttctattcggatgcccgtcaagtgtgttcattcgtgaaccttttagagtgctaaccactcggattccttttattatggctaaaaagcagtcggctagaatgcctctttaggcgccgcgtatgcttttgtcatatgatgcacgattgtgctattattttgttctcaactatatgtttagtttgttaactaatcacatagttgggagctacacctaattaggtgcatctattcgatgcactatattctttatcttttcgccctttacagtctttgtcttcgttactcggcagatcttggcatgaaaggtttgaagcactcggattattatctttgagaaggctatgatggttgactgcaaaggtctcgggggctactgtggagattatggatatcccatatctacacgacgatggtatttggactgaatacaggataccaaatatagatagaatatcttatttgtgtctcgggtttgtttctcaacttgtacatcaaggaaataccttgagacttagtcggttacgactgtattttatctgtatctgcatatttcgttagggatatagattatcttttgtaacacggactccttcccatatataaggggggtccgggtgcctctaggggtacacatgttgattttctccaaatcatacaatcaataagacactcggcggattcatccccggacaggagtagggtattacttcttgaataagaaggcctgaacctgtataaatcctttgtctccaaacccatacacttctccagcttgatagccaccccctttttattattgccgaaatctagtttcgacagaaatttttttataattcgtatttttattgttgttagatgataaaacatgattaatattttgtgcgtgacttctctttttaatttttttcattattgttttaaataagacggacagtcaaacattgggcacggaaaccagagtttgtctttttttgggacggagggagtatatataatggattgcctgcatgtgtgtactaaaattttgtaaggcctggtttagttcccaactttttcttcaaacttctaacttttccatcacatcaaaatcttcctgtatacacaaacttccaacttttctgtcacatcgttccaattacaaataaacttccaattttggtgtgaactaaacataccttaagatcaaatctagctttcatttgtgtgaccatatgtgtgtcatatgccggatgagagcaaattcttttgcgtgttgcactggcgagagcaggcagaattgtttgtgcacacgggatcaacaataactagcatcatatccacacctgctgcgggaggacggcagcgcctacttcggcatgctatcgctcggcgcttctgcaagcgcccacttcactctctctcctattttctttctcctccatgtaggagtatgctgatgtggagcttcttatcgccaacctaattagctctattatacttgctcttagcttaagaaatggtaatatttagtatctttcagaggcatgttaggttctctttctgtaattaattcgttattagtcgcgtgctccgcgaggagaaaacccaaccaacgggatgatgacagacagtaaggagtaaggatagaagataaatatgtagattaagcgttttaggtaaaataaggtggtattaatatattattacttgagttttaattattataaacttaaaaatagattaatttgatattttagagcaactttcatatagaaagtttttgcacggaacgtactgtttagcactttgaaaaagcgtgccacgagaatctaaaattttatccaatttttgttggagaaaataacggtgcgtatagtgccgatttcttattgtttgggtgataaaaaaatagaaaaacaaattttaaattgtgtactcgaattttttcttcttgctcagatttttacacccagtactaataggcaaacacaatgttagaagttccagataaaaatgtaaggatggagcctctacaattaatctataattttgcaaaaaaaaaaaaagaagagaaagtgttaaatttgtgatactatcatacaatggcttcaatctcttttttaccgggatgaccaaagaaaggacatccaatggcattaagagagagggaataaacggttacaagaaaatttttcatcgacagttggctatcgaggaagggtatacaccagagtgcacacccgaaaccatgcgaatggcctcaatctcaggtttcgtgataattttaccaatgtacctattgacgacttccaactctgaaaattggtagatacatgatgatatgccactaaaacagaattgttcttgcaggagagcatacaggatggtgttcagagtagtagcacccatcactcaaagctgagcatggaaggctgtggagacagaaccatcatccaccttgatgacagcattgttcttcaagaagtccgagtaccatctagcagagcgcctgggctgccttgtcagttcttcgctgccaaatcgacggcaacaatgccgaaatgcgccttgtaatcgccaaacatctcgtactgatccatgaatgaccacacgcagtatcccttcacgttggcgccattcctgcgatcgatcggtcagtcattcaaaccaataagatcccagagtgagatcttgtgatttttcagtagaaaactctt

SEQ ID NO: 71085 - DNA, 2572 bp, Oryza sativa
  unsure (1)..(2572): unsure at all n locations
ataacagagaatgttcttagagtgtaatgaacactaaggaatattatatacgaaaaatggaaaagagtatcaacagccagagccactttccctccctcaccgacggaggcaagcgcggaggtcctcaccatgtcacggctgcgcggccacggcacgggcgaccggtacccggagggcacccgcaccaggcacctgggccgcggcgccacggggcagtggcgctcccggtgctccatgtggcgcctcgagcgcagcgccttgatcgccctcatgttgtcgaggcacgggatgtagtccgccgacgacacccctctccccggcctgcaagtctcccacctcaccttcgccgccggctcgtccccgccaccgccgccgtcgtcatccgccactccctccgtggcggcggcgcccttatccgcatcgagccgtggcgactcgctacttccaccaccttcccctgctgcagcgtcggcgttgacggcggcggcggtgtcgtctggtcgcgatgcggtctcttcggctttttcggttgcgtcggcgctctccccggcttcggcgccgccggcgacgaccgcgggaggcgcgagcgtcctagtagggcggtgaggcgggaggagaggacggagagggattgcgcggaggggtcgaggaagagaaaggcgagggcgaggagcgcggatacgaggaggaagagcgacagcgagaggaggaagggccgccgcttgcgctggtcggaggtgggcacggccatcgtcgctgctccctcctcctccgccgccgtgaagagatgccggagaggcggagagagatcgaagacggtggtgccgatggtggtggtggtggtggttggtcacttgttcactcggttggtcggtcggttggttgggcgggtgggaggacggagtcaggggggaagtggagcgtcgcggccacggcgggttgcgtggttggccttggccggccgncgncggcggcggcggtgacggtgacggtgggtgcaggtcgttttcgacggtggtgatgagccttcttccccttcgattttggtatagttcgttgttgcagagctagtgcgatatctgattttgttatgatttgttgcagctagtgcgatatgccggtatcccgtcgagtccttggcgggttatctgactctgacgaaacgtgattattccattctggttatcggtaatgacgcactgaggaaagcggtaatgcaactatacccgttttgccagaactcattcaaccctctcgtctacgccaatcaccgagtcaaaaaacattcacctggatttcagttacagactagtaaaaacattcacggacttcagtaacagacgtacggagaagtatacaccctccgtctaaaaaaaccgtatatatattataggacaataaatctgaacagatgtatattcagattcatgtattaagatgtgtcacacccagtactagattagttttttatgggatagtaatagaatgtgtcacatccagttctaaattagttttttatgggacggagagagtagggcttacagctacatggtattgcaccagaaaacgaaaaaaatgtagcctctccgaatcgatggagggcacatgccgatcgatgtgagagcatcgccaacaatttttcttaagtcctcctcatcttaaaattaaggaatttcattttacaaagtaattccaacagttctcctaatcgtctactcaagaattagaatttcctttcctgtaaaaatcgctatttcacaatttaagcatcacatctactcaagaagttccctttcccgtgaaaatcgctcacaagttgggcgtcacgctcgctcctaatcgatcgtgcaccggggaggatgaggcgatcgtgcgacacatcaggatgcaacaaagatttatgttagtagtttagggtgtcccatatttttatttcagggagtcaagttttaggttatgagaaccataattttaagtcctaaatgcccatcaaagaatcctgcaataagattattgaattggaatttaggggaactgtgggccatgctctgaatgcagtgataaggtagagccgtagttgtattcaagtgatacttgcttaaggtgtgaagagggagattaccattaaacttcagtaacaacacctaaacaactaaaccctgtacatgtttctgggggagaaaaaacaaccaaaattacaacagacaaaggatgaaaaactctatctgatctgtgcctgcactcgctgctgacgctggttctccttcagcttctccctgggtgacagtttgtcaccgatcagcgtgaccttccaacagtctgcttggaggatgaaaactgacccagcttttggcacaactgcaggttcaaactttgtaattaagccacaaagatatgcagataatatctatagaatcgaatgtctccatgcaaacagagattgataacaccagccgatggactgactgacaagagtatttcaggtgtctcgagcaagaagcgttcaggttgctggatggaaatttcaagtgcgtagccctcagagcaatacataagctttcataacagagca

SEQ ID NO: 71086 - DNA, 20318 bp, Oryza sativa
  unsure (1)..(20318): unsure at all n locations
cgtatgtagcagctaagaagaatccaataatcactgaagataaaaaaaaacataaaatgaggtatataggcaatgagcttgccctgtgcagcagtgcggactgccttggctgctaggtgctttaggtgttagcctcagtgagcttgctgcattttgttctaagagacttttttttttaatcttgtgccactcttcacaactctattctttcttttccataaaaaaatcacgcttctatcttttgccactattccattagtgtgcatttctctatttctatccctgtctgatcaacaaaggttggccatcaagctttccccccgaaagacaattatggcattgcatatgttccaaatgaaaagaaaaaaatactaaatgaacaatgtagagaaaggtacaatgttaatttagatggcacaattcttaatagcaatccaaacatatgtgcaaaacaggcggtaaattttagactaaggattaagtacttgaataagttacatcacagcatttaagagttatgacaaatacaactacttgtgtaaatttggcatgtttcccgctatggcatgcaaaaaattgcggttcaatgccaaagtcatactgaaaaagcttaattaatcataaaatactgaacatgaaaaggggaagatgaactaatataaagggaatacttaaagatgagaagcacctaaaagggaatccaatctaatcaagttaaaaacatgaaatagagtattgtgctaaaggcagggatgtgtcttacttaatacatcccatgttccaactggtaaaaacatgtgataagtttatatgtaaattaagtgccataatcaccactgctgtagtaaggttagtgcatttactgctaagacatagcagtttcagttctatagcgttctcccaaagtacagcacgctgaactcaacataatgtattgacacaatgaatgtacaaataacatgtctggtgcaacaaaactaaatttagccatgactatgcatcagcatttgtttcttctggattctataaatagtaagtccatacaacagacaccttagatcctaaacctagtgtaccaaatactgaacccacaatacagtcttcaggaaaccaaactactgagactgatgcaatcatagaaatggccaatattgaactagtgttctgcaaattatcagcattgaactactaaggagtgcaccaattccagcaaaatagcatcccatagcaaggggaacaaccaacattgaactacggtttggtgaaaaagacactaactccatccaaataccatagtaaaggcgctgtcatatacagtattcgattgaccacccaaaaatcctgccttcaactagaagtacaaaaactggtgatagctttttcctctatggaagaaatgcaaaatctttgcagattacacagcagaacaactgcatttagctacggcggtatccactaccaagtattccacccaaaacagaccattaggctagagatctcacgaggctgtacggaaattcagaagtgcgagtggataattgttcgaaattgggaacggatctcgattctgcagggcttaccgggcttgaagaagatggagaggccgaaatcgatggccttgagcggcgagttctccttcttgttggcgaagaggaagttctcgggcttgaggtcccggtggataacgccgtggcggtggcagagctggacgacctccacgatggtgcgggtgacattggcggcggcgcgctccgtgtagtggccccgcgcgacgatgcggtcgaagagctccccgccttcgcagagctccatgacgaggtgcacggcgccctcgtcctcgcacgcctcccgcagcgacacgatgctggcgctcttggggaggtggcgcatgatggcgacctcccggcgcacgtcctccacgtcgaccgccgtcctcagcttccgcttggagatggacttgcaggcgagcagctccttggtgtcccgatccatgcacaggtacgtcaccccgaactccccccgcccgagctcccggtccagcgcgtacttgtcgtcgatccctccgatcagctcgcacccttcctccccgagcacggggagccgcttctgccccgctcctcctcctcctccgccgccgccgcccccgccgccgcctccccccacgccgccgttccgcgcctggtggggcttcttcttcccggccgatgcggggaagtgagacgacttgacgtcctcccgcgccgcggcggccggcgagcggcagcagttccccatgctcgcgcgagatcaaggggagggagggctagggtttgtgctgcattgggcgccgcggtgggggattgggagatgggaggagaaggaattggtgaagtgaggtagaagagagagaggagatgagtagaggagcggtaaaactgtgacgagtttggtaatggtaacggtaaagggacgggagggaggcgctggggacgcgtagccggcggtagcttttagccttgggccgacgaggacgagggtgggggaacattcccacgtggcgccgtggcgtgtgcgagatttgtcgctgaccggtggggcccttacggtttttttgggtgggttctccggtgcgtttttgggctttcgcggcggtgcggtgagccggtgtggggaaggacggctaggggggggtttgactgcgctggtcgccgctccggttgtctaacggcgtgtgcgcgagagaaaaaggacggaaagggcgtccgccgtggcgccgtcttatctctaatctctcacagtctgcccggtttttttgctggattattttggtcaagtatctaaaaataagttctctcacaaaacattactacattttttctactgtatttttaagattattattattccaggctatttgttaatttattttattatataatcgtgctaataattgggttaataatctatgttcttatttgttgcttacttcttattataagccataatggcacattaatagttaaaaaataattataattaaaattttgtatatgtgtttttatcgacttaaaagttaatataaaaattacattttaaataatattaaatcaactttaaaatcaagttttagaattcaaatattaatattggcatataaatcataagccaaataatgaggctctaatcttaaacggttaagaacatcaagccatattagcagtgtgatttaacaagaaaatcactgcggcacatacgcttttcctctatgcatcttctgttttgtttcttttttgctagagacttgcctgagctccgaaaaccgatgtgtttaggattcaaccttctgaactgtccctgtcactgtttcagagaccgtcaaagatcgtgttaacgaagctgtgtagtatagtattgttgctgtctttgcagcgcctagctgcggaacaatatgccgtgattttgcgtgcgtgatgtttgtgtgtcactgtgcgattatgtctataccactcaataagtgtagtttacgctatcgttcctgtagctcgagacgttgaaatgcgaaaatgtcaacaatacgtgggccgttgcaactaccgttagaagcctctcgttaaaatttcaacgttctcttgccaaccttcaacgccatcaatggatcaaaagccaaagcctaacctacacttacacagctgtgagatggacttgttacacgtttctagcttctagccggcaataaactagtagacggtatttggatcggtaacaacggaggtcttcttcccttccatttttgaaacccttgcaaaaagcgttccagcttttaaccaatatgagcaaattcaagtgtgtgtatctgtggccggacagcgaatgcttccgaaacactcagggacaaagcggagctagctacggctgtcatcttggcttaattagccatgcttccgacggcaaggggcgacaacgactgctcgacaaaaaagcaaacctccccgtttgcttcgacattaaccatgcaacagtgagcagaatacgacctgtgaggcagccaaagcatgaaaaatgaaaaatcaccggtgaacgaagtaacgagactgtttctacgtgtggccatgtttgcccgcatgcgtcacagggttatcctcgccttcttttttttctcctcgcgggatgagccgcgggagatgagagatcgccgtcgtgcacagcgaattcgaaagcagaacatgcagctatagcaaagcgcgcggttactgtatctcatcgtgagcagtatagtatgaaacggaggggctcagcggtcacatcgggagtggattctaatccctcgaaaggatatcccctcgtatacctttttttcttttaaattcgatgcaaatagttatgaaaaaatctgaaaaaattgacaatgtagagtataatgatacctactagtctaccaaaattcaagttcaaattcgatctacacatcgaaaaaaaaagacaaatttagatataaacagtacgctactactcatatgctgaatttatcttttttatatctcggcgtgtgagttgagtttggacttaagattttgtggagttgtatatatgtgttgtatgaatattgtcaaatttttccaaaattttttataaccgtttaaatagcttttaaataaatgagggaactcccttgaaggattagaataatttccccggtcacatctgcagtgggggcgagagagattggagaagcctttgctgcgtgcagcgtgcgcaggaagcagcggtcccagtcgtccgtcccaagcaggtgacacccaaaaaccaacgactgctgacctcgctaccggaaaacggatctcggcgacagcaaagtcccccgcgccgtaccaaacctttgcctgaaaaagcaccgagctgatgctgtgctgccgctggccagggctccacctcccgccctcctttttcttcggatgccatcatctaccctgcgcccgtacaacacaacacaacaccacccttcttctccatcttctgcatgactgcatgaccgatcggcgaacctgcagcagccacaagatcggttggtttggttcatccatgcagcaacagtagcagcatgtagctgtcaatatatcttgctccgtatctcgtgttgcttctccaggagactggacgattatcgcgggtaggtgaagtagtatctagctagtctcgcgttaagaagaacgagctgaattcggtggcactcggctgtccgtctatcaggacgatcgagccggtcacatgttgaggcctaataaaagcggtgcgaagcactgtttactgccgggcggagcgcgtaaacgcccggcgatctcgcattcacacaccaacgagagccgtcgacgtcgagcggttgcagcggaattaaattcgcctgcccgaatgattggttgatcggagccgctgccactgcaggctaacgcgcacaattctgatggggcgtacttgcgcgggtgttggaacaatagatcgcgtggtggtactacttggtaaagagaacagctgtagttggtgtcctttagcatggtcgtgtagagcaacagtgcatctggcggcgccggcgacaatgatacggtgagattgcaggtaaggatggcaattattaccgattgaacatttaaggctccattcttttctacactgctggagcaagggtttttacccacggttcgtaaaacccttacagttccgattatataaccggactatgaattcggtagttccggtttaaataatcaagactaaagatgtatctttccggtcagtaacatcaaccgggactaaaaatggcccgaggatagtgccaggtcattggtccctattcgtctcttttttttcattgttatttgaatattgatttcacaccaatctcaccaaaatcataaattccaaatcgagttgctcctacataggggtgaaaacggtacggaaactttccggattccggacctattttcaaaaacggaatctgtcggtcagaatttttcagaaacagaaacgaattcgaaaatattttctcggaaacggaatcgaaaatgataagggcagtttccgttggaactcggaatcggtcggaaactttccagaaattttctcggaatttttggaaaatttctcggaatttctagaagttttgtgactgaaataccctggattctttttttaagcaataaatagtgaatactatggtgtttggctgctattttttaaaaaaatatttgttatggaaatctaaaattatataagaatatttttttcctgcattgggatttatcaacaacattactctcttaaacatagataatgtattccttaggttgtgttttgtgatgtactattgatacataacaattggacttatatgattgtgttttatgatgaattgttgaccattgagacttgaaaattggatttatcatttggaggggttttttattccgataaattttcgttaccgtatgcgcgccgattcgttttcgctccgttttcggtttcgataatattcgattccgttttcgtatccgggattttcgatccgattccgaaaataatatgaaaacaataaagatggtttctgtctgtttccgtactgttttctcccctactcctacatccccaaatcaaagtaacaacatcacaaatcataatattcacatcacaaattgtcaaaaaaatcacaaattctaaaaaaatacatcacagatcaaatataacacagatccaataaatcacaaattcttaaaaaaaagaaaaaaaaagaaaaaaaagtaagaaatctagccgccgtccgccgcctcctactgcgggctcccgccgctgcctcggctgccgcttctaccgtcgcctccccaggccggtggccgccaccgcccccgtccggttgccgccgaccgcgccccgctgccggcctcgctggccgctgctcgctggccccgccaccgtgcgtaggtcgccgccgcgccccgctcgctcctcgccggcgccgtttattcctagagaaagagaggataagactgtgatagagaggaggaggaataggaatataaggagaggataagagtgtgagagagagggggaggaataggagataaatttttttgaagattagtgcaagagattttttatttttaagtcccggttagtaacaccgaccgggattaaagatctacataaactttagtcccggttggaaacaacaatcgggactaaagttatgatctttactccttaaagatctctggggacctgacagcctctgacacgaggtgaactggaactatctttagtcccggttggtgttatcaatcgggagtaaagatcacatagtcctcttgcacttataaacgggactaaaaatgcttttggacaatcgaccaaagatggtttctccagtagtgctattaggatataaattttatttagattttcgttaacgcatttttaaattgctaaacgatatattttgtatgggaactttctataaagtgatttaaaatatcatataaatttatttttatagtttaaaataattaaaactcaattaattatgtgctaattattttttagttttacgtatccgtatttaatcttcaatgaactcaaacagtcaaacgggaccttaaatagtgagtgtaaacatgttaagattaggcatgtcaaaacctataccgaataggtaaatggacatgaataatcatgctcgctttgcctctttgcccgccaaaactaaccggcatgtgaggtatactagacactactgtttttgtatgtactacagttagtgtctaattagtatgttacacaatgataatgtcgtttttatattaaaaccatgtttgttttacctaaagatgcattgtatttgctggttaattcctaagtagttttattaagagtaaaccgtactttggacaaggtttcttacataagttgcataatggattggatcttatcgtgtgctttcactttgggtcaggtttccttttttttttcctcattggaccaggttcatcttttggttgccaccagcccaccaagctggaggactacaattgtgtctctttccgacaacccaagacatatgtacttttctatggttttgcccatgaacatatccgtgaaacatgtagcacccgtggataatgggtatgagccaaatgattatggatatgtttagatccactgataaaatttttcaccctgtcatatcatatgtttcgatatatgtatggtgtattaaatataaacgaaaaaaaataactaattacacacattacgtgtaaattacgagacaaatcttttaaatctaattgttccatgatttgacaatgtggtgctacagtaaacatttgctaatgacggattaattaggcttaataaattcgtctcgcagtttataggcggattctctaatttgtttttgttattagactatatttaatactttaaatgtgtgtccgtatatcccatgtgacacggtaaaaattttcaccactaaaactaaacgcagcctatatttatttttctatcgtttttcccatgaccatatccgtaggacatatagcaccgtggataatgggtatgagcaaatgtttataaccgttctacatagtaggtggtatatccgtggacataaatttggctgtgtttagtttcttttaaagttgaaagtttaggttaaaattggtacaatgtgactgaaaagttatatatgtatgacagattgatgtgataaaaaaagttagaagtttgaattagatctaaacacagcctttatctcgttggtacaatgtagtactacaatggtacactgcatgtttctttcaaaaaagacagtacagagggagaaattcgagacggtttgggtgtttgactatttgggctggtccatcgctccgtccggcaaggtggccctgaacggtgggcccatcatgtgtcagcccactggcatcgacggcctgccagtgccggcctgccgggctgttcgctcccggcgcgtcgaaattccttgcgtgacgtgtcccccccttccggttttcttcaatctgtggtcacgccctctggaagccgagagcccgagaaggcggagaccccgggagcagaggggagagcagcgcagccgccatggaccgcgtgcagctcgtgctcctcggcctccccatcctcctcttctgctccgacctcgtcacgctcttcgggccggagcagctgcccaccccgcagcccgacctgccgccccaccccagccccgacgcggcctccgacgccgtccagcccgacgacatcgccgccgatgccgccgcttccgcgcagattgctgtaagtccgagcttcgctgctcgatccagtgccaattttgatcttcgatctagtttgaactagacgagtcatgtgcttttccctctctgttgactcttgtgttgtaggagccgcaggtggatgggcctgcctccggcaccaccgtcgagttgaagttctgcgcctcctgctcttataggtaaaaccatgtactactcatggcttctgtcatctgtggagttgttagctggtttggtagaatcgatagtgtcgaataatggccagtgaatcacagatcaaacccgacaggtttcgtcagatttccttgtagccctagatcgcaggggttcagaactatgtatcaatagttaagaccgcgttgaccatactgatatctagagtacaagtttctattgtacggccggcctatagcttttctgttactgtaaggccccaaaatgagatccattctgaatttagatttgagttcagtgtgcaacacacgagcacctaacttatctgagctgataccatgagctcaaactccaagtgtcatcatgatgggaatggctggttgactgtaattataacacctaagtaacctgtgcagaagccagaaataggtggagtcataccttgttctagtaccgtacttcctaatactggtcgtcttctagttcttttaagaccataataaggactgatggtagttgtcttctaacattttcatatatgatctgcttcctgtgaagcatcgctgaaacttcttactgtttgccaatggtattgcacaatgggaaaaaaaagcacacacattttatttttcaaaataatatcgtattcttctgttttcatcttcttaattcaaagatacaccagcattttctgtattcactaaccaacagtcctttaatttattttttgacacaaggcttgcgccatgagttgagtttgagtgccttcatatgtttttggttatttttttgaagtgaatagcttgtgatgagaagaataccacttacatagttccactaactacttctctcttttatgcatttctagtgtctgttgggtaagaatgcagattctcagtccattcatttatattcttttagtttgtgaatgagcatgttttgctccaaacatcttggttcatcctctcaggaatgctctaactcttctctctgacctagttcacacccacttatgctcgtgggttattatagagtctggaatgctatatttctgtggacttcgctgtgttttttgctccttttttatgcccatggcatgctaggagagatgaactgagagaaagaagagttcatgctgaacatatctttgtttgactttaaatgaataaacttgtgttgatgtgatgaccatttatttcaacatgtaatggagcagaaccttctttcacatgctctagtgaaaatgccttttgttttctcttctatgaattggtttgtgagttagacagataactttaagtcgaattctgcaggggaaatgcagtcaccgtgaagaagatgctggaaacctcatttcctggtattcatgtcgttttagaaaattaccctccaccattcccaaaacgcgcactcagcaaagctgtaccttttcttcaagttggagcaatggcaactttaatggccggtgatcagattttccctaggtttggaatggttccacctccatggtactactcgctccgtgctaatagatttggaacaatggcaacaatctggctgtttggcaatttcgcccagtcatttctacaaagttctggtgcctttgaagtttactgcaatggacaattggtatgtttgttatgcatacatccttttttttgctgcagtggttcagtagtacttttgcttgtgttatgtaatgttagaatcccccccccccccaaaaaaaaaaaacagccataagatcttttttatgcaaaccagtacagcaactgttgtttactatggttataacccatggttgtttagtgccaaaatttctagttattatggtttgcttcaatgggattttctttatttatataatctctctcgaaagaaactggcattttggagccctcagtcatagctgaactgcaatgatgctagactctgtagctgaatctttgactcaaaatgatctgttgtgtggcacaatatcagttagtggtgaaaccttgaagccagagtaaagttgctgtagaagagagctatatcttgcatttatatgtgcaagttgactgtccatttatctgtctattggagttctaatcccaagaccccctagttgccatcaatttttttcagacccttgcattgctgtgtgtagtgatacacttgaatgattagattgggttcatactaaattagtaataatcagtagactagctgtttcaaaacaaagagtagcttgcatgtttcctaaaactggtttgcaattgtacttattccctttaattaaatgaactgtgcaatctttgtcctgatcacttaataatgttcaccaggcgctaggtgctagttgggtggtagaccagctcctagcaactaattggcaatttggtgggctaggtggctggcttttagaacacagttactaaactttgtttagtgtgtttgaggtgttctgtttttttttttgcaagattaatttcttacgcaatccatctgttaacttttgctttgtgtgtatgaagttctcctggtttttcttttgcgaagcttaattcattatgcgctccatgtctccatttgtacccgatacactaactcaattcaatttctttcttcaggttttctcaaaattatccgaacagagatttcccagcgagtttgagctacgggagctcattggcaacaggttaccagattctcaattcgggaaaaatctggaaaaggtttggtcatagatgttgatgtcaagagagcccacttcatttacctgctatttaattgatagaaccgcttgaaagtttacgcctaattgtcaatcacatgctatttgtcttcttcttttgtgaaggcaggtacttttctttttgttgtaaataatgttttaccctcgcaaagaaagtgaaggagttctgtggctatgttagtttgttagaactgtcatatttactcaaagaggatgtgaaccataacgccccttctcgagtattcctaattaattatcagaaataattactctgactttggattggaagtgcattttttccggatatgttctgttgccctggttaaagcgtcatttgctgtcgcaaactactagatgatgccctgtgctttctgcgggatatatgatagatattggagaaatgatgaaatgatttggtttgaaatattataaaaatgatttgagaatgatgattgagcattgtactcctatatgtttagttttaaaatgaaattaattgaaggtataattactatgcttgcatgttgaactttgtgtgcttaatgggttgatgtgatatgtttgtatgtaggttttaggagtgctaataaatactatgcttgcatgcttgagttttaggtgtttagtggacattttctttatagaaagaagagattcatttgaaactctatgactgaattgcaatgattcagctatagctagctcttttttttttttgaaagtacaaacaaataaagattcagacatatggtggtgttattaatctcaatcctattggaaatgatattgatcctgatatttgcaacaaaaaaaaaactgattctaagatagtcctcgtggcctctcctcgaattcatcagattcctgattctaagatgagccccttgatcgccggagagcgacctcggcagcgtcggtcagatcccctccccgcctgcgggcgtagaaaggtatgggtccgttgccggcgtccgggaggagtaccagggatcaaactctggccagtggcctgctcctgggctcctggcgctccctctcagctgcaggcgtttcatcattctcagcaaccgagatgagatgaggttatctcatggtctagtggcacttgcagatgtttacagaagtaccagagttcaggccatcatatgagttctcaaaaaaaaagggggccatcatatgcagttaaactattctctccatttcgtattacatgatgttttgatttttttaaaaaaataattctttttaagtttgaccattcgtaggaaaacgtgccaatattttttaacacaaaacaaacatactatagatctaatgttagacttaataaaattaattgtattgtagatgttacaaaattttcgtataaacttgattaaacttaaagatgttttacttagaaaaaaaaatcaaaatgtattatagtatgaaacggaggaaattaaaggcaagcaggctggctgtcgttccccgtggatgatgcaggacagtaatcttggggcttgtttggttctttgctatgtactccctccgtccaataaaaagacaaactctggtttccgtgcccaacgtttgaccgtccgtcttatttgaaaaaattatgaaaaaaattaaaaagacaagtcacgcataaaatattaatcatgttttatcatctaacaacaatgaaaatacgaattataaaacaatttcatataagatggacaattaaagttggacacggaaattcagggtttgccttttttttaaaggacggagggagtgtaaccttgccaaaaaaattttggcaaaaactggctaggtttttgtttagtttgctaccaaagttgtatttaggtatttaactaagccaaataatttggcaatggcaatttgacattttctttggtttggctgagttagagcaagttttatgaaagggatagctgccaccttcaattttatctttatcatctctatataaattaagaagtagtctgtacagtatgttatctctaaacataaatctcaataaatatatttattgaagtttgtattggggttgtatcttacacgagggatggcttaattctttctttcatctcttctctcttccacaacagtaaataaatctacatggtatgtagagataaagtgcttacaaacttatagtatttgctcttagaccgtaaaccaaacaaacccaagaagcctgataaaaaaagccagtgcacaactagcaacagcaattcaggtcggtaatggttgcaagtaaagcgttgcattgaagacgaagttgcaatggttggtcttcaaagatgtactataagtactgtcacagtgcgtacaaacctttcagagctactgctagtaagttgtggcattaattaagccacatttaatcatcgaactgcaacatgttagttcgcaggaagtggtcagcgacagctttgtatgtggcttgcgtcggatggacagagtcccagaacatgaactgggccggcgtcgtgcaggtcggcatcagatcggtgcacaggggccccatctccagcagcccagtgccgcagcaccccttgccagtttcggcgaaacctgggttaacagaagttccgaaagcaacatcaaatgctgtcaattctgtaaaaaacaacgccgaaatttttcgatcggtttcggcttcagattttcagaagttagctctttactcaccatacttctggggatgatcgaccatgtccgtgagaggggtgtagatgtcagcgtacacggctttcgctccgggcgaagttgactggaacttggtgagcattttgcggagcttggcgttgtacttctccgcctccgcgttctgctccgcgatgcagccctgtggcctcggcggctgcctcagcgccgccagcgtcatctgcaccgggaggcatccgaccggcggcaatccggcgaccaggagtctccgggcgcccaggttgtacaggctctgcacattgtttgaccatatggttaaatcttggaaaggtcaaattcaggttttacagcgaggttgggggactcgacacgtttgaaggttgcaatggtgcagcatgcatgggcagatccactgtgttgatggataggattcgatcttgcttgttgaaacttgaaacagagtgcctaactaccctaactgcaattgcttcttgccattgtttgcagagcaagagagatcaaggactacatttgcacctgatctcgtgccagaaatgcaagtgcaatcagtatccttactttccaggaacaaagcacactacgcacaagtgcaatcacagttagttataaactgcgcgagaacttctcacgaaaatggcattagcacaaaagtgcaatcacagttagttataaactgagaacttctcacgaaaatggcattacggtgacgtcgatatagatactaatttaactaatctccgaatctcaaaggtttcgcatgcaacttgcagcattgtagctgtcactagaaatggaccgagttaacctgaagaaacgaatggaattcgcgaagaaattaacctgaatgtacgatcggagcttgccgatgaggagggcgtgatactggtccagcgtgtnnnnnnnnnnnnnnnnnnnnnnnnnnatgatcatgtcgttcgtcccggccgacacgaggaacagcgacttgttcaccacctcaccggccttgccggcgcccatcctcccgacgagctcgctaaagtccgcgatctgcgaggccatcgtcgcgacgccggcgttcgtcgccgtcctgtcgtcgagtcccgagccgccggacgcgaagctgacccccgtggcggcgtcggcgtcgctgaggacttcggagccggagtggtacgccggcaggaggcccttgacgccgagcgcctccacgaggaagtcgctcatgatcttgccgtcgcagaacctccccgtcggcgcgccgccggggaagtcctggccgtagggcgggtggtcggcgcgcaccgcggtgacgaggcggttgttgttgcccgcgtcgagcgtggagtccccgaaggcgaagacggccggtatgcgtcgcgcgctcccaccccgtgacacggcggcagcggccgcgtcgacggcgacgacgacgatgccgtggatggcggccagggagaagaggagggcggcgagcgttggcttgagcgccatgtgggcaacgtacgcatgcacgttccagctaagatggtgtacacgcacagtgcagttggtcgctcgtgtttatatatgctagtagcatcaactgctatcagcattggccgcttgtatttacgagcagcctgtcaactaactctttgtcattcttgcattgttcatcagccccagtcagataatggcacaagaggcgatgtgattggttttaaatgaccatgcatccatttaagcatgcatagaattcaggaaaagagataatctaatcagtaccattgagttttatttggttactagggtttgaaaaaaaaaagagataatccattccataacattgacaaaggatgaattctacaatataccaccgacaaaactgagttttataatatagcgttgaacaactagttttcttacttacataccattgccgctagtcaacggttagtttaattccgttaagagaaagaaaatgtccattttacctctagggtaccgtgcgtacgatcatggatttcattggtcacgatccactaattcttctcattgatgaaaaatagaaatcacttgtctttctatcatccaagattatttaattaggcatggcattgtgcaaaatctcaattttatcctaggggtaaaattgccatctttctcctttaatggtgtatgactaacggttgactaacgctgatggcatataaggaagaaaataagttgttccaaggtatattgtaaaaccgagctttgttagtgatatattgtagaacccgagctttgttgatggcatagaatggattgaataaaaaaatgatgaagagcatgcctatttggttccctcattttgtagtgttggataaaacacatactaacatactaactctagaaacaaggtagcaaaagacgcataaaggctcctatatactttctccgtcccataaaaaatcatctctatattaaagttcaggattggagggagttggaagtaaccagatgtgatctatcctgactccctgagtatgacaacgtttgttaaactgtgatcaggtataaatgggtgaaaagcgatcttaaaatcttaatagactcattacaccggtaatcatctataaatgggtcaaccagcctagcaaaaacccaactactgtatactacaactgtatgaaaacagtgttcattaaaccggtgatcagctataaatgggcacatggtcttctttaccgcttccattatttccgtcagcaaaaaagaaaaacaatagtttgccactactgaggttgctcataattctccttaattcaaacatgattagcgcttaattctcataaaaaattggtaactactcatgcgtcataaattttgtctcataacaaaaaacaaaaatatgaccctttcggagctatttttttcgtgtcatcatgcccgtttagaatgtaaaagttttcctggtttttatatacgaaatgaaattgttcacatgaaattcctcctatgtttcaaatagacactagattctttcttaaaaatattttttttccaaaatacccacactcagaaatagaaaatttgaggatttgccactgtcaatcatgcgtgagtcttggactctcttccctgtcaaacacatgtgattgacaaatcctaaattacgagtggcaaaatcctcgttttatccatccgtttgtccattactgcggtggtcgaagtcgttagttggaggttggaacttgtgggagtttgggagcttcagagttcagaaatcggtatggtcagtctcatcagtgcccatctcctctcgctaccctcatccgcgccgcgctctcgcccgcaatcgaggccgcccctctcgccgcccgccgccgccgccgccgcctcctgctccttcgacctgccccggccccgccgcctcgtcgccgacgggagccggaggaaggggacgatggctgcggcgatcccgcccgaggcaagcggcctggcccacgacctcgggtccgcggccgtcaccgcaggcgtcgccctcgccctcctccgcttcttcgaggagctcgccaagcgcggggtcttcgagcaggtcagccaccgccgcctcttcgcttcgccctttcccccgttggcgcgtcactggaggcttctagtagctaaatatctccaactaagatgcatgctcccttagtagccattactatttgaatttcgatgcaacagtaaggaggtcgctactgaattacacgctcactgactcatactactgagattcccatgggtgggtgacgagacagacacgcagatttggattcgtttctcgtatttttgccaaggttgcatgtacgaacaattatatttgtgtgatcatcttcacggtgctctgcgcttctcccaagcagtacaacttgtttgttaaaatattcagcgcaattagtcccagcctccaagctgtacaggagtcccatactgctaagtattaattgtgctcatctgaggtgtctgtttagtagttttactttgagataggatttttaggtggggattagtgataaatgggtaagcatttccatattcttccgaaatagaccctttcagtacaagtctagttagtgcctgttagattcaagaaagatataatggaaaaggtccatggagatgcatgtgaaatatgtcaatttgatggtctaccgttatgttctaagaattccaagttaagaacgaggagcgagggttgcgaagcaaatcctgatatttttgttcaagatattaaagcatatatttagtgcgagaagtaggcttatgagtcttgtatttcattccggtctctgtcccgtgctgttctttctttgattctaaataacttttatttctcttaatggaaaaaatgcgcccctgggtattcccgaattttatgcagtttttattcaaaagtataatgttaccttttctagtttctgttaacaagattgatctttctatcccatttccaacactcgtttagaaaaaaaaaatcaagcatgatatttaagccataaaacccctcagtgtctcactctgcacattgcaactcttaaagttttactttgcagcgcattcatgtgagataatccaccaactgttgttaaatatatttcagaaatagtgaaaaatgaagtataagttcccaccaacaaaaactcagattcacaaaatcttggggtaaatgcacagcacagccttcttaccagtaatttcagatggatgtctgatggctggcattagctcattgacaccagatgaaattcagctaggttctcaacataacatagacatataaactgaaccatgcaattagctgacaaattaacagtagtttttcttattgagatttgcttcaatacgatgatgctttctattgataaattccatttgtttgcctgcagaaactcaatagaaaacttgtgcatataactatcggtatggtattcttgctcttttggcctcttttcaggtaagaaaatctaattttctctggtcaacataaatcaccatattggtactcacatattgatgctttatacagctcaggaagctatgctcctttcctggctgcagtagcaccagggattaatattataaggatgcttctgctggggttaggagtaatgaaaaatgaagctatggtaaaatcaatgagccgatctggagacccgaggttgtatactcgcatacaccaacctttggcgattacataattaataagcttgtttctgctcatatttgccttttattctttgcatttttcactctgattttcctttttcctattctatgccttctttttggcacagatttgcttattctttgtttctgttgaatatctatagttgctgctgctgctgcttcaggtcatgatcctttagacttcattttctcatgaacacagggaacttctcaagggtccactg

SEQ ID NO: 71087 - DNA, 1138 bp, Oryza sativa
acgccgcatcgccgagcaacgcggcgtcgaaatgctcgacgccaccgggctcccacggcagccgcggcgaagcgtcaggcatctcgggcgcgtctcctcccccatcacgtaggctcactccatcaaaaacaaaaaaacaaacaaacaaacaaacaaaatcaagagaaacgcgcgaggaatcgatcgattagctcctggagcagttgggatttgggaaggatcaaacgcaatggggaaaaaattgggtaggaatttttgggggaaacggtggaggctgaggtgtgcggtcggggagaaccaggaggcctctgggggaaaatgcccgcgggagaatagcggcggtggcatggcatggtgcatggcgaggccgtggccgcccgagaggcggaggaggaggaggaggagagaggagagagagggaagcggccaggcgaggaaggcgaaggagtggcgtcgtcgcggggttcacgggtcgcggctgctttctagctgggccggtctggtgaatacgggttggaataagttcatttaaggtcccttaacttgtcaacaaatttgattttcgtccttcgatcgaaaaaccagatacaacgggtccctcaactatcaaaaccagtgcagatgatacgtggctaatttgactcggtcttcatctgacgtagcattgccgtagcgcttacgtggcaattcgatccgaaaaataataaatctcatgggacccacatgtcagtttcaacaaaagaatgaattaaaaaatggtggggcccatatggccccacatatcattgtcacccctcctcttcttcctcctctctcaccatctctcccctctcctccctccaggcgccacggggccacggggaggtccggcggcggcggccggcgacgtgggagaagggcagtgggcagggcgtcggcggcgagagcgctgggtcttcgctcacggcgtcggcgcgggggggctcgtggaggagatcggggccgcggcgccgcccgtctccgacgagctagagctcgtgcgagcgcagtgccgggagctgcacgactgccgacgagaagcagaggaggttcgaggtgtacaggagcaacgttgagcttgttgagaagttcaactccatgtgcaatggctacaagctgg

SEQ ID NO: 71088 - DNA, 630 bp, Oryza sativa
ttcgatttcttcgcacgtatttcgcgtgcatgtggatacatatatacgttcctgcgcaggacttttctttgcggaaatcttacatggttttatcgtttttattaccggtttgtttcgatttgcaaggtgcggctttagttgtgcatgctagaaaacgagtgtacagggcgaaacttcagcttcattgagaattgggatgacgccatgggattctttggccaagtgcgtaacgtaagtgatgatatgcacatgcatggatgtggtcagctcgatcgaagcaagaagccagcgtcgggtcatctggtcgctagttttgtttgcactttgcacacggcttcatcattgtctcgtggccttcgttttctattatactcataaatgggatgagtttcctgttcggttgatgatcatgttctgttttcagcgatcgtgttctcttccgttccaaaatacaccctccgttccaaaataaggggtgtttagatgtaggggtgtaaaattttagcgtgtcacattaggtattatcactggtggagaaaccctttgtagtcccggttcgtaacccccctttagtcccggtttccaaaccgggactaccaatccgggactaaagatcgctatctttagtcc

SEQ ID NO: 71089 - DNA, 1292 bp, Oryza sativa
ccgaccccctcggggggactaagaggagggcgaacacatcaccctcgggcccgacgtccctcgagggtgccaggccacgtgggcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcaatggtaactcggctgtcaataatgagcggtctcttcaagactgccacattactcgagtagcacacgaatctggacatggcgattcgtttcgtctggagatatggtaacgtcgcttcggccggcgagcgtaactaacgcgcacacgatatgatctatctcgactgccacaaccgcatatccacctcatgcgccgcaagcgggcgaatgggatttagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactctttctttcctgtgccctaccttcgccacacgcgctcgctcttaatcttctcttcctccggcgccatggcacggggctccgctctgctcgatggtagcgtgctgccgccctcccgcatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccggtgctgaaccgctacatcccctgcgccctccgcaagaagtgggacgactggaagagcgactggttctacacccccctcgccgacgaagcgcgcctccgacttccgagccagcccccggcgcaggcctccagctggcgggcgccgg

SEQ ID NO: 71090 - DNA, 750 bp, Oryza sativa
agtttacccctctatggttctatccaccagtaattcaaaatgctagcttgcagtttgatatgccaatgtattacggaccttgcttatgtatgcaccacagcccaaaaagttttgaggcacataaataaaatgttgaaggctgtaatctcaagggaacaatacaggcaggagctctatgctagtaacaattagcaactcatacttgaaacatggatctttgcctgctttagaatttctgcctagtgatctgtgctgatcagctgttatgctctggaaatccaaatcaaccgtaaccctaatagattcgtaatttttgaattccgaatttgcaaatgaaggacatgacggcggcggacttgaaatcttacctgagcgcacatgggctcccagtttttggaaagaaagaggcacttgtcagtagaatcttgactcatctaggcacgtgaaatggtccacttcgacggactactcagtgatagctaactctgtaagctatctaaagttttctgaacatgttgaagtgcctatcaaaaaccctctccctgcttaggctgtgccaaattttgtagcaatatgacaacagctgaccccagttcatttggtatcatgtgcttttgtgacatgtaccactgggatttctcttaaatgtcactccagtctgcagagatcagatcattgttggtagaggaaagtgatccattagagaaagcaacaccaaacaagattattaagacattttttaagtgaagc

SEQ ID NO: 71091 - DNA, 783 bp, Oryza sativa
  unsure (1)..(783): unsure at all n locations
gccgcccccgccgctttcaacactcccccaccgccacagcccccgatccggctgtgctgcggcggcgacggccgtggagcggtgtacggcatcatcccaccacgctcttatctcacacaggtttcttggtttttatatttttttcacacaagaaagagagagagcactagacacggtctggctacttatataccttggagcaaaacagcaaatcaccaatcaagctaaaccaatactgagatggtcatcacacaagttgacaacttactcaattacacttgccatttgtaacggtggtttttgcaacttggagcaagtggtttagggtcacttgtgagagttggggtcctttgggatggtgttttttctagcatcagggacaacaattaaaccgcaggtgatatgtacgtatgctgctctgtcgccatgtaatgtcatatagtcataatggtgtagactgaggctgtatagaatatgcgcttcttctgttatgagtccgagtgtctcagactgtttatcgatagattgcaggagccaaccgagctatgttaaggtaccctgttcagatctacggatgtagttgtgaaagctatcttctgagctaagttaatccaccatcagtctgcgcgctgtgcccatatactggccatactatgcatagttagctcagtcagattcatctagtagaattagactcgatagctnacagcccaataccattctaacttatgatgccatatgtttgagcctatgaattagcatgccaacgttcagtgaggcagg

SEQ ID NO: 71092 - DNA, 23540 bp, Oryza sativa
tttcagaactgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacacaacgactccgccgttttgcataggacaggaaggatgcgatcaaggaggaattaaccaagttgttagcagcgggcttcattaaagaagtccttcatcccgactggctggctaacccagtcctgattcggaaaaagacggggcaatggcgcatgtgtgtcaattacaccgacctcaacaagtcttgtcccaaagatcctttcgggttacctcgcattgaccaggtagttgactcaacggccggctgcgagctactcagttttttggattgctactcgggatatcatcagatccgactaaaagaatccgactgcttgaagacatcattcattacgccttttggggcttactgctacatcaccatgccctttggattgaagaacgcatgagcaacctatcaacgcatgattcaaagatgtttttcaactcagatcggccgcaacgttgaagcttatgttgatgatgtagtcgtcaagaccaagcagaagggtgacctgatcacggatttagaagaaacttttgcaagcattcgtgctttcaagatgaaactaaacctggaaaagtgtatcttcggagtaccgtcagggaagttgctcggattcatggtatctcaaagaggcatacaggccaacccggagaaaatcaatgccatcctcaacatgaaaccgccaagctcccaaaaagacgtccaaaagctgactggttgcatggcggcgctcagccggttcgtctcacgactcggcgagagggggatgcccttcttcaagttgctgaagaagactgacaatttccagtggggacccgaagcacagaaagcctttgaagacttcaagaaacttctcaccactccaccagttttggcctcgccacatccacaagagccgctactgttatatgtgtcggcgacctcccaggttgtgagcacggtcctggttgttgagcgtgaagaggaatgccatattcaaaaagtccaacgaccaatttattttgtcagcgaggttttagccgactccaagacaaggtatcctcaggttcaaaagttattatatggtgtcttaattaccgtcaggaaattatctcactattttcaaagtcactcggtcacggtagtcacatcgtttccactcggagatatacttcacaatcgcgaagcaaacggacggactgcgaagtgggttttagagttgatgtctttggacatatcattcaagccacgaacttcgatcaagtcacaagctttagctgatttccttgccgagtggaccgagtgccaagaagacatgccagaggaaaagatggaatattggactatgcattttgatgggtcgaagaggcttacaggcactggagctagggtcgtcttgatttctccgactggagaaagattgagctacgcattgtggatacatttttctgcgtcccataacatggcggaatatgaggcgctgctccatggattaaggattgccatctctctaggtattcgcagattaatcgtccgtggagactctcagttggttgttaatcaagtcatgaaagagtggtcatgtctagatgataatatgaccgcttatcgacaagaggtacgcaagttggaaaataaattcaatggactcgagctcacccatgtcctccgacataacaatgaggcagccgatagactggccaattttggttcaaaacaggaagcagctccttcagatgtgttcgtcgaacatctttacgaaccgatcgtgcccagaaaagagacagtcgaagccatggatattcaaggcgtaagcatgatcgaagctgactgaagagaactgtttataaaatttttgagcaaacaagaactccctcaagacaaaaatgaagccgagcggatttccaggcgcagcagactttacattattcatgagactgagctgtacaagaaaagtccatcaggaatactgcagcgctgtgtgtctttggaagaagggagacagttgttgaaggatatacattctggtatttgtggtaatcatgctgctgcacggaccattgtcggcaaagcttaccggcaaggttttttctggcctacagctgtgtccgatgcggacaagattgtgcggacatgcgaaggttgtcaattttttgccagacaaactcatttgccagcccaagagttgcaaaccatcccgttgtcctagccgtttgcggtctgggggcttgacatggtcggcccgtttaaaagggcagtcggcggttacacgcatctctttgtggctatcgataaattctccaagtggattgaggctaaaccggtcatcacgatcacagcagataaagctagagattttttcatcaacattgtgcatcggtttggagtacctaatcggatcatcactgataatggcactcaattcactggcggagaatttaaagacttttgtgaagactttggcattaaaatttgttacgcctccgtggcacaccctatgagtaacggacaagtcgagcgtgctaacggcatgatactgcaagggatcaaagcacaagtttttgaccgactacgtccatatgctggcaagtgggtagatcagctgcagtccgtactttggtctttacgcactactcctagtcgggctaccgtccagtcgccgttctttttggtttatggcgcagaagcaatgttgccgagtgaagtggaatttgaatcattacgatttcggaacttcaacgaggagggctatgaagagggccgagtagacgacatcaatcgactagaagaagcccgagaagcagttttaattcggtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccaggttcttatcgactcaagcgcgaagacggtactctcatcaacaattcttggaatattgaacaccttcgtcgattttatgcttaggtatttcgcttgtatctttcctatttgactgctaacttcaagtttttccttgaagttttcagtcagggggctattatgataataatggagtgtgatttttatcaattcaatttgcttacttgatttatcattgccctgtttggtctttcgacttagccaatgagaactaaaggtttttaatagcttttgcgggttttaggctcaataaggcttgacaaaggcttttaagaaatcagaagccaagtatggaacaccaagcatagcataaattcatcagtattgtacaaattgagcctccaccgtcattgatcatcaaaatcattgttatatcaatcagtatcagttttttcatcatcagacttatcagacccagtcggccgaaggtcgacatcttggaatctctcaactacatcagcagcaatcttgtcagccgctttctgcacatcactgatgaggtcaagagcagcttcttcgctcgtcccgtctgcaaagccatcaatggcatcaatatcaactcttggataaagggatttggtcatcgccaacgccagacttgctcccatactttcagcttctttgatgttcttgaagtaagtatatggagcgactctcagcttgtcgaagatttcggcagcatcaagtgtactcgacccggcgttattgaagaacatggcctagataagtggagtagcggcattagcgactttatccctggctccttcaagcttgttgatcttgccaactaagacatcaaattgtgcttgagacttgatcttgcgatctgcgtcaacagattcacattaatgaatcagcatgtagaagataatggcttttgaggcattgattattggtaccttcaacctcctttaaagccgaatccctctgtcttgctagctctgccttgtcattttccagagtttggatctgcttctctagttgagatatcttggcagcttgcactacattaacttcggttaatctggattacagatataacagcacaaatcagtaaggcagagtttgcgcgaaccttttgacgagccactcagttcgaaattggactcctggagctcagcaatccgatccctcagatcgtgttcattcttcttggcaagttctctggcctcgtacagttgactcctagtggcttcgagggttccaagatgaggaactagtctctctagggttgcggttttcacctcgtccctaagatgaatcctctgcggagcagtttaatcagcgctcgagccagacggtaaacaagatggctgaggtcaggcgtcaaagagcttacatttacaatgcgagtcgcttggttgagtgcctttttcagtaggcatacctcttcgtcttctttttgccggtttattacaattccttgaggttgcaagttgtcatcccaccacttgaccagaataggagggcatgaatcttcggctgcttgtatacggggaatttcttcttcatcaccgatcatgatcctaatgcatccattgacaaaggttagacaatcgatcggagttatttgggtcaacatggtttcggacaaagtgtttacctgtaatgatttctggacgaggacgagtggatttggatgcttttaaaggggatccagatctccggtcattgctggcgtcttgtccgcgagggttgtctgcttgggtttcgacttctggaatatcttggcttggccctgcgtccgactggtttccagtcgggggctcctgattaactccggcttcggcttcggccgactggattctagtcgggggttgatcaccagattctgcattattggttgccggttgattgtcacttggatgatcctcagcagttgactcggtttctttggaagaacctgtgtccacattagtcgggtcagagtctttcccaaacggatctatattagatggtttcttgcaaatttgattatcagtattaattgccgcaatgggtgcgcatcaatgcaagagagatcgttatatgagttgcacctagaagacttcctgatctttggcacagggcgactggatgttttcttccttggagtagcctgttttggtagtttcttggttgtctctcggtctccaggcctcctggcggcatcatcggcttcgtcgtcacttagaaccagcttcctctttcgagaatctggctggccgattggatcagaagcacttggttgagtttcagaccgaattcttggtcctctgctcccttgcccagtttggtggcggggcgatcggcgttgagcaattgggggatccgacttcatcaaagcaaattcctgggtgtaatatccttcattgttaactgattcaacaagaaagcaagaccatattttgagaaaggttgaagtgtatgaatacgtaccggtggaggaggattgaatgcattgaatggcacaacgggtagcaggtgtgaatagctgacaacaatagcgtttgagaagatcttgtacattctttctttcatgaccttaaagtcaagagaatctggatcttcccgatttggctcatgcttgccgtcaaactcaaaagccgtgcgggatctctctttgattggagctaatcgacttttgataaagtgccgagtgatttgttctccctgcaaaccttgttccttcagttttagcatgcgttccatcaattccactgcctgagcagcttcatctcccataggcaatgagttccatgtgtcctggtaaaccggaggaagacaggaatattcgggaagtgcgggttcaggattttggacgtaaaaccagtttgcgtgccagcctttgtttgaggtcttgaagggcatagagaaatacttttggcttagtgttcctctgagttggaaaccagcgcccccaaccacgcatggtttgctcttattatgttggggcttgaggaagaagattcggcggaataaggcgaaatgaggcctaatgcccagaaaagcttcgcaagcatgaacaaaattggcgatatgcactatggagtttggattcagatgatgcaagctaatcccgtagaagttcagaatcccccggaagaatcttgaggttggaagagaaaatccgccgtagaagaaatgagcaaataccacgatttcgtgtgtatcgagggtcgggaatgcctcaccaaatgccggtcgccacccgatgatctcttttgctggaagaacgtcgtgtgccaccatctccttcagattgtcttccgtcacatcggagggcgcccattgactcttcaagctttttttttcttccgccatgaatgtgaactggatggtgtgatttaattcgagatacggctggaaagggagggaaattgcagcggtggatgcggggagaaatttcgtgaagtttttgagggtggattggagcggattgatgaaccctagtttgcccggcgcagttttcattgtagcaggaaatggggaaaatggcgagagtctcggcggggaagacgaagagacgttttttacttcggtattattagggtatcgggggtgctaatgggcctgggcctgtacagtacttcagcccaattttgttttcagctttggcaatatgtgctcacaatgatgtggctcgatgctgttaaaatccttttaacgtgattcaataattctttggaattattatgatgcacataaaaaggtgcccgacagaaaggtgttataccatttttgtaagcttttttaggctacaaaagctgttgggttaatttgagatgactggtttattagtagtcattctcctagcatgttatatgcttattttgattatggtaagggttatagcctaggctattaaacttcctaattgccatgatctttatcatatttggtggatcattttacgagttttctactcggattcctgtcaaatatgtctacttatgaacctttttgagtgtttgtcactcgggtcttttcatattttttgtccttgatatgttcaagttgaaaagcagtcggctgggtatcttattgagtaccatgcatgctttgttataaaaccactcggttcttgactacatgtttagtttttcaactaatcatatagttgggggctacacctaattaggtgcatctactcgatgcaccatgttttattttcgcccttcacagtcttttagcactcagcaagctggagcaagttgaattgaagcactcggattattgtttttgtttcgagaaggctattttgtcaactgtgaaggtctcgggggctactgtggagattatggttaccccatatctacatggcggttatattccagctggatatacggtaccaaatatagatagaatatctttatgaggactcgggttagattctaaacttgtatgtcaagaaaatacccgggatcctagtcggttacgattgtattttatctgtaatcccatattccgttaggatatggactgtattctgtaatacggatcccttcccctatataaggaggggtccgggttcctctcgggacgattcttttttccagtttatacaatcaataacacactcggcggaatcatccccggacaggagtacggtattacttcttgaataagaaggcctgaacctgtataaaattccttgtctccaaacccatccactttcctagcttgatagccacccccttttattattgccgaaatcttgtttcgacaaacattgtagagcttgatgagatctacaactttattattgactattttattatttgaggtcatttaagggtctaaatattcattataatataccatattaatttttacaaaatctcagatctacaattcaaacatctgatggagatgtgttccatatcaaagttgtagagctcaacgggatctaccactttgtagtttataacatttgtatttgaaagcatttaaagtataaaacaaacattacaagtttcgaagatgtgaagtaaaataaataacatctccaatttatacaatggtaaataagttatacatctagtaaaaggtcttgggagtagaaaacgataatcatatttgcatatggatctcttagaggaacagccatgaaaattgattttcacatacggttgtaggaccgtctacaaaattgacgatataaatgttggagacgttgaactaaaataataagcgatatctctttcttgatcaagaaactcaatttgaggggtttttttatataccggtaaatattcgctaccgtattcgttccgtctcgtattcgctccgtatctgtattcgataatattcgatttcatttccgtatccgagttttcgatttcgattccgattccgaaaaaaatatgaaaacgaatatgataaagctagtttccgtccgtttccgatccattttcatccctatgtacggccggaagcgcggcgaggtcgaggctggcgtggcagtcgtccaagcccccttacggcgagcagcgagagcgcgctgagcaccacgagtagagtgttcaaaaattagtggagtgaataaagtctatggaattatatatttaaatatgaagggggtaattttctcggtccaccaaatatgttataactcatgcggattcacggaagaaaatatgttatcaccatcatgttgtgttcaacattgttatcgagcgatgatacgtaacgtgcatgaggttgcttggttcagttaatcttttttcccttaaagaagcgtgtttaaattctgccgcacacacaacagcatcaacgcaagatgtcaggccttcatgcttaaccaggtgcgtgacaaactaacaatcaataataatctcattaaaaagggaaatatttatcgataatagtctcataaaaaacttgctgaaattccaatattggtacaagcagaattacaacaaagggtgcaacaaaagaatggcaaaattaaactaactaattaaacctttaatcggtggaaaatgtatgacaaacaaaaatcacgagcttattctgaccaacaacatccccgtcgtcggagatgtggattaactgtgatcattagccggtgatcaatggcggctagttgacgaggcggcagttcttcctgatctcgccattggcgctggtcttgattccaatgccgcccatcttcaccatcgccgccgcgaacttgctctcccaccggccgggaatgaccacgttgaggaacacgctgaaccccgtctccgacgaccggagcgccgcgtccgacgtgaagagcacgtcgcggctgagcacgttccggtagtactggttgtccagcttgtcgggggttttgaggtcctgcaccaccgtggggtcgccggtgcggttgcacgcccgcgtcaggttggccttgagcgcggcgtccatgtcggaggtggtggaggcgaggcggtcggagaaggaggagcagtgggagacgccgatggagtgcgcgccggagagggtgaccatgtcgtcggcgtcgagccccttgtcggcgaagttcttcttgagctggtcgagcccggcgaacggcgacggcaggttggtgagggtctcgtcggcgagggagacgcgcccgtcgtagcggccggccggcatggcgaagtcgatgttggcgttgctgaggaagtaggcggcgtcgcggccggcgaaggcgacgacgtcggcgcaggagacgacgccggggcacgcgctctcgagcgccgccttcgccgcgtcgatcacctcgaagccgcggaggctggggaagttgggcacgccgagcttctccggccgcgagttcgccgtcgtcgggtcgagcagaacggaggcgtcgcagccctgatcaatcgaaaggagacaatacacagccacattaatcacgtggattactaactaattattaatcacgtgttttaattgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatatccctagaggcgcccggaccccctttatatactggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccagttcgaataccatcgccgtgtagatatgggatacccataatctccacagtagcccccgagtcctttgcagtcgaccatcatagtcttctcaaagataataatccgagtacttcaaactcttcaagccaaaatctgccgagtggactgtaaagggcgaaaaaaataaagaatatggtgcatcgaatagatgcacctaattaggtgtagcccccaactatgtgattagttaataaactaaacatatagttgaaagacaaaataataacacaattgtgcattatatgacaaaagcatacgcggcgcctaaataggcatactagccgactgctttttagccaccataaaagaaatccgagtggtttacactctaaaaggttcacgaatgaacacacttgacaggcatccgaataaaaaaattctaaagattacccatcaagtattataaagattatggtaataaataagtcaaatagcctaggccatgactatttaccatgaaaataggcatataacacgccaaggaaatgactataataaaaacaagtcattcctagttaacccaaacagcttttgtagcctaaaaaagcttgcaaaaacagcatgacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgtgcaggcctaggcccattagcacctccgatacccttaactgaaaaatcctatatccaagcgacgcttcgtcttccccgccggaactctcgccattttccccactccttgctacagtgaaaagctgcgccggcgaactagggttcacaactccggccaaatccacctccgaaaaacgcatcaaaatccttcccgtgatccaccgcctcaattcctcacctctcccaagccatccctcgaatcaaaccagcacatttgagaaaaatcgatggcggaagagagagaaagctttgaaggccaatgggcggcgtccgatgtgacagaggagaatctgaaggagatggtggcgcacggtgttctcccagccaaagagatcatcgggtggcggccagcgtacggtgaggcatttccatctccagatacgcatgaaattgtagtcttctcgcatttcttctacggtggttttgctcttccgacctcaagatttttccgtgggatcttgaacttctatggaatcagcttacatcacctaaacccgaattccatcgtacatattgccaatttcgtccatgcttgtgaagcctttttggggatcaagcctcactttgccctattccgccggatctttttcctcaagccccaaccaaacaagaacaaaccgtgtgtagtcgggggggcaggattccaactgaggggaactctgagccaaaaatatttctccatgcccttcaagacttcgaacaaaggctggcacgcaaactggttctatgtccaaaatcctgagcctgctcttcccgggtactcttgtcttcctccagtataccaagatacctggaactctcttccaattggagatgaagcagtccaagccttggaattgttggatcgcatgttaaagcttaaagagcaaggcttgcaaggagagcagattactcggcacttcatcaaatgccgactagcgccaatcaaggaaagatctcgcacggcattcgagtttgacggcaagtatgatcctaaccgtgaagaatcagactctctggatttcagaatcatgaaggagaggatgtataaaatcttctcaaatgcaatcgtcgtcagctactcacaccagctgccagtcgtgccatacaatgcattcaatccgcctccgcaggtatgtattggaaatcctcaaaccatgatcagaacataattttgtcttcatgctgagttgactaactatggaagcatcttgttcaggaatatacactgatgaagtcagatccaccagtcactcagcgccggtctcctcgtcaacataccgctcagggaggtggagggccaacgatcagaccggatccgcaacctcagacctccaaatcaactggtcagacgggtcctcgcaagaggaaactggtgcttgatgacgatgaaggcgacgatgataaatctggggataagggctcgcctaataaacccccaaaacgcaccatgcccaggaaaaaactggccggccgcgcaatgccaaaaattagaacatcttccaggtataagacctctcggtatgatttcactttggtaagctctctcatgagaatgatgctaaattctgaaagaatactttgcaggaaaccatctgatatagatccatctggaaaagaccccgatccagccatggcagagcaaaatatatccaaagaccccgagccaactgccgaaagccagccgactgccaaaagccagccgaccggcgcccatgcttcgggtgaccaggccaatccgagtgaccagccgccgactggaaaccagtcggcaacaactgaagcagcaacaactcaagagcccccgactggaaaccagtcggacgcaggccctgatcaagaaatccctgaagtagaagcgcagacgacagcttcccaagggccagaagctggtaatgactcaatagctggatctccaggcaaagaacaaagatcacctcacgctcagctaggtacatctccaggttaattgtcttctcatacaacggtgatttaaataacctcagcgtatccgtctaatgtcttggaaacacatcaggaccatcaggtgatgacggagaagaaatccctcgcataaaggcgaccgacgactctcgtcctcctatcttgatcaaatggtgggacgagaactcacaagccgccggtatagtcataaaccgtcaaaaagaagatgaagaagtgtgccagctgaagaaagcgcttggagaggccactcgtattgtaaatgtaagtcttccgagcgacagccttcagtaactttgttttctttttagcagaactgaaccatgatccatcgtgcagagaatccatcttcgcaatgaggccaagaccacaactttggaaaagctggttcctcatttgggaactctagaagcagttagggaccagctgcatgagaccaaggagcttgccaagaagacggagaaagaattaagggaccgaatcgctcagctccaagagtcaaattatgagctgagtggttcatccaaaggtaatctctagatcagtttcatcagttcaaactggcataactatatcctcaaccatctgaatttcaaaacagcgcaagccgccaggatggaacagatggcaaagcaaattgaagccctggagagagataagacagaactggctgcgcaaagggactcagccttgaaggaagtcgaaggtaacgccagccaacaatctgagcttctctccttataatgcaacagatgctcatcataaatgtgttttgtagatcgcaagatcaaatctcaagctcagtttgacgtcctggttggtaagatcaagaggcttgaaggagcaagggatgatgtcgccaatgccgctgcaccaattatccaagccatgttcctcaataacggtggtccgagtgcactcgacgcaaccgaaatatttgacaagctgagtgttgctccggaagtatatttcaaaaatatcaagaaagctggaagtatgggagctggcatggccttggcgatgacaaaatctttgtacccgagaattgaagtcgacaccattgatggatttgcagacgggacaagtgaagaagctgcccttgatcttatcggtagtgcgcaaactgcggctgacaaaatagcgagtgatgttgtggagcaatttcgcaacaacgacctccagccgagtaatgatgactctgatgatgaaaggactgactctgactgagtttggatgtaatacatggaggctcaatttgtacaatactggtgtatttatgctgtgcttgatgattcttgcaaagtttttgatttcttaaaagtttttgctaagctttgttgagcctaaaacccaaagaagctattaaaaactttcagtcctctcaaactaagtagaaaaaccaaacaaggcaatgataaaccaagtaagcaaactgaattgataaaaaatcacactccattattatgataatagcccccgactgacaacggcaagaagaaaacttgatgttgacagtcaaaatagggaaatacaatgataaagttaagcgtagaaacgacgaagatgttcaatgttccaagagttgtcgacgagagtgccgtcttcgcgcttgagtcggtatgaacctggtcgggtaacttcagagataataaatggcccttcccatagaggagataacttgtgccgatctcgtgtggtttgaattttccgtagaaccaggtcgccgactagaaaggcacgagatcgaacattgcgattatgataacgtcgcaacccttgtaagtaccgagctgactgaatcaaagctgcttcgcggacttcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccgttggccctctccacctgtccattgctcattgggtgcgctacggaggcataacaaatctttattccaaaatcttcacaaaagtctttgaaaactccgccggtgaattgtgtgccattatcagtgattatccgattgggcaccccaaatctatgcacaatgttgatgaagaagtctcgagcattatctgctgtaatcgtgacaacaggcttagcttcgatccacttggaaaatttgtcgatggccacgaagaggtgcgtgtaaccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgcgcagcagcgtggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatagcgacatcatgggtgcccgtaatttgagtggcatctttgtgaggtaccgtcggcgtataaatgtgttcgacaaaaacatcagagggcgccgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaagaccactctttcataacttggttgacaaccagttgtgaatcacctcgaacgattagacgctttatccctagggaaattgcaatccgtagcccatgaaggagcgcctcatactcggcgacgttgtgggacgccgaaaaatgtatccaaagcacataacttagtctttctccagtcggggaaattaaaaccactccagctccagtgcctgaaagtctttttgacccgtcaaaatgcatggtccagtgctctattttctccacgggggtatcctcttggcactcggtccactcggcgacaaaatcggctaacgcttgagacttgattgaagtgcggggcttgaatgatatgtccaaagacatcaactccaaagcccacttagcaatccgcccatttgcttcgcggttgtgtagtacgtcgccgagtgggaatgatgtgaccaccgttaccgagtgaccttgaaagtaatgagacagcttcctggtagtaattaaaataccatataacagcttctgaacctgagggtacctcgttttggagtcggccaggacctcgctgacgaagtagattggtcgctgaactttctggacatggccttcttcctcacgctcgacaaccaagactgtgctcacgacctgggaggtggctgatacatacagcaacaacggctcctgcggatgtggtgaggctaagaccggtggcttggtgaggagttgtttgaaatcttcgaaggccttctgtgcttcaggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaagccaagcagcttccctgacggtactccgaaggtgcacttttcagggttcaatttcattctgaaggcgcggatgctcgcgaaggtttcttctagatccaagatcagatcatccttttgcttggtcttgacgactacgtcatccacataggcttcaacgttgcggccgatctgtgttgaaaagcatctctggatcatgcgttgataggttgctcctgcgttttttaatccaaacggcatggtgacgtagcagtatgccccaaaaggcgtgatgaatgaagtcttcaagcagtcggattccttcagtcggatctgatgataccccgagtagcaatccagaaaactgaggagctcgcagccggcggttgagtcaactacctggtcaatgcgaggcaacccgaagggatctttagggcaagacttgttgaggtcagtgtaatcaacacacatgcgccattgccctgttttcttccgaactagaaccgggtttgccagccagtcgggatgaaggacttctttgatgaagcctgctgctaacagcttggtcaattcctccttgatcgcgtccttcctgtcttgtgcaaatcggcgaagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtcgcggcttcggtttccccactttttgaagtcttggcagcgggcacttctccttcgctcaccgtggttgcagccagtcggatttcctctcgggctagcgccatctcgcgagtttgggccatgtcgcaactctccttgtcgcatgtgacggcttgcttgatgtcgctccgtagggataggactcctcggggactaggcatcttcatcatcatgtaagtgtagtgcgggacggccatgaacttggctaacgccgggcgtccgagtatggcgtggtatgctgtctcgaaatcggcaacttcaaagctgatattctctgtgcggaagttttcccgagtgccaaaagtgaccggaagagtaatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttctgcgaagcttgacattacggaccactgggtctagtaccagggggtaccgccccgggtggaccactcggtcaggatgatccgagcggtcaaacttgattgcgatttctgaccatcgaagatactggggcgtgtcaggttgaacagcattgatctcccgttcagtcaacttctgcttccgtttagattcgtaagccagggggccgccgaagatatggttaagctccttgcggtggtcttgaaatccagccggggtgtcgccgtcatcctgcttccttgacgtgctttgttcttcgtcggagttcttccgagtagacttggtgtactgctccgcgaactgtttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccgaatttgccgaccaattcttcgtggcgaatccctttggtgaatgcggcgatgatgacgtcgtcggtgatgtcggagatcttgttacgttgttcagaaaatcgctgaatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatctgctaaagccaccggtaaatagttcgccatggccttgttatctcctcctgctgcgcggattgcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatggtagcctcgagctgctcggcgctgtgtgattgtgtcgcgaagatcgatggggcggcgacgaggtggtgagcgaggccgttccactcggcgctccctatgaagttcgggaggcgagtgaacagaccgctcgtcgtggcccctgctcctgcgattggatcctgctccggtgatgctgaggcttggatgacggtagtcatgagatcggaagtgggggacccggctgccagtcggcgtgtggacgctttcggagttaactgggaccgtcgccgcaatcatggtctttgtctggttcaggatgttgacgacgtggtcggatcgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcttcagcctccttcgcgatccgttcacggtcctgctgctcgcgccgtagccgttcttgttcttgtgcttggtgctcctcctccagtcggcgacgctcttcggtctcccgggcttggcgttgctcctccgtctcgttattggccatgaaaacgccaaagtagagaggggtgtagttgtcatctaggcttccgtcgaagtcgtcgagatccgggtcgtggtagcgagagctaaactcatcgtactccacgatgtcagtaggacgtgagtcgacggtgggagagctgttgtagtcatccagctgatctgtcgaaaccgtgccgagtggttggaggatgacgccgacttccctgaagctaggcgaaatcggtgttgaagccgacttccgcctaggcctacgggatgaaggcgctgtcgtggtgaagacggccgctaaatcgtcggggagcttcatcaggaccggtgggtaagccccatcatcttgatctggtatcgttggaaaagatgcgatctcagccgagtggtttgaagccgactcggttgagatggtctggaagtagctttcagccgcgttcgggaatccaaacgggaccgaaagccggttctctcccgactggtccgattccgagtcaaggagagaaatcttgccgaagttgttggtgatgaagtcgaggctgccgaaccgaaacgtctgcccgggagggaagacgaggtcgtcgatgccggagatgggacccattgcactgatcggcgaaaagcttgacgctacccctacctggcgcgccaactgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatatccctagaggcgcccggaccccctttatatactggaaggagtccggattacaaaagataatctatattcctaacggaatatgaagatagaggtaaaatacagtcgtaaccgactaagtctcagggtgtttccttgatacacaagttaagaaacaaacccggagatacagataggatattctatctacattaagtatccggtacccagttcgaataccatcgccgtgtagatatgggatacccataatctccacattaattaaataagaaaacattttttttacctcgacgaagcagtcatgaaagaagaggcggacgagccctgcgccgatgccgcggttggcgtacacagcgttcttgacggtgtccttcacaatttgctcagcttttgggcaagaggaactgtaataaccaactctaagccccggggccggcgggcttgggctggttggagccgggttcggaggagttgtgcttggtggaggataggttgttggcgggctcgggctcaccggtgctggactcggaggagtcgagctaggtggaggataagtaggcggcatgctcgggctcaggcttggcgggcttgggtatgtaatgggtgtgggtgggctagcattgccggtatagccttggcatgtcacggaaccgaccagagccagcaatgtgagcagcacagcaagcttagccatctctgattctctgcactgaactctgaagcaggttacagtgttctgaaactctcaagactctgaactttgtggtgaaatgcagctgcttctgcatctccatttatagtcagtccccagccgaagcagagaacaaacaatttggtgagcacgtcgcggtgacaaatgcaccctaagtcaagcaggggaacatgggaatcgagcagctagctagaccagttgacatggaggtttctttgattaatttttgccggtaaagctgcagctgcactgaacaagtcgacggtctggttggtttaatttcagaggtttttcgtcttgcagcgtatgttccatggatgggttgtttattgtttctgaatcaaatttatcacccagatttatgttcttgcggccgttgaattggcagtttggcattggttttgatgggactcgtccacgccagcgcctacttcccggggtggtggaacgccaagttcgcataggcgatggtgaagatgggcagcgtcaccgtcaagaccgccgccggcgagataaggaagcagtgtcggttcaccaaccaggggcctgtttggggagcttaaaattctgagaagcagctagttggtagccagcttctaagaatcaaagctgggttttccagcttctgtcttgtagttcattagctggattctacaactacagcttcttagaatctaaaccaaaagctagactgtttcgggagcttctaattctgagagaagctgcagcagttagaagctcctctaaacatgtcctagtactaatcacgacgctttacatgcatgcctcaagccgagccagtgaacttaatttagaacaataattatctagattatgtgtcacctgcgataatatttaggatcttatgcaacttcgattataaaacgtgagatttcctaaaattcactctttttatatggtctccattgatcccacaacaaatttaatcggttataaaattacacggccaacctccgctagttttactaatacgactaactaaactttacttagacatgttcttatgtcatatataagggcatgttcacggctggagcctggtatatactagtaggcaatacacgtcacttaagattataaactatactcaatttctcaaatattataagagtatagtttatagtttttctattttctcatgttccctaccctatagtaaaaatttcttctataaatactaagagtctatgtttagcctgtgttaagcttaaatgtttgagaaaattctctctgtacccctaaaaattcatccaatcccttctatacccctaagatttgctcattcccttccataccccaaaatttcaatttagatcccttctataccccttccgttagttgaccattagttgaccgttaaattcatatcataaagtccattttaccctttggtatcaagaaaatataaatttatgaagtatattaatagagtgtataaatttattgtatacgattattatatttatgagtttattttgtgagatattatttaacaaaaataatttttatctcgcataaaaagatttatcttataaaaaatttcgtactactctaacaaaatatgaagtttttaatggcaaaaacaatattatttttttgttttatct

SEQ ID NO: 71093 - DNA, 21149 bp, Oryza sativa
gaatttgggccgagcccgaaagaaggaaggggaaaattattttcttttctttttattttaattgattaatgaactttgtattattaaaattatttattgagctccgaaaattcacgggaaattttcggagagtatattagggcacaaagaatattacaaaatattcccggccaatgatttttaagggaaaattttaattctcccattatttcacttgattaaattgctttaacttttatttaatttctagaaaatgcattatttaatgatttttaatcccgaacgaaaatcggggcgttacaaatctaccccccttacaggaatctcgtcccgagattctgggatggctagaaagaaagctggtgctggcgggcggtctgactgatctgcttacacatgctgcctctttctgattcatctgaccgattgctcgatgaaccaaacctgcataagcttgctgttctgttgcttcccataaactgacggaccgactctgattagtctgaccttgaccagaactgctggtgctcatagaacttctattttttttgtttggattgaattgctaatgctggcaattagataaactgaggattcactttgctgaccggggatcggtgtagttttcccaaaaccttgaaactgacttccgtaacccacagacaatgactttgctcgacctgctcttgattcaaaccacaagtattttcaggaaactggcttggtctgtccttgtctggattgcggctgttcctgatgctacttctttaagccaaacggttgacctggcctcaccggcgtaccttcgaatttaattagacaacttgggatcagtgttactctgctgacgccttgcagctggccctttcaagtactaaccaacttgctgcactgggttgaatctttaagggaaacggcaacgaggtgaaccaaaactcatctctgcgacctaccccccttacagagagtagtcatactttcgcgtgaccgagaacctttgaactgttgtccttgaaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctactcttgaccttgcatcgagctttgcatctcccgcatcaatacatccatcatctaatcttggacaccaaatgttgatcacgagcagggttcttctggcactgggataccttgtagctttcaactgaaccattgattggtgactttaattgagcttatctctgacactgaccatccgctgccaggacggaagagaggtggaagagaggggttgctaaagataaggtcttaaaccgattgcctactgatctgttgtgagtagacttttattgttcaagttgcttaagcaaacaacctagtatggtcgcatccccaccaatgatgcaaaccatacccctacacacaagcaaacaacacacgacctagcagctaacgaaactactcttccaggaaggattgggtttaggtaaactccgggaaaactccacttgatcttcgcagaacgacgactctgaactgatcttctcgctccttgcacgaagcttgaggcttgacttgacttccgaacagacacgaagctgacggtttatcctccacggtttaacaactataagaattggagggacagggaggagaattttgaaaaaccgtttcgcaaagaaaagccgaagggcgaggggagacatttttcaaatagggttttcagaaagcttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcgaacgtgcaaggggatacaaggaggggtttgtggctatttgcataaaggcggttgtaaaacattttattgagcaaaacagtaaaacagttgagtaattaaagtaatattgaatctccactgatcaacgctacaccacgttgaacaggcccaaccaacccacctgaactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgactagcaaaaccatgcacccacagcccaccattcagttgcattttagttggataattacgaccatgaagcatggccaggtgtctcgagcacgcagctcactctgatactaaaaaggtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatggattttagaagttttgagccattttaatgaatttctagaattaaactcgatttattgcgcaattattatttatttttacaaaggaaaaggccgtgctgacgtcatcaaaggggaggccggcgccgacacgcgggccccgcacgtcagcggtacaaaggggcggcgcatggtggaccaagtccacacgtggcctcgggtgcgcgtccaccacgtggacggcccagatcggcccgagccgatcggacggccacgaggcggcgcggctggggcacgggcgcggccgagactgacccggccggccatggcacggcggctacgcgcacgcggccagacgaccaccggcgacggcagcgcgtcgcggtggcgggcatggggagcggcggatggggaaaaaggagagggggcggtggggattctcaccgaggacggcgacggcgagacgaccacggggagatggccggcggcggaaaagatggcggcgaccggcacgggaggcgacgggaacggcgttccgacgacgcccgaccacggtggagccgcggccgagggccggcaagacctaaggaaaatattggagcggttagggagagaaataggcgaccggagcggtgaggagcggtggtttgagacgacaacggcggtagcggagctcgggtcgacggcggaaaggtggttgcggcgatgaaatggggaaacggagcagaggccgaggtagagcttggcacagcgttgccgccgacgcaaacgacgaggtgcggcgacgactaacgcggcagcagcggccggctgaagacggcggcggtgggggagagaggtggtgcacgaggcggcggtgttccagaggcggagaggggaaatggggtagaggccgggctgcggcacggcgccgcgaagccgacagtggtggcggattggcgcggcggtgggtggagcggcggaatcggccggccggagctcgccggaaagcggtggtgcacgggagcacggtggggaggtgtctagggagcgcggggtgctcggggagaggggaaaacggatgaagggaggcacgtgagtcgtttatataggtcccggagggggagaacgtggccgggagaggcggatttgaagggggaagaggcgccggcgacgtgggcgagtggggtggttcggcgccggttatggagggggaaagtgggggaggagagcggggtcgtgggcggcgaggtcccacggacgagcgcgcgcgcgtggggtggaggaggtgggcggaaactgcggcgtcgtggggcggctcgggcggccatggtggttgcagccggccagccagaggaaggaggaggagctgacaggtggggccgcgggtcccacctgtcggccaaagaggagagggaggccggctggggaggcaaagtagacttcggagaggagagggccgagcggcgagctgggccgagggagagagagcccgagagggggagggggaggaatttgggccgagcccgaaagcaaggaaggggaaaattattttcttttctttttattttaattgattaatgaactttgtattattaaaattatttattgagctccgaaaattcacgggaaattttcggagagtatattagggcacaaagaatattacaaaatattcccggccaatgatttttaagggaaaattttaattctcccattatttcacttgattaaattgctttaacttttatttaatttctagaaaatgcattatttaatgatttttaatcccgaacgaaaatcggggcgttacacgttgcttgatgggtttggcgtcttccttaacatgtaaagagtgctcaatcacctctctaggaataccaggcatatccgatggtttccatgcaaagatatctttattattttgaagaaaggtgatgagcgcgctttcctatttacaatctaactcagcgcctattacagcagtcttattaggatcagagggatctaagggaatcttttttgtcttagcatcactttcttcggtcttcgtcagcttggttgcaggcacttctccttcgcttgccgtggtcacagccagtcggatctcttctcgagcgagtgtgatctcgcgggtttgggccatctcgcaactttctttgtcacatgtgacggcctgcttgacgtcgctccatagtgatatgactcctcgaggaccaggcatcttcatcatcatgtaggtgtagtgtgggacagccatgaatttggctagagccggtcgtccgagtatagcatggtacgctgtctcgaaatcagcgacttcgaaacaaacgttttctgtgcgaaaattctcccgagtgccgaaggtaactggaagagtgatctggccgagtggtgtagctgataatcctgggatgacaccgtggaagggtgcattactcggctttaattccgtgcgaggaatctgcatatcgtccaaggtcttagcgaaaaggatgttgagtgcgctaccaccatcgatgagagttcttcggagcttgacattgcgaaccactgggtctagtaccagggggtaccgccccgggtggaccactcggtcgggatgatctgagcggtcgaacttgattgctacctctgaccaccgaagatattggggcgtgttaggttgaaccgcattgatctcccgttctgttagcttctgctttctcttagattcataagccagaggtctgccgaagatgtgattgagttctttgcgatggtcttgaaaaccagtcggggcatcgtcctcatcgtctttcttctttgatgtgccttgatctccgtctgaaggcttacgtgcggtcttggcatattgctccgcaaattgcttgtagacgaagcagtctttggccacgtggttggagttgggatgatgcggacattgcgagttcattatcttgtcgaaggtgttgacgcgggaacgttgtcgggaagatggagaggttgttgccacaagttcttcgggcttacgcttgcgatccttgtggttgttacttccactccctcctgtagtcggcgtgtccttctttggcttccaagtggtgcccgactgcttggatgcggtaatagcatcttcggctttggcatactcgttggctttttcgaacatttgcttaaccgtcctgggaggtttacgtccgaacttgccgactaggtcatcgtggcgaatgcctttggtaaaggcagcgatgatgacatcgtcggtgatgtcggagatcttattgcgttgctcggagaagcgtcggatgtagtctcgaagggattctccaggtttttgaacgatgttgtagagatcaaactgtgtgccggggcgttcaaaggtgccctggaagttggcgatgaagtgatcacgaagttccgcccatgatccaatcgtgccacggggtagaccgtggagccaggatcgggcggaatctactagggccacaggcagatagtttgccatggccttgctgcctcctcctactgcgcggattgcgagtccgtagacggtgagccaagactccggattggtggtgccgtcatacttttcaattccagtcggcttgaaactgactggccaatccactcgacgcaggtcattggtgaaggcagccactccatccacgtcgtcgtcgtagcgatcaggtgaatagcggtgacctcgtgctgcacggcgctggttgatcatgtcgcgaagatcgacgggatgctggtgaggcggagagtgaggccgttcgactcggcgttccctgtgacgttcgggaggcgagtgaacagatcgttcgccgtggtccctgctcctacgactggatcctgtgccgatgatgctgaggcttggttgatgataatcttgagatcgaagatgagggactcggcttccagtcggggtgcgggtacttgcagagttggccggaactgaggcagcgatcatagtcttcgtctggttcaagatgttgacaacatgatcagcttgattgagtgcgtcttccttgaggagggtgtcgaggagagtgattgctgcaaccgcgttctgctggggggtgcgaaaaaccgttgttccatcgatgtcctgttgcccaatgaggtctctcgctcgtcgcccggattccaaggcgcgctgtcgtcgatcttcagcctcctttgcaactcgctcgcgatcttgttgctcacgctgtagtcgttctcgctcttgtcgttgtcgttcttcctccagtcggcgacgttcagtctcttggcatgtgcgctcttggtccgcttctcgggcttggcgctgttcctccgtttcgttgtcagccatgaatacgccgaagaagaggggcatgtagttatcctcatagctatcgtcgaagttgtcgaggtcgccgtggtcatagtggtagccaaaatcgtcgtagtggaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatcatcaggaagtttcatcagtattgagggataggacccgtcgtcttgatctggtcgcggaagagtagattggatctcatccgagtggtttgaagccgactcgggagagatgatcttagagtaggtcttggccgagttcggaataccgaatggcacttggacctggtctctccccgactggtttgaatccgagtcaaggagagagatcttgccgaagtcattggtgatgaagttgaggctgccgaaccggaacgcctgcccgggaggaaaggcgaagtcgtcgatgccagaaacgaaacccatcgcacttagtcggcgagaacttgacgctacccctacctggcgcgccaactgtcgaaacaagatttcggcaataataaaagggggtggctatcaagctaggaaagtggatgggtttggagacaaggaattttatacaggttcaggccttcttattcaagaagtaataccgtactcctgtccggggatgattccgccgagtgtgttattgattgtataaactggaaaaaagaatcatcccgagaggaacccggacccctccttatataggggaagggatccgtattacagaatacagtccatatcctaacggaatatggaattacagataaaatacaattgtaaccgactaggatcccgggtattttcttgacatacaagtttagaatctaacccgagtcctcataaagatattctatctatatttggtaccgtatatccagctggaatataaccgccatgtagatatggggtaatcataatctccacaatgttgatataaagtttgtctccatctgatttcgtatgaaaaagttatgtgtatatacgtgttttttctaaaatttgctcaatgtctgcggatatctgaaaaaaattccggatagtttctgaccgttttccgattttgacggatagtacccttactgtattcattttcgtttccgagaaaaaatatccgaattcgtttccgaatccgagaatttccggatagttccgaccgaaactatccgaattcgtaaaatggtccggacggacggaaactatgcgaactagtttcaaccctacccgtacatagccatccccggcgagtcttccgagcggatggaggagcgagagaaggcctagagaagtagaggagaagtgtggcggacagtgggccctaccatttttcattttaatgcttaacactaatatgtgggttctacgagctgactcagccagtcaacggggttaaagatgccacgtggaataaaaccacctccgaaacaaaccagggagttgatttgcaacggttttaggagttaggggactggttatacccgatttgtggttgagggatgcagttcaaccagggacatgagttgagggagacaaaataaacttattccactaaaataatcgaccagtttttgggcctagcattctacctgggcttggctcccccttttcttctccaagattccatccgaaatctaatcttgacggcatcaggcctacatacacacgtaggcccgtggtccgaaacgtgatacctcccgatcgagtgatccagatcctacgtactccttgcgcccatttcgatccgtatgatcaatcgtccggccacctcactggaagagtgtgcgcttgcaagtggcaactcacatgcatcagtcatcatctatcacggaccattactccccatacacaccttgcaaattttctttgattttggagtttgattggagtagtttacagtggtcgtgaactgtgtcagtttggctgataccatctgccaattaacggttgttaattaattgcaaacatgcatgcatgtatgcaatttaaattttctggtctactgatgccgtagcgagcgataaactactactataagtctataacaaattcgaggataatggaggctagcttctgcactctaaacatgcatgttgtagtttgatctgtagaatttggtatagggtgcatcttgtaatcttggactgatctgatcactttttattgggacaaaatatactatatagaaaagttttacctagctgcgtatgaatcagctgtagcgcccgtaggtgtagcataattttacaccatactctctccgttacataaaaagcaaacagaatgtgatattctagtacaacaaatctgaacaagatatatcatattctattctatgttttctataggacagagcgagaactctgtgtacccttttttctgttgtaggcaggtccagcaatgtatcagtacggcatgtctcaacaagaaaagtgaagtcagggatgacataaacaggggaactgtttagctatagtcactagtgacatgaaatactctgaaatcttatagcgccattgtttcgcttattcatatgtttactggaatcacttactggcaaataaaaaatcatctgtgggaaaagcttttatacacatatacttagtgactcaaaagcaattgctataaaataaagtacgatgaaaaaaacaaattcaaaattaagttctaaaattcaaattctggcttataagcatcagcataattaagccaaacaatgagtaaaacttttgtttgcaataacgtgatgttaataagaatttatagaagtattcaaattctctgaaatcttagcaccttttcaaacaaacacaacagctccttcctagccttgaagtgcggataccacagtagtggtataaacatatccttgatgtgcggacatccttggtacacggccgagatatacttttttttctccaaaaaaacaaaatctttacttaacacgggcggtcgatcggtctgtgctcgatcaactacagaaataccaacatgtaattgttatctggaattaagcttcagatttaacaacttggagttcttgacgtgcaaaacagtttgctcttttcatctccatctccccatcttttaaaaaaaaaattgagaactccatctccccatgttacctacgtttttgggccgggcagaatttatgagaagttgcatcagtgctgagatagacttcagagagctcccccaaaattaatctgctgatacactgagacccatttgactctcatggcgacagctagttatcctaattaatcaatcccggaattattgtccggaatgtgcttaacatccaccccagcagagtaaacaaatcaatggcggctaaaacaaaagcttatccttccaatctgctcgcagggtgttcgagcttgaaatcaagcccatactccctcatgcagagtcatgcagtgagacaatataatacacatgctcacatgcgacgccggattaataatttttcgatcgttaattattttctccttaattcctagctccaaagtcagcgagcctcgcatgctagctgagctgttcttgcatgtgttcttcccgcgctgtccgcgcagacaaaaaccctgcaaatttcttccggattccgaccactagtctgtcactagctagctctctgtccatctgatcgattcggatttgtgctataaatggacgtgcaatggagagcttagccattcagacaacggtagtggagtgtgtgagtagctgaggaggtcgaccatggcggcggctagggttgcgatgtgggtggcgtgcgtgttggcaatggcggcggcgtgccaggggcggcttagggttgggtactacaagcggaagtgcgcgccggcggagtacgtcgtcagggccgtcgtcggcaacgccgtccgccagaaccccggcgtcggcgccggcatcgtccgcatgttcttccacgactgcttcgtccaggtacacagatcgatccgtacgtccatggcgatccatggatacgcaacattggttgccgcaattgatgacactgagtgacaagtcgttcgtggttgcaggggtgtgacgcgtcggtgctgctcgacccgacggcggcgaacccgcagccggagaagctcggcccaccgaacttccccagcctgcgggggttcgaggtgatcgacgcggcgaaggcggcggtggagaaggcctgcccgggcgtcgtctcctgcgccgacatcatcgcgttcgcggcgcgcgacgcctccttcttccttagcggcggcggcatcagctaccgcatccccgcggggaggctcgacggacgcgtctccctcgccaacgagacgctcgcgttcctcccgccgccggtgttcaacctcacccagctcgtcgccagcttccaggcgaagggcctcgacgccgacgacatggtcaccctctccggcgcgcacaccatcggccgctcccactgctcctccttcgccgaccgcctctcgccgccgtcggacatggaccccggcctcgccgccgcgctccggagcaagtgcccggcgagccccaacttcaccgacgacccgacggtggcgcaggacgcggtgacgccggacaggatggacaggcagtactaccggaacgtgctcgacaggaaggtgctgttcgactccgacgccgcgctgctggcgtcgcggccgacggcggcgatggtggcgcggaacgcggcggcgcgcgggaggtgggagaggaggttcgcgagggcgatggtgaagatgggcgggatcgaggtcaagaccgccgccaatggcgagatcaggaggatgtgcagggttgtcaacgagtaactgttaatttcagaggaggatgcatctagctacgtacgtgccattttgatttgttttcttcagaattcagaagcatgaattgtcacatttcaatattatttcgttgcttgattcgagatgatctggggcaaatgttgtatttgcacctgacggaattaattgtacgctccattagagatatgatcgaataaagtttttcagtttttagccagcctctccattctttctccagttgtgacaacaagtgtacttgtctggtcactagctagtgtataatctggcgaattagcaagggaaaaaaaaaatctgacaagcacaagctgtaaatttgactagtcgagcaacgagggcttgaacccgaaatgggcccaggacagtggagaagaccagcccataacttggcccattgcgctacggttgatgcggcccatttcgctccgggagggcctaggaatgaatctgcttccttctcggaatttcggcccagtcgcacgctctccccgtaaagcccgtacttcttctctctttttggcactctcgtctaatttttacatgaaaatggtcacacgaattaacagaactgctgcagagtctgccgataagtagatgttgtttattcatatacattattccttttgcacacgagtagtacaatacagatgagtatataaattagcaaaacgtcagcactttgctacggctaaaggaaaatatatcacaatatttccagaataaataaaacacctccttcctgaaatatatttctcacattttcttaatagagaatactcactttagtttaattttatatgtagctaatcatttagatttagctgttatacaatgtaataggtaaaaactataatgagaatagtggggtgacagatctagagatttttaaaggagtatagatatgagtatgactgcacgtccagataaagataattgaacctttggaaattcatggtgtttattcgtgtgatcatgggttacatcctgcttcgatgcaggatagacccctgtagcaagtttttcagctggcgcctgaggattttgcctgaaggagaccttggaatggagtcaacgaacaccactttcctgatcttcttgtatggcgccacctatatacatcatgaattcatccatgctcgatttatcagaactattcaaacggttaatgcagcgcagcaaggcaatctaatctgcattttagctctgtcactaattgaataatgatctccctatacgtatatatgtaccttgttctgtacaaaggaaatgacttcatcttcctgaagatggccgctgccttgtttcttgaccacatatgccatcgggatctcgccggcctccttgtcgggatacctgcaatgctacacttaattagccatacatatatatgcagagttggagagtgtgagctgtaaattatttgtttcacgttttaactctttatacacattttgtcgaaaactttcttctcctgtattagtactagaccacatgttttaagctatatttaataagactattttcttaaagtatttaatttatctctaaatccgctcaatagtctaaatcaaacagaacagtgtactgacggcgcgacggctgcgtcgtggatgtcagggtgggtggccaagacgtcctccagctcggccggagccacctggtaggcgttgcacttgatcagctccttcaccctgtctaccacgtacaccagcccacgcgagtccacgtagcacaggtcaccggtccgcagccaccgctcgccgccgccggagacggagacagagccggcggcggcgaccagggccagggcggtcgcctcctcgttgttcaggtagcctcgcatggtggaggggcctcggacccagagctcgccggtgcggcggggcgggaggagctcgccggagtccgggtccacgatcttggcctccacatccggcatgagccgcccaatcgagacgccaccgccgccgccgccgccgccggtgcttctctccttcacctccgtcgtcgtcgctgcaacagcgacgaacgtcatatccgtcgatgacggtggcatttccaccttgtcgatgccgttgtcgttgtgctgcagatcgcacatggtgacaatgcccgtcgtctccgttagcccgtagcactgcacatatgcatgtacaatatatgaaaatatttatgtcatgcttaaataacatttgatgatgaatcaagtcacaataaaataaatgataattatataatttttttaaataagacgaattgtcaaacgttgaataaaaagtcaacggtgtcatacattaaaatatagaattagtatattattatgtaatatctttggataaaaaattatacaataaccaaactctatataatttctatgtttttaaaagtaagtatcttagaattattattagccaaacttttaaatagtgtacaaacgttatgggcatgtttggtagtgccaaatcttgggcaagatttggtactaccaaaattttggtagggtagagttgaaaatgtttatttggattgaagccaaaattttctcataagagataagtttataggcaaagccaaatttatggcattggtagagttttagtagaggtgtttggtttgctacctaccaaaattttggtagggcaaattttagtagggtagcaaattttggtagggtagcaatctaaattggccctataaaacattataggagggagtatttataaccggatggaatgcatgtgtcgtcattgttgatttaacgtacaccagagatatatcaaggacatgaaaaactgtgaagacaatgcgctaattactctattttcccctgaagagcacatgggatgtgtacaccagtgccgcccaattaataatctattaattttgagtggtatttagttaacatgatgtcacgttcgtcatctgaaaatacgtctaacattgggtaaggaatgaacagtacggtgacatcaagcagtaatggtaaggactgaacagtacggtgacattgggtgaatatcagccatccatttcgagatggacggctctagacctaggtactacagcgataacctatagtacaaaaaatgattttaatcacactttcgctacagtgctacacagtacgcctgccacagtgctctgcccttttctctcactgtacatgcggcgctgtacttagagggtgtgaattaatccgtgcaagttcttgctgctacctctgttccaaaataagtgcagccataaatattcgtgttcatcgttttgatcatctgttttatttgaaaattttataaaatatatataaaaaaattagtcacacataaaatgctattcatgttttatcatctaataacaataaaagtagtaatcataaaaaattttcaaataagacgaacgatcaaacgttagacatgaatagtgctaaaactgcacttattttgagacgggggagtacaattttcagcttgtacgagtattttgctgaattgtaccgacctgttttttctagagtactagctagctactccagtacatatgtacatgggtacatttattgattcaaagtgcattagatcaagtaatgtaggactctaatattttgtcttaagatatagtagaatcacgtgatgatgagatggaggagagaagccacccctcacatatatgtaacctttacacaaactcttagagagatcgatgagagtaagattagagagataagagtaaaagaccaatgaattgaaaacaaataaaataagattattatggtatatcggggttaaatatttcacagataatttgttgtatgtactactttcaaattaattaatgagtaaataatgtagataaaattaaagttaatcttagaacttgctcttagtgtacatattaattgtgtcacgcgagcgtacatgtcacggttgatttagaacaggtattaattgcacatacaagtgattttgcctctcataattatattttaggactgaggtagtacgtagtaccgtaatagtaatgtactgcatctcactaattagtgcatcgctgaaattagataaccggacgaagtgacattgtgtcaccaaaaggaaagggtaattagacagccatcacagccctgagatgacggggaaattaattagctagctttaatgcaatcatataatcctttcatcctttggtcataaatatttatcttttagataaaaaatcgatctaataaaaattccggccatcattttttttcagaataaatttacaaaatatcataattgagcttataacagtatgctataagatttacttatatttgctagtagtaaatctcataccaataagtagttgcagaattagaccaagtcaatgttgcagtacgtatgaccgagaattaatgcaaattaaaactagttctttcatatatcttctcacaaccgagagagaataattaattaagggcggttcctttcaaactcaaaaagtaactaacataatgtcaggtatcagaagatcgaatccatcgattaccgagtgtttcacaagctagtggcgatttatcgtttccatcaattaatgtgtaaatattatgtcaatgatatagatcaaataatttatagccaaagatcttttatttcactataggtggcatagtttcattagaattgctagctaataaatctatatggtttaacgctagtcaataataaatgagagtttggatttatcgtatcaccttaatttctcattttgatttatttttatcttcaccttcatctttttattaacaaatttatgaccgtgtgtgtcttataacataagctagagatgtaatcaatttctattattaaaaatagatcaaataatatatataatgcgatgagcatacagaagagaatcacacttttctctctcaaaaaataagataatacgtaaacatggcaaatacaaccatacatcgtacaagacgcatcagagatgagaagctaattagttatttatttattttcaaagaacgagacagtattgatattaattagttcccacgcatcaaagtggaatctctgttgagtcttccatgcatttgtcacaaaagggatcaatgaaggttttgattcgatcgacacaaaaaaaaatgttttaaaaaaagttcaggaatgactagattttatgcaatttgcatattataaaacatcaaaggtcaactgtatagatgaatttatgcagtgacgaacataaactataataattataattaagacatgttttagatttcaattttttttttcaaacttatacttttccgtcacactgaactttcctacatataaactttcaacttttccgtcacatcatttaaatttcttcaaactttcaattttagcgtgtactaaacacagcctaagtaaaataaatcacacaaattaagtttactttatttttgcagagaattaagtgtagtcattagccgttgattaattagggaagcaactgtagcaaatagccaggtaggatacgaacctggccgaggttgaccgccgggaagcagctgcggaagcgcgccatgtgctcgcgctgcaacggcgcgccggacgacaccacctgccgcagccggagacgacgccgcgacggctcgccgtcgccggccgccgccgcgaccatcttcacgaccatcggcggcacgaccagaagcctcgtcaccccgtactcctccaccgccgccatcgtcttctccaccgagaacctgccggggaccaccaccgccgtggcgcccagcgccgccgtccccatcacgaacgacgagaagccgaacatgtggaacatgggcagcacgcagccgtacgcctcgtcgtggtcgtcgtactgctgcggcttctcgccgccgccgccgccgccaccccacgcgcgctccagcgacgcggccatggcgatcgcgttgccgtgcgtgctcaccacgcccttgctcctccccgtcgtccccgacgagtagaacagcagcgccgcgtcgtcgcggccaatgttcgccgccggcagatccaatgtctcgtcgtcgtcgacctctgcggcgacgtcggcgaggagctgctcgacgaggacaagtttgacgtcgggcgcgatggagcggagcttgggggcgagttcgccggtgacgagcgcgaggaaaggcttcgcgtcgtcggcttgccgagcgagctcgtcgggcgtgaggagcgggttggcggcggagagcacggcgcctagggagagcacggcgagcgagagcgcggggaagtggagcgagttcggcgacaggaggagcgcgacgcggccgcggcggaggccggcggcggcgagcgcgcgcgcgacgcggagcgagagcgcgcggaggccggcgaaggagagcgcggcgccggtggaggcgtcgacgaaggccgggcgggctcggcggccggggaggagcatgtgcgggaggatgtactccgggaaggagagcgcggcggcggcggcgaactgcggagggtggccgctccggtagacgcccgtggcggcgcagtagccggcggcgaggtgcaactccgtctccatcggtgtggaatagtcaatgcgttcagagagaaagctcgggtatttaaaatgagcgaataaatgagatggaaacatggttaacgattgaaacaaatcgatgaccaaattttgaccatcgaaattcgcaaagtcgatttttaaaacgtaaacaatttgatttggcccatttcagaaaaaaaaaaggagtttgatttcagataggaaaaagtacaccgaaggtcccacaacttgtcatcgagttacaaaatcgtctcccaaccacaaaatcgtctcttaaccaagcaaaaccggtcacaataggtcattagtggttttgacacaaaaccgtctcttaaccaagcaaaaccggtcacaataggtcattagtggttttgacccggttttagcttacgtggcggctgagtcagcgtaggccccacatgtcagactgccacatcatgagtgtttctctttccccctcctctgtcttcctcctccactctctctctctcactcctctcggggcaggccggccggcggtgaggaggaggtcgccggggcgaggagctccgacggccggccggcgatgcggcagcggcgcggcggcgcagctgctatggccgctacctctccgcctccaacgaacccttcctgctcgggataacgggccgcaaggtgctgcaggcgcagccccccggcggccgcgccaccgactcgtcgctggagtgggagcccgtcaaggacgacgctctcgtctacgtccgcgtcgagctcactgcctggaacgtcgcgccgctgcggtgcgcggcggagtacctggagatgacggaggagcacgccgaggacaacctgaccgcgcgcgtggaggcctacctggagcaggcagtgctccggcactcctgcgaggccaccaaggcgctcaagtcccgcgaggagctgctgccgcacgccgaggagctcggcattgtcagtcgctgcgtggaggccatcagcatatttacaagcgggtgatgaaagtcgacaaatacgaagcaacacagacacagagagacagaggcctctgcaagtctgaagctatacacaaactgataaattcgtacgcataaaaacacatccttactggcaaacgctgttggtttctgaagcacgagaacgacaggagaaacggaagagaggatgactgccatttctcggtaccactgccgtaagagtgaatttaaatgaagaacaaaacatggatcacttaacaagtccctttgccaccaccgcgcgctcgtcggccgcgtcgcgctcctggttcgacgacctcgccgtcctcgggctggacatgtacagaagggtaatggctgccatggcggcgcgcgccgatgtgaggacggaggctagggagagttgtctcgtgtcgtacgccaggggcaccatcaccgccctatcgaggtcgatgcggcggcttgcgtcggcgccggcgtcgtcagaggtggagcagagggacctcctggaggcggtggtcaccagcgtccccaccgacaagtgctcggggcgcgtcgtcaccgccaagttcctgttcgcgcagctgtggacggcgcacatcctgctcgcgttggacgcggcgctcgggcagaaggccgcgacgcagctggagcacgccacgctggaggacgtgctcatcccgagctactccggcggcatgaagacgctctacgacgtggactgcgtcgagcgtgtggtcaggcacgtactcgccgaggaagagcacggcgaggcaggggagtcgacctcagccgctgcaatcaccgaggagaagcgggggggggggggggg

SEQ ID NO: 71094 - DNA, 1569 bp, Oryza sativa
acacaacacacgttttggtagttagaaatattgaagtaatcaggcaatctctacttagaacatattttgagaaaatgttgcaaggatagtaccatcttttgagaaaatgttgcgatggtagttttcaaagtgtgtacagatcggtcaaaaataagatctgcaaattaagtagttgaataccgcccatcacagcatgtttttcaagaaacatatcgatttcatttaacttcattacataaaaggcattgacctattaaatgacatgtaattgcatctgcccatcaacacaagtgacatgtcaacaacaaacacagcagtcaaaattcccatcattcaattccccaaaattagcaccttacactaaatttctatcatggcaaaaaaaaaaactaaatttccacaacatcctacaacactgaattccacagatccaacaccatgacagttttatcagggaccagaagtaactactaaaaggactacgcttagtattatctgttctaaattaacatagagaatcatttctaaaacaagaacacgccaatcatccaaaatactaagcatatagcacaaattaccgactctgcaaccgtggaatcatagcagatatacgcaaacttctttcacggctatctcattagtcagaactcagaacaacacatttcaagaaaagtgagatcaagattaataattccagactcaccgccttgcgcagcttcttgatgagcgccatgggcttcctcttcagacccctctggaacctgcaagatcacagaaccaacggatcacaccagatcacacccgcaaaaaaaaagagcattcccgtaagggcaaatcaaatcactggcacgatttcatcacagatgcgagatgtgtgggcagcaacacaacaccttctgcgggcgcgcgcggggaagagctggacgaggtcatcggtggacatgtcgaggagcgcgtcgaggtcgacgccgcggtagctgtacttgcggaacgtcctcttctttggctgtgcgccggcggcgacctccgtctcgacttcgacgtccgcctgcggaaaaacgacgcggtcaccgacggagacatgcacgggggatcaccaacggaggaaagttcgagagcgaggaactcaccatgatgggctcggagcgcgcgggaggagctcgccgacgtcgcggaagccgaagccgaaggcggagcctggcgggtagggtttaaaggggagagggcgagtcaggtgggtaggttatatagtgcgcgtggttgcgaagcccattctcgttgtactgatgggttgggctgaatgatagttgggctgtgtggagtttcggctgggactaatttgccctaggaataagttcatctgaggtatgtcaacgaatccgattatctataatctatgttacctggatacagcacaaaagtggcgtatcagtatcggatacgtgtatggatatggatacatattggatacacttcgatacgtatcccagattttcgcgattttcagttaaataaaaaaaagatacctcgccgatacgtcccaagcgttcctgaaagggttaattggat

SEQ ID NO: 71095 - DNA, 12124 bp, Oryza sativa
gacctcatctgcacaggcgctggcggggatggcagggagggcagcgccccaatcgccatcggcaaggcggcatcggcacggcggtggagatggccatggccgccggcgagctcttcacgcgcgggatggaggaagaagaagagccaggggcatttccgtccgggatggcattttagcgaagacactctgattgaggatggtattccagcgaagcccgttttcataatggtattctagcgaagccattcttatgggatggtagatatgcaattttctcggcgcctgtgtggagccgagtgggagacgggagtagggttggacggttggtgatctagggtttttttagtaccgggcctcctagcctcctaggcctattgggccagttcggttatttcgggtatttcagttaaccgagcccaataaccgaaatgcccgaaataaattcggtcttttgatgttagggaccgaacagctacccggatttttgggtctcggtcttttcggttcggtctaattttgcccacccctaagcgcactcatcgccgacgcccacgctaacgacctcctacagccaccatcctcgcccgtgccataatactgttgcgcaagacagccacaatgcatcctccatggtgttgagctcctactcagccgtgtacagatccactcccaaggcaccaaatcaagagacatgagcactagagtcgtctcacgaccaaaatgccaatagatccagctaccacttacaacaagagccagttagcgccaccgtcaggaccccaacatggcttgctaccatgatcagggaagactatggggaggagactccatcgccgttatctttggctggcatgccctttgggtggcgtgctcctgtggttgtgaggtggagggtggggagggggagaaactggatacgggtgtgacagcaatagtccacctagatagtccggattataacaccatgttccgatcatctttcgagtctggctgtctctaaatccgatgaattgggtgtagtcgcacgttaccatttgatttacataagtggtattgggaaaagccacataagcaatttccttttcttggatcactctttttgtgtagccttcggtgaaagtaaaaaaaaaaagtggcccttagatgaaagttaaggttaccgcaaggctatgagatgcttatactgttataactcttttggaacagaattttcgaaggacttttccacgaattaaattagttcgtgtaaaaatccgttaaaaattatgcgttcctaagggtcaagactaaaaacaacgcattaggcatgtactagtagatgatttctgcaaactcaacagccaattgcaatgggaaaaaatattaataagctttcaatgcatcaattggtggcgcgggtgcactgttcaatgccgcctctgctcctcatgactgggagaaagtctttataaccgtgggaaggccggaaacatgcatgtacacacgacaagatttgcacttctcgtttttaatacagaaatgatgacgccataggcttccaaattatcaaacacaaatgatgtacgcaaaccagcccccaacataccaacgcgagaaacaacatgctatcaacaacggcgtcgtcgacaaaatgcggaggaaaatcaggtggagaaaaacaaatagaagaaaaaacgcacacggaacgctcaaatactataggccacttgtgcctcggctcacgttgacctgccttaggccaccgttctcaccggctggcaggctcgcgcgccattggttcatgccgatcacgtactatctcatcttcccactcaaattccacgtccaccaaccgccgcttcgcccttcgctgctgccgctgggctccaaactatttttaagcgcgtcccgcgtcgccagtgagccgcgtcgcgttgcacggattattgcaatcgatccaaacaatcacgtcggtcgacgagaagaagtgagtgatggcgtcgccgacccggccggggccgtacatgccgcgcccaccggcggtgccggagtggctgaacaccggggacaacgggtggcagctcgcggcggcgacgttcgtcgggctccagtcgatgcctgggctggtggtgctgtacggcagcatcgtgaagaagaagtgggccgtcaactcggccttcatggcgctgtacgcgtacgcgtccacgctcatcgtgtgggtgctggtcggcttccgcatggcgttcggcgaccggctgctcccgttctgggggaaggccggcgcggcgctgacggaggggttcctcgtggcgcgcgcgtcggtcccggccacggcgcactacgggaaggacggcgccctggagtcgccgcgcaccgagccgttctacccggaggcgtccatggtgctgttccagttcgagctcgccgccatcacgctggtgctgctcgccgggtcgctcctcgggaggatgaacatcaaggcgtggatggcgttcactccgctctggctcctcttctcctacaccgtctgcgccttcagcctctggggcggcggcttcctctaccagtggggcgtcatcgactactccggcggatacgtcatccacctctcctccggcatcgccggcttcaccgccgcctactgggtaagataagctctcgcttcctctaccatttgcaacgtacggtcggttggttaattctggtcattgcctggtcggattttcttcacaacttttggttgttcggtttgtcacgacccgccggggtttacttttccggtgcgcgctcacgggtcaggacttacacgagtacttgcacccgtacattagcagtacatgtgacgtgtggactttgtggtgaaacgttcggggcacgcggtcgcgggagcacggagtcgtcagcgcccggggtagactagtcacttgcgtgtattgatcgagtgagacgtgttttggacatggacgatggtgaactagtactatggaaagaaacgattcgatgtagcttaggctcgagcctaatttcctcgtacctgcaaaagtacatatatagacgagttgctagaaagaaaaaaaaaaaaaacagtgctggctcagcttgcagaatccagattctagaacagtacgtggcacgaatctcgacggcgttaagtgttaaccacgtgacggcgattaataaatactttttttgtgacaggtggggccgaggctgaagagcgacagggagcggttctcgccgaacaacatcctcctcatgatcgccggcggcgggctgctgtggctgggctgggccgggttcaacggcggcgcgccgtacgccccaaacatcaccgcgtccatcgccgtgctcaacaccaacgtcagcgccgcggcgagcctcctcacctggacctgcctcgacgtcatcttcttcggcaagccctccgtcatcggcgccgtgcagggcatgatgaccggtctcgtctgcatcacccccggcgcaggtatcagctgcttcctgctagctttgatcaattctagaatccaactagattagcaatttagtactactacactgtgattagccagttgccattcacatagtttcattaatgaggtcgttgaattggccattcgttaattaattcagttggattaacgaactagttgtgtgatggcatgcaggtctggtgcacacgtgggcggccatactgatgggcatctgtggcggcagcttgccgtggttctccatgatgatcctccacaagagatcggcgctgctccagaaggtggacgacaccctcgccgtcttccacacccacgccgtcgcgggcctcctcggcggcttcctcacgggcctgttcgccttgccggacctcaccgccgtccacacccacatccctggcgcgcgcggcgcgttctacggcggcggcatcgcccaggtggggaagcagatcgccggcgcgctcttcgtcgtcgtgtggaacgtcgtggccaccaccgtcatcctgctcggcgtcggcctcgtcgtcccgctccgcatgcccgacgagcagctcaagatcggcgacgacgcggcgcacggggaggaggcctacgcgctatggggagacggcgagaggttcgacgtgacgcgccatgagggggcgaggggcggcgcgtggggcgccgcggtcgtggacgaggcgatggatcaccggctggccggaatgggagcgagaggagtcacgattcagctgtagtggtggtagagtgggcattttgtcgcaggctttgccgcactgcagctaaactggacgttgaccatacgataattctcatctcgtacaggtagatcttgcaactagcaagatggagtagcagatattactaaacacatatgcttcattattttatttctggagtaaatcaagattcgttttggggtagtggtagatatttgcaatctgatgcagtcagtatgcaatgtgtcctaccctgggagtcccaatagataaacaaacttttgccagcattgcacacaagcaaacctcacggtaccatggtttcagtggaatctactgtaaattggttttgcttagttagcttggacaggtctgagaatatctcaaaactgtagagtacgcgaccgcacgtggacgcctgatctgagtctgaagaactgcagaagcaagcctgaagacaggccagtgcaaactgaaatatgacagcctaacagatcaccgaagcaattcatcacttgcatcattcgataacattgcacaggcagtgttagcaataggcgtcaaacttcttgcatatacacaacaatcgtgtgcctgtgaaaggaatttagatacctgatctcacaagttaacgatacaatgagaaaacgcaatccgaggctagtcgaattgctcccagtcggtgtttatttgtgtggaagaaacccgtggtgggggtgcattcaagctgcccatgccattgtcgaacgtctcccactgcgttgtcactgaaacagatttgttttgatcgctgaagggattggcatttcttgccttcagcttatccaacgtctccacaagaccttggacacggcgtacctgcaatgcaagtcatcgttattgtgagggtatgtacagcatacaatgcctccagtgactattactttatgacaacaaaaagattttgcaacagggaccaaacccgtggtcagatggtcatagcagcaacaattattcagatatattaccgtcaagcaaccaaaccaactccataaaattcaaaagggcaaaataaggattctttaaactgaagaaacaaatgaattttgactttattaatatgttacaatacatataagatgttctaccgattaagcttggctcaacaatgtttttgaagcaccctgcgcatgctgaccatttcactggtcttgttcttcaatataatagggcaacaaaaaagtgaggaagctacaaatagcatttcactcttgaccaacaaaggtcctaatctggcaaaattctctcgaaaccaacactaataaatggttataaacctcaggtctatcccatatcagaccaggcatttattaagtataagctccagcaggttttgcattagaagctggattcaaaccacacagccaagttaaaatagttttgtgctatactggttacaagcctaaggctaaatggaccgtcttaatgtggaactgctcaagccacacaactagttcattacccataaccaagaaaataatcattggagtacgggggaaggtcaaagtcaaacaaagaaactagaattagtcctggaaggagttgggagacacccttgtgatgcaaatgaagactataattgattcagcatagcagaaaatagctaaatggcaagctttctttactagatgtgccgtatgtattgtcttttcatggcttttaagccatggtcctataaagggcattaataagatttatcattacagggtagcaatgctacactacatggtaaggaacaaaaaaattccatcatcagcatagatgtatgttgattcatcaggaaaattccatcatcagcataggtgtgtgtggttaaattttagtaaataaaaggaaatcaggtttgagtaatagtatgtgatagctatttatcaacagaaaataaaccattttgaaagcttaggatgaccaatatttcagcaccagtactagtaattgaatttgtattatatgagataagccatgaccaatcatgttgagatgtataatggccactgtacctcagccttcctttgtgcccttgcttctccctctgcctctatgccatcaagtttcagcagctccatcataagaagctccgtcaagacaacaaaatctttatcctcaatctttctccctgcaaacacactcttctccaaatcacatacctggtaatagaacaaaaacaaaaaccgtatcagcatcaagatataagaagagttaatgtttaatggaagaggctggagaaacattattccttcaccttggcagagagtctgtcaacttcagctcttacacggccaacagcctcacaagccttcatcatgctctcatccataattactggctcggccctctgctctacattggcaggggcaggcttctcaagtagaagaagttttgctccatccttgaccccagctgtatgcaggaactcattgtcactcttctccttcccacggaagaagagcctctgcctttcaggctctacgccagttgcctgggtaaggacccccttcaattcaccttcatacaaaagagtgaacaattaatcctaactacatatcaaagcaatggaaaccagttccttctaaggaagcagatcatgatgtactgcttctgcgaactactccaaaaattcgataagagaaggcttctttcaaacgttgaactatataacattgagcttccatctgtacagaaaatgataaaatagtgtaaatttagtaaatcacacaacctcagttgagccagtatgtgcacctatttaacgtcatgaatgaacaggagtgtactaatacaatacaacggtacaacagttttaacgtcatgaatgaacagaagtgtacaaatacagcggtacaacagtaattcagtgtgggcctaatggtggacggatatagcatgacgcacagacatgtcgtcaaatatacacttaaaaactagtatatttttgtcgccatatacctaggtacatctgcttgccacagtccaagaggatattatagttaaaagagcaggaccataatccatctgcctgccccctgccacacaagcacatagtattgcaatgcttttgttctgaatctagatttgcatccaattcgattcacggaaaaggagacaaggacgatgtgatcttattaactcctcgacgaatcgccgggttgactggtcaagatccgtagctcaagtgcaacatagcagatcgagcatggtggtcgctgctgtaactaaccgggagcggcaattcgtcgtgcactttccgggcaagcgtttgagcttgcctacatcaaaaatactaatcgaaacataaccgatcacaaggcaccctcgttgcaatcgcccacggcgagtttcacgaggagggaggaggcgaggatcataccgaaggtggagtgcgccggcacggcgacgtcgcggaaggaggcgccgtgggagaccctgagcctgacggccggacccgtgtcgccgtccctgcgctgcaccagcatcccgccaggccggacctcccactcgccctccgcgtccctcccgcccgatctgcctcctccaacgccgctcatcatcgccgaccccagccgcctttatggcgcccctctcctccccccacacgaccccaccgattcggtcgcggcgaaagcgacgcgcggccggagggaggaagggatggagggaagatgaggagaaaaggaggatttggtggcgcgtggcttttgcgaagggtggaaggctccctccccgcggggttccttcccctccggagaagcaagaacagccgcgcggcagtggcggtagagcttgctcgcgagcggcagcggcagcgagattttgcgagagctgttttttttttttcgccaagtacaactttggattctcgcgaggccgcagggggaaacaaaggaggctcgctggcgtggaggcctcgtctcgcgtcgcgtgctgcctccgctgcggataggacgggagagttcgcggtggggtcggtcgacgcctcgcggggcgcgtggtttttgggccctcgtgacacgtttggttcgtgagaatgtgagatcgctcgcgggacggctcggtgcggtgcgccgcgtgcgcctactggtatcgccgagtcgaactctccacagcctcctcggactagcggtgcagataagtccacgattcggttgcagattttcttttttcaattaactcccatctgaaacctgaatttccacttgtacgtacaggataaaatctcagctttgttcatagctgccgttcacctgatgattaaaaaaaatgtggtactaacgaggagctgtcgtgatgtttggtgtgcctaatccttgtcttcgatggccaagggtaaacgtcgtaattaaggcccacaaaggcacaaaccgtgattacgcaatgatagcagactttatggtacggctaacatgatggtatggttgcgccgacactagatggtaaagtactgcaattagcggtagtaagtagtgtagtaccactacagaagtacagtactaacattgttaggattttgcagttgagatgtgggccctgtgagctaaattatgaggcccacaagacagtgtaatgtcctcgctgggaaatggaagcgaagccggaagcgtggcaaggccccaaggccggtggcaggtcggtgatagactaattaaattaattagtacttgacaaccatccttttttttaacttacggaggactgctagacagccatctgatgcatatgctccgaggaaaaccaatgcatgcatgtatatacagctagctagcccacatttacgttctcagaaagtaattaattccaatattctaaaatatacatagccctttaaattttagcagcatagctgatgaggacatcccacactattacccgctggcagagacgctaaagtcgagcggcgaccgtgtgagcctctgaataatcccacattgcttagcttgggaggaggaagccaccttaaaagggagagccacccttcccctattggactagtcttttaggaagattgggcatttccccgagtgggtgtgcctatgaactgttggggtccgggtaaccttaagttattgggcctcggccaaccccacctgggggcggaagggactaaaaggctgggcgggactaaaaatatctttagttaatattcttaccaagataactggaagccccaaccgctaagaatcctagtgaacctagaaaaagaatacaggcccagaaaaaattacctctttttcgagaacctttcagaagttctaaaagattttgactttactttttttgattctgaatattcttaccaagataactggaagccccaaccgctaagaatcctagtgaacctagaaaaagaaagctaagaatcctagtgaacctagaaaaagaatacaggcccaaaaaaaattacctctttttcgagaaccttttagaagttctaaatgattttgactttacttttttttattctgaaatcgccttcgccaactagatactcctgtaaaatagttggttagatacattaactttctattcaaaaagcggaagggaggggggcgggaagggactaaaaacatctttaagggagggggcggaagggaccaaaaacatctttagtcccgctttgaaatctaaattcgggcggctgggcggaagggagggggcgggaagggactaaaaacatctttagttccgctgggcagaagggaggggggctttgaaagctaaagtcgggcgggaagggactaaaaacatctttagtcccgctgggcggaagggagggggcgggaagggactaaaaacatctttagtcccgctttgaaagctaaagtcgggcggaagggagggggggcgggaagggactaaaaacatctttagtcccgctttgaaagctaaagtctattaaggaagggactaaaaacatctttagtcccgctttgaaagctaaagtcggacggaagggagctaaagtctattaaggaagggattaaaaacatctttagtcccgctttgaaaaagtctattaaggaagggactaaaaacatctttagtcccgctttgaaagctaaagtcgggcggaagggagaggggcgggaagggactaaatagtcccgctttgaaagctaaagtcgggcggaaaggagggggggtgggaagcgtcttgcttagcttggaaggagggcggaaggaagggaggggggtgggaagcgtcttgcttagcttagtcttgcttagctttgaaggagggcagaagggaggggggtgggaagcatcttgcttagcttggaaggaagaagggggattaaggaagggactaaagacatctttagtcccattttgaaagctaaagtcgggcggaagggagggggggtggaaagcgtcttgtttagcttggaaggaggaagccaccttaaaaaggagagccacccttcccctattggactagtcttttagggagattgggcctttccccgagtgggtgtgcctatgaactgttggggtccgagcaaccttaagttattacttattgggcctcgaccaaccccacctgggcccttgtttaagggggtgggaatgatgaggacatcctccactatgggcctcagccaaccccacctgggcccttatttaaaggggtgggaatgatgaggacatcctacactattacccactgtaagggcatcctccaatattaaggaagggactaaaaacatctttagtcccgctttgaaagctaaagtcgggcggaagggaggggggtgggaagctttgaaagctaaagtcggacggaaggaaggggggtgggaagcgtcttgcttagcttggaaggaggaaggggggtgggaatgatgaggacatcctacactattaaggaaggactattaaggaagggactaaaaaacatctttagtcccgctttgaaagctaaagttgggcggaagggagggggaggaagggggggtgggaatgatgaggacatcctccactattaaggaaggactattaagcgctttgaaagctaaagtcgggcggaagggagggggaggaaggggggtgagaatgatgaggacatcctccactattaaggaaggactattaaagaagggactaaaaacaattttagttccgctttgaaagctaaagtcgggcggaagggaggggactattaaggaagggactaaaaacatctttagtcccgctttgaaagctaaagtcgggcggaagagagggaggtgggaagcgtcttgcttagcttaaaaggaggaagggggtgggaatgatgaggacatcctccactattaaggaagggagggggtgggaatgatgaggacatcctccactattaaggaagggactaaaaacatctttagtcccggtttgaaagctctatcaaccgggaaaaaaattggcataagcggggtggttgcacgcggatcggatcaatacaatctcctcctctccttttttaactcatctcctcacagagtcacccttatctcttcctctccctcctcccttcctctcctcctctcccccctccctcctacccacctccccacctccctctgcaacgaagggacgcggagggccgggcgaggcagcgtggcgccgcgctggcggctggcggcctcgcggcggcggccgaggacgcggcaggtggcgcgcggcggctgccggccggcgtggtggcgcggcgcacggagggccgggcgaggcggcgcggcggcgtgctggcgcgctggtggcggagccggggacgtggtgggcggtgcggcggcggccggcgtgtaggatcgagatgtcgactagaggggggtgaataggcgatttaaagaataaataacacctaatcaaatctaacctaagttgctagtccaccgctcaaccacaaagccaccgcacgcccccttcgtc

SEQ ID NO: 71096 - DNA, 886 bp, Oryza sativa
aaaaactcaaaatcccttatattatgggacggagggagtacctaacagcccattttcctcaacggtatcggcatgtaaagactatatgtcatcggcccaccagccgatcggctatcgtttacaagattaattattttattttccttgttggttgcaatatcaaaccaactagtacgcccttgaagaaagcgagattttggacttgcactagagttatgtagatctcttaggccactgtgtgttcttttgcatcaacagtagttaagtgtcgagatacgtggttaaagagatgagtacgatttagattcgacgacgagttaagacagtcaaagcggacttaatccgatttttaataaagatggactgggctggccaaaaacaaaaccagtcttcggctcacatcgcaataccaacacaccgcatcgcatatttttcctcacctttgctcaaaactccggaaagaaaccagacgaaaccctaagaaagagagacgtcttcggctcttcgcccgccgccatggcagctattctccgatccctgggtcgctcggcaaccaccgccggcctcttcggccgccgctgccgcctccttagcgaggcagcttcagatcatcaggtcagttccgtcgctcgccatcttattctctttctcgcgacacagacccgaaatattttcgacgaaaattttctccatctcccccttatcttcgatctcccgcgcgttggggctccttcaatttcatatgggaaggaacaaatgggaaggaatagatttgtaggatcttgcttggttaatcaatttcatcatatgggaactagattggaggggatttgggaggtgtgcaatgtcacagaccaacacaatcacaccaaatctctcacacaca

SEQ ID NO: 71097 - DNA, 710 bp, Oryza sativa
gtttggctaagcatccacatttgaggctatttttttacatatttttccctctagaaaatgtgatggaagatgatgagagagaaagtgtgtgtagggaataaagaagattataaatacttgtttgaataattaaatataattttgtatgaaattataaaactaagctaatttaatattaaaataagaaaaccatattaaatatttgtttataatgtaattaaaacatgaaaaatatgtacaatgaatttaatagtaatgattaattgtatgaataattatattcaattattgtattattatgtaattaccttgtaaatcttggattttgtataattacgatttatatgtatttcatatagatgaatcggcaatggatatacgcggatcggtggtcgaaagagtttattgacggcgtgcattattttttgggtgtggccaatgataacaagcgtaacggttttataagctgtccatgcgataagtacaaaaaccagaagaagtattccaccacacaaactattcatgcccacctgtttcaatgggggttcatgcgtagctacaaatgttggacctcgcacggagaggttggggttgcaatggaagaagatgaagtagaagatgagaacattccggactcggctcagtatggcggatttgaagaaaacacaatgggcgaggcggagctggatgttaagggaatgatgggtacc

SEQ ID NO: 71098 - DNA, 546 bp, Oryza sativa
tgcatttcctaatattttttttagtggttctcgttcaaaatttattctagcgttattagtactgtacatctattactgtactaatggctcattttaccaacaaaagttttacaatattgtttagtttaatcttgctgcaatgaaataaatttagcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttctatgcccaaattcctcatgatcgtcacgaagagaagtgccgagtcaaagtcaccttgaacagtaatagtgaagatattccctcag

SEQ ID NO: 71099 - DNA, 20140 bp, Oryza sativa
tcttattaaaaaaatttgtgcaaaaaaaaaaaatgaaaagttgtgcttaaagtactttgaataataaagtaagtcacaaataaaataaataataatttcaatttttttttgataagatgaatggtcaaacagtgtaagaaaaaaaatcaaaatcccttatattatgggatgggagagtactaacaagctggagcactgcacaaattactgttttcatggggtcctggcagtagaattttgcttgtttttgtcattttcgttgttattagctcgtactgcctctaattatagacatgctaaaagcatgaaaagatgctctacttgtttaagtttaacttggttgtcttttcagattccttggatctgaaagtaggcaacagagaggtgaagaaaaggggtgacaaactgaggtggcttgctatggcagatcaggaccaactagtcctaatccccaagagaggcagtggttttgagcaccttttcaacgcagatgtagattaaagattttgccaccagctctttggtagcattattttcttcaagtagggaattaatcaaactaatgtgagcggagagagtagggcagtcttcggctgagttcatttcagcaacataaaacaacaattttatcgttcttcgttggcacattttatgaatttataaatagtatgttttgtaaacaaaaattatatataaaagttttttatgttcaaaatcaaataaactctcttttgaatttataattgacggagcgtggggctcctcaccgggagaccgcgcgggcccccctttgccggttcggccaggggcgctaggtgaggttctaagccctcgatctgtggaatgtttcgcgagagagcaaatgcgcaagacacgggcgatgtagacaggttcgggccgctgagaagcgtaataccctactcctgtgttctggtggatctgtgtatgaaggagttacaaatagctggagagcaagagagttcaaactctaaagaccctcttcctctttctctcctctccgagctccggtgtttttccccccctcttctctcttttttctcttaagtgggcaaggtcctccttttatatctcaaggggataccacatgcaccacttctacctactcttcttttgggtggggactcaccttatcttccaaaaaaaagtggcttgcgccttcgcctagaagctaaatcacagcttgtctttgagtgaggcccagcgtcatcactcgcctgacaccggggatctccctgttactccctcattaatgggcggagatttgccatggctgctgtccgaatgaccctccgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagttagcatgctggctccggctagggacgagtgcctagaggctctcattattccgacgggacggggcgaggcgtgcgaaaggccgcctgttgccacctaacccgcgatctgaccggtctgtgaccggtcacactgtgacctctcacggaccgaacgagtgtgctgcgctgcattaaatgcggcgtggggcgctcgtccaacccgcaataaacgcggttaggtgagcgccgctgtgctcacctaacccacacacgtggcgccaaacccgcagggggtcggggcgccctagccctcagggccgaaacgggagcggcccaacccctcggggagacagagggaggggcggccacatcaccctcgggcccgacccccccgagggggtcaggccacgtgggtgaccgcggctgccccaaacctctagtcaagatacccccggtcccatgtcaccgacaataatagttaatatgtaattaatcacgcggtagtgattcattctatgtttcgaacaacgaacaacttcaactgaaatgctccgacaaacacaaccttcgtatgaattgatacacgtatattaatatataattttattgcgaataaccagagttccctaaatacatgtggcttcatatttaaaacaaattttcgagaaactattggagtttcagcctaaaagggaaacctgtccaaatacttgtgcatcagattgtgcatcagatgattctatattgcttaacaaactgtacaacagaaaataaactaatcctaacttttcaaaaaaaaagagaaataaattaatcctaaccgagcctttttttctgcagtcagtatagtcacggactcaattttccgtcagtagccttctttgcaatccaatgaatacattccgttagcatcgcgccggcgccccactatgcagtaccaaaacagctccctgatgggtatacacctgtagcgatgttctgtacgttgaatcgtgcgttattcgccatccccattcaccaatcgccacctgaacgtacgtgaatcgcaccgtccgaaatcaaagcccgtttcttctgacacagatctgtgggagcgcggatatataaaagtgtcagcgataggtggggtgcagctgtgatgtgagggctgggttagttactaactttttcttcaaattttcaaattttatatcacatcaaaatttttctacacacataaatttttaatattttcaaccacatcatttcaatttcaattaaactttcaaatttaacgtgaactatacacacactgagctttcagatctgcgttttagagcaggtacaatagcaggctataagccagctgcaaacatattttaagtagataaatgaggagaaagaagggcggtgggctacagatttatagccagctgcagtacggactctaagacgcagtgtctgtatgacaggtggaaccatatattaatagtgtagtatgtaaatattgtatgaataagctattagattagctatagataaattgaagctagtagttggccatactgttgaacttgctcttacgggggccttccgcacacgaagattggatgcggacaacagcacgagcatgctgtttcaggaatccatccgttccacagttcccagccgcgtcgctggcgtctccctcgcgtgcccacgttcgctcgcggatagggggcgcgtacgtgcgcctcgaacgacgtgtggacgcgatggaagatgcgttctgtaccggacacatgcacgcacgcggcccgtgccacacaaaaaccgtctcgggctttgggcgccgcgcgagctggtgggagtgggacaccgcgacgatcgatgcaggcgattcgcccgggccgttcgtgccgcctgggccgttcctgcggccgcgacggcgtctcctcccgctgccttgctcggctccaccgtagcagcggcagtagcaacgggggcggaggagcagtgaggtgcgcgaaggcagccgcgcagtcgatggaggccgtgaagaaggacgaggaggcgagggtggtggcgctgcgggcggtggaggcaacgcccgagtcgttcgcgccgttcggccaggtcatcgccgccacacccgacggcgacgagttcggcccccacgacgcccagctcgacctcacccgcggcatcccaaggtcaggatgcaccacccccaatcttcttgcagttccacgaactaggaatacacgcgtcgcgcgggcacacgttacacgtagggcggtgatgcggtggccggtaggtgggacgggatgatgcaggcgcactgggcctgggtcaaccgtgaagccttctccactccactgatccactccatcgccaattcgccgtatcaactcaccaactggggaaaacgccgaagtcgaggaggggaggccgcccggtccgcgcgcgatggccatggagggggtgagggtggtgacgctgcgggcggtggaggccacgcccgagtccttcgcgccgttcggccaggtcgtcgccgcctacggcggcaagcgcttcggtcccaacgatgcccagctcgacctcagccgcggcgtcccaaggtctctcaacccacacgctgcctagctagcatcgatccatcgatcccgtctgcatctctggttcctgcacctgatttaggcgaaaggttcccacttcctctgatctttttttttctctcctctacttggcaggttctacatcatgaggttggagaagcggccgctcaagttctggacgatcacccaccacgcgagcgtgacccagtgcctcggctccatcggcggcgaagattggtacctcggcgtggccaagccctcgatcgtggaggatggggcacacgagcagggcggcgatgggaggaagcccgtgcagtcgcgtgctggccactactaccttcctcccgatccagctgaagtctgcgtcttcagggtttccggcgctaagtttctgaagctgcacatcgggacctggcatgcggggccgcagttcaaggcggatgcggtggatttctacaacctggagctcagcaacaccaatgtgagttctaagctgttgaattgaacttcgacttattagctattggttcttgcgttcagtaatactggaaaaaaatggcttctcaactttaaaaggtaggaatgtttttgtttgttccattttgctatgcacgggcgcggtgcgtttacgcatggccatacagttgtgtttgtttatatatgtcttagagcctgatacaattttaggaataaaacttattcaacttttaatttcaccaatccttatcactgacagaagtgtgtgatcttgcttgcaatactcagtactacaatgtttggatagtccagcactatgaaaacattcttttgagtaaatttcacaaaactacaatttagcaactttagtaaggtatttcgcagaacagcaacaacagaattttatcagaaagctataactttatccccataagttgtatgattgtatgtaggaattgagaagcatgagtacttcatatgtgtatgacacgccacccaaacttggcacacaaataagagaaattttacactacttgagaaagtaccttgaggtacctaaatttttgataccttgagatatacctagagttaccaaattttactatagaaaatatggtatctctaagtaccttctcaaggatggtaaaattaccccacaaataaagttgcagttttatgataaaatcatatactgttgtcacagttctctgtaatggctagctaaagttgtagaaaattgatagttttgataacaacagttgtagttttctgaaatttactctattcttttagaatagttttctatggtgctgtgggaaatactatagttgtgcctccttaatagatatttcatgaaacagtgcatgaaaatttcatctttgtgcactgtttacatcaaattcttaagcccttactcatcttttaggcattttggagagtttatcaggttcaatctggttgcatctgtgtatacagttcattgaagcagtgtgctctgtggttgcatttgtcttttagactaaagcagtttattcaatgaccgatttggcaatttctattgtcttcctagttaataaacttggttctgcttattgctgacttatatgcatgttttcgtaattgtattcttgccaataaatctagggtgccagtgtggtaataatcttctctaaatgaattattgtcagttagagttggaaacttatctggtagtctctgattgctggtgtgtccagaaccgaaatccacagagtcttgtttctgtgtcacaagaatggaccaactgaacctgccggttctaaattttgcgatggactccagatatctgatgcttgtctaatctaaaatgagttagtaattatctgctagttggaggccaatgacaggacccatattcctacttttgttagggtgcagaaataacaaggacattctttcgaaaacaactcaatatgttgtagcactaaagaaagtccaacaatctagttggtctgccaagtttggtggtcgtccctctttccataacttctgataagtgtctttcttttttagaggaacttttgtatacatgtcaattagtagcatatatttatcatcatctttttgggatgtgcagttatgttactacaacatgtcattgctaccatcagacttatgttcaatttttatttgacaaactgccatttctatctcgaagttaaacttttccttttcccccttgtgaacctttgaaaagggcagggagttcctgcaattcacctcgaagttaaactgagcatatggtgtttgtttcagtcataatacttttgcttatttcttttcagattgtcgaccacactacgcacgatttcaagaaagacgacggggtaacttttgtgattgaggactgagacacatttcacaacctaaggctgggtaatgaatatgctagactgtttgcatgtcttgtctgtttcctgagtttttaatgaacaatcgatatgcaaatgtgatgtacaatatgcacatatgagctgcttgttcaagtcattgtaaaaaacaaattaagaaaaaagaggcaaggggagtctctagtgggtacacccaaaagggcaaaaagccgtccagtatgaaatgatgttgctcttttctgaaaacaatatgaatgatttgagtcaataagtgatgtatttccagagagagaactatcagacaatggactttctggtatcgtggctgtcatactatgtttgtgcttgtggtgccgcgaaaaatcttactactcgagtattattgacataccaaaatctcgttatcaaggaagtgacattggacgcgcaattctgaacgcggagagatcggcagggggcgccagggggatcgacggtgacgagacggaacctcgacaacgacgcgccctgccgatccgggcagcgtttggactttttttttaaaagccccgatttggatcgatcgcggctaacgattcggccacctgtccgctgggtcgatccgtagtaggcgcttggccggccatgacgcacggcggcgccggcggcccggcctctcgccccatacccacggcggccgcacgccgcacagtcgcggtcatacgggcgaacgcggtggaagatccaggccgaggacgatggcgcgacgtcggcccccaggctcaaaaaaatataggaaaattattcgcggctttggcctccaaattcctctcgcaagcgccacgtttccccgacgtccacgtccattatccggcctggtcagagagaaaaccgggcacccatgctgattagccgctgcttagcaattgattatggattaattaacaggataatactggagtactagctctagctgctgctagtagtaatcagctgctcataaaaagcaatcgttggagaagcaaaagcgcacggcacgagggacgcccaatcctccgtgtccgttggctcaactcgaccaaacaaccgcctttttttttagtctccactctctccacttccccccctccattgccgccccgtttctctctctgatcggcaaaaaagtggatgctccggctgctcgaccgccatggtgaggtctctcgacagctacccctccatcaaagatgtcacctacaggttcgattctgcttcccctggtcgaaaaattggttcttggatcaaaaataactgccaaattcggttcttttcgtcagttatgctgattttatctttagtatgattcaccgagtatgtggtgtagtttccctaatttggatttagagggaatccaatttctgaagtgctgttgtctacttggcggcagctgcggatactgcgggtacgcgctgaacctgagctcgtcgacgcggaacacggcgaacatcgggtccaagtacgggaagcagatcaagaagggggtcgtctccttcttcgcggtggacgagagccggttcacgcaggccgacgaggtcacctgcgtgccctacttccactcgcggcgctcctgggggctcttccggcggaggtcgcggctgctgtgccggaagtgcggcggccgcatcggcagcgcctacgaggaggacgaacccgccgccgcggcgctgcccgcgtgcgacggcccggacgacctgcgcaccacgagctccgggagcagcggcagcgcgtcgagccagaagaactacgtgatcaagatcaacgcgctgcagccctcgtcggacgattctgatgctgttgcctttaccctatgacgattctgctgtagcctgtcatctcttccggcccggttgaatttgctgctgcagtcttggaattcgcattgggagtgcaaaaagggtgatattgcagtcaaggaagggatcgccatggcagtgagcttttggaagggtttgataccatcatgatcttgagtcacctttgctgtctgtagtagactagtagtgcttttcttttcttctgtgaattggtgggagtatacactggttgttaatttttggatctgttaatattggaaaatgacaaagtttgctgtatgtggcttggccctattgagtttgtaccatctcatgaggttcataggggttgcaattttgagtcatcttgctttactggtatgtcttaagtttctctacacggattcttcattagtcttctaagaaagcatgggttgttgcattgtgtcagttactgaatataaattctctgttaaactttaaattatagtcttttggttttccagaaataggcatgtatcttcagttttgttaagctgataaggtgaaaccataattctgatttctgtttatcagtgtaattttcctctggtgccagctcgtcaagaaatgggacttgggagcacagaatgaactcatgtaagcagggctccaggtgagctcatgttcatacaaagtttttagatataagtaacaacttcatacaaagcagtaactcagttgtatagcatggtaaagagcgttgtaataaccaagaaatatctgttctaatccacaaaatttgatatgcaaatagcaagatgaaggatcattttctgagaaagatgtaaaattgtaaattttactgctcaaagaatcactatcagtatcatatacaaaggagctctttagctggagcagtacaattgtcaggtttccctactagctagtaagaaacatacatacatttagtagagatagttgatatcatgttgtaataatcaaatcaaattaaaaaataatgtaaaaacactttagcactttatatgattgtcgtagtttactctatcattctgcttcaagtggctattgagttggcatgggtgtattctgcaagaagtgtctgaataatataagtgcttctcgaggccggtgtagtggtacctcatggcctgcgcctgctatagtgacgagagttaatcctttatacacttgactccaacctccaacctgcaagaggaatatatcatgtattcaaatgattcattctgacccagaatttgcttagaactgcaaatagtttttagtatactgacctttccgtggtcataccaagggtaccaattgaccatagttggaagcttaagagcatctattgagtaccttgttgcagtaacaggaactacagcatctgtatccccactgtgaaaaggagtaaagaaaatcacatagcaagttaagtcatctcactaaatgttagccagcacaatataatggattaactttgtagcagtagtaactcattagatcgtagtattgaatcaaacaatgagttgaagtactggactgacctgaaaacccatatcctgataccagctgcaatcaattcttggtagataggaagcatagatttcggggaatctgcccagtatgatccgacaatatcgctgtagaacagaccaaatgagtatatgtgtgtgtaagaagagcagaaattttaaggcacaattaacatctatatttattaaaacctgcaagttttccatgaatattgaatcccagtggtgttagcatgcatcgctatctgcacttctggccggttgtagtaaatacttgagtatctttctgtgcagggatcatatgctctggataaccaaggctgtggatggcaacatgatgttaggtacaaatagtatggccaacaattatctaccgatatacatatataggcatcaaatcaagctgaaaaaagacatgctaggcagaggaatgagaacaggaaaataaaacagcaaattctaaggttctgcaaagtacagtataatattgcagaaacatcaacccatgcactctatctgatctagatagggtgatataaccttttctgtattcaagaagtaccaaatgccacaataggaaataaacgcaatccattatctaaatatataacaaaataatctaactgaaatcagtaataacttcttaaaaaagaaattagttctagccaaaaggtatatttactaaacaataagtttattattgcatcttttaccacattatataatggatttccaaaaggtaattttcctcttttatgtgttgcaatgcagctactttcttattcttaatcagcacagttcaatgtgtttcgagtagtaaattcactgtttcatgaccatctaaatagatctgttataatgggtttaaatgatctaagtagtggaactagatctgtgcaacaaagtcaagagggtgatctaagttatcaaaagtcaatgagaaaaaaagaacacttacgtagcgtcctcccaagccaagtttgagagaggctgtattattgcagggctttgtatacaggctgtaaggatcgatattgccttcttctgaactggctaggttcaggttctttagacattcaggagaagggtgctcagaggactcaagcaagcatgtcttcttcaggttgtgataagtgttgtcagagatgaggccatgagtccaccaatactcaaaggtaccaagatagtcgtggtagtcatcagtaaccgcattacccacctaatttttcagaaaccaaaaaaattcagaacatacacatactcaaactagaacaggcagaacatggatttcagagatctaccatgaatcctttgagattaattattggattctgaatgcccttgttctgttcatagatgagctgggctaactggggaacgtaatgccctgaaagcaccaaggaaatacatccctgtaagtctttcatccaccaaatagcaagaacagaaaataaaataaaaacttatctcatgcaaacttacctgcatagctctccccagcaatgtagaactccctgtacttgtattgtgggaatctctccaaccagttcaccagaaatgcataagcatccgatgctacaagattaaaaaacaagtgacaagtaatcagtaactgaatcatggtaaatcagggcttagtggatagctcacagaaacaaatggcctcgaatttgtttacctgtcttagcatctcctgcgacgtacagatccaacgtcttgttcgagtacgagaaccccacgccggccggcgactccaagaacagcaaattcgccgctgcaatcaccaacagaaattaaaaacgaaattaatcaacagccagagccactcccagcactgccattgttagcagcatcacttgctgtaacaatggagctcaagaacaacaattgcaaaagctacgcacccttgttccaagaattggggttcaggtacagcgtcttcccgtcgggcctgatccggaacgggccgacctcctccgacgcgccgtacccgaccgacgagcaccccggcccgccgttgagccacaggacgagcggcgcgatgggcccggccgccggcaccgcctccaccagccagtagaagagcgcgcggccgtgcgcctggttgaccgtcacgtagccggagtactgcgagaacctcaccttcgccggctgcccggggagctcccggatccggtcgctctcctggtcgcccgacgccgcggccgccactgacactgacactagcagcagcaccagagccgcggccttgtgagccattacgagctccaaaatctccaatggccggaccacgggacacctgagcgtgccaagcaagaagccttgcacttgctcaagtacgcaacactgctgctgctactgaacaagatgagctataagaaatccagagctactagccaccaaaggaggccaggttgcttgcatggatttcagtgaggcggggtcgtgagctttgatccttacgccaccaccttcctgcactctcattgaccaaggacagctcaagaacccttggcaaccgctaaagaaatggaggcggcgggaggacggcggttgagctcattcgctctgaccagcggcgcgcgggacagagaggtagtgtgcggagattttctcttgctttccccgcgccggggatgattgattggcgcgagtacagctcagggacggaggaaaagggcggatcagatcgcgtactattggcacgccgaaccggatggattgcgagattaggtaagcggctgcgtgcgctacagatcgggcactcactggctcactgctagtgtgctagctcgctctagcgctgtagcgcagcgacgcggcggggcaagtgggggtgtcggcaactcggcattagtatagtggcagtggcggtggtggtggtggcggcggcgctggcggcgagcgagggcgcgcgtgtgaaacggaggtagaagaagctgaaacgagcacatgggatgggactgggagggaaacccccgcgcgcgcggcagcggcagcggcagcgaataacaaaattcgcggaggatgacgcgcgcgccttccttgccgcggcagcggcgtccgctcgtgcgcgcgtgcgcgatggaaagcggaaggcagaaacggagcacgcggcgcaacgtgattgagatcgtgagggtgatttgagatggtgaggcgtttgctaactttgaggcgctcaagacgggatttgcttacgagagacacggtgataatgacgagtcgtacgaaagaacgagcagtctcccagaagaacagtcaccaaactgacagcccgcatcattgcgtcacacgaagaaagcgagatttgtttccgtgagccccacatcagataggagtactagtagtactactctgttatcgatgctccattttaaaaattctccattttgaggaactcgtattacatgagcgcatgcaggcggtatctaggtttggcgtttggccccatgttgaggtgtcgagtgccgacgagctgacagcgtcgaggcaaaaacagtagaatagcatcgcagcatgttgcgacatcgagaaaggaacagtataatccctcctgcaggctgcaggaatcctaggtgattatcccataattccgggcgaagtggcaattccaatttcatgggtggaccgtggttctgaaacttcaccagaatcctagcatttgcggtcgaactccagaggaccacaagcacacaactacacattctcaatgctgcaaccagcaaccttggtagtaacaaatttgcagtaaagttcctgtcatgttctttgaaccggccagtggccacctagctgataaagtaaggcctgttttagttcctaactttttcttcaaactttcaactcttcagttacatcgtttaaatttcaatcaaacttctgattttggcgtgaactaaacacaccctaaaagaagaaatttctgccatttataactaactactgtaactgaactgactctcaaaattcagcaatgacaaagccagccgaccgcatatcgaaaggccagcaattttaacttgccaaatcggattcaggctcgatggcggagcggagtccctgccgaaccatcatctgcgcgtagaattcggcgtgttcctgttcaggcaagcaccaaagtagcaaaagaaaagttaactaaagctatagcaacatactactagtactagattactagtagcatgtgatgggagcgtgtgtgttgccgccattttcggttggtttcgaactaaaggaggcgggcgtgaagaggctgtggaatttatataccttcacggcgacaatgacgagcgcggcgcctttctgccgggacgcgtggaagagctgccgcgccgcctccgcggtcacggacggcaccacctgcggcaaggccttctccactgcacacaccgcacgcgtatcaacacaagtcacacagcgacgcagccacgcaggcacgcagcatgtttatgtggcattcacagcgttagcgatgcaggcgagattgttcagcttgcagacttgtaggttgcagcaatacaggttggccaggttgtttcgtgagaagagaaggatttgcgtaccaagcttctcggtgtggcgggcgtcgtctatgagcaaaactttgtagctgtcaccgcttccagagcccctcctgtccctcatccttccggtgtcccctcctgtgtatacagtcgtaaatgcgagttaagcaacactgcaaacgaatgacaaatctctctacaaaggacgcagaattgcaaaaagtacatcgttgcacataatcgataaatcaccttcttgtgtcacgggaagcgtgtcgagctgggactggtcgaaggccggccgctccagcagcgcgccgccgctgctggcgtgcggcacggccgccaccgccaccgccttcctccgccggtggctgactctttggtccacggagacgctccgggagaccggagcggcggatgcggtggtcgggaagatgagcgcgccgcacgcagctgctctgctactgatggccatggcagtggcaggcgttgtcatgtcggaatcggaagcagaggagatcgatgtatcgcgtttgatgcgcgcggcaagagttcgctccttgcgtgagggcaatggagggggagaggcgcacacgcacaattcgcaaccggtggaagatgtgagctttgttcttgtggcgatggtacatggcaggatttattcagggtttcagccaagaaagcgccaaaaagccattctgtcgtgtgcttgagagcatggtccatctgtgcgtactcggtagggcgaacgatctgtggctaagcatagctgacccggggaaattgggggctattttggattgaagccaaaacatgtccctaccaaaattttggtaacttaaatagtaaacgtgctagtttggattgaaggccaaacaattggtagtgtcgttgctcaatttggctatattctagaatcttcttcaccatgtatctatctatctatctatctattatattattaagacagctcgaaaaaaggcaccacgttcactgtggagactagaaattctcagattaatcgaagaaaaagaaaaaaaagagtccaaacagaaatacaatctgaaaaataactggaattcagaatttaaaaaaaggctatattgaaagaggagtccatctaaaaacccaatacgtgattaattaaaattcggaataataaataaataaattgttgaaattagaaaaaagaaaaaagaaagttcaagtaggaatacaaatttgaaattactaaaagaataatggtctagatttgttgtacacaagataatcatatcaatctaattatagatcatacaatccgtactaggagtccttgtccgtttagaaaaatcaattgcaaaactgtacagtatagagctatgattctaaaccaacatacattgccgcacatatatagggtggagataccagaccagcacgcttaggctgcagcagcagaaaaataatatagtgccctcatttcatacgagtaagaacccaatacgagattaattaaaattcaaaataaaaaataaaataaaatccgaaataagaaataaaaaaagaaaagaagagtttaacttggaatgcaatttaaaaataactgaaattcgtaataaaaaataaatattatttaaagaatacaccatctagaaaaatacgagattaattaaaattcgaaatgaaaaataaaataaaatccgaaataagaaataagaaaagagaagaagagttcaacttggaatgcaatttaaaaataacttaaattcataataaaaattaagactatttaaagaatacaccatcagaacactgtcagggttatggataccacatacctaatagtagttgactaaatctcggcaggatccaccacataccatgtactatacggaaacaacctgcggatataggaggagttccggataaggaaagacaaccagagttctacatggaaacgacaaggactactcggattgtatccatattggtttctttatttttacttggacaaggggacacctataggtataaatacaagcccccctaggaggagaggggagagaacatagacacggacaatcaacacacgaccacctcaatcaacacccaacacaatcgacatagaagcctacatacgccaagacacgccgccggatatcgacttcagggataagcacggctagtaccctgcggtgtctccggatactgtcaggagagacgaaagcgttatctctgatctcgccgggcacggattcgaggaggaaggctaccctgttgtcgactacgagtcagaacttcagaccgccatatcgacaacagttagataggctaccccaaacattgtactggtgtgattatggtgaataaaagcaacgaccggctccggccaacaggatgtagggttattacctgacaattcaggggcccgaacctgtataaaaatcctcgtctccgtctcttttacctcagtctcgcgtataccctagcaccgacgatcctcatatcatgcaaataccagaaccgcgacatcagacgtcgacaaacacataacgagattaattaaaattccgaataattaataaaataaattctgaaaatagaataaaacaactaggaatataatttataataaaatctatcggaacgaaaaatatggaaatttcaaaaaaaaaatcatctagaacacaacgatgataaatgataataaatatctgagaagcaacagggttgtaaaggagtagagtggtgacagttagggacatctaaaaactattaacaaaaccccaaatagaatcccaatgacaattaaaaggagtgacgacggacaggccgttaagcagcacggtcacgacggttgtgggatttctaaaaaattaaaaaaataaacctcaatgataatcacgttcgattttaaaatctcaaatataataaagagtgggaggaagtgggcgagccgtagaggagtaaagtgacaaagccactgacggtttggtgggactttagaaagtaaaaaattgaactcatacgataattatgtttgattttaaaatcccaatgacaataaagagaggaagcagcggatgggccgtagagaagtataatggcagcttttaatgggacttctaaaaataaaaaaaaatgaaaccaatgagacaataaactcaaaaaaactataagatccaaaatttaaaggttagaaggagaatgaatagaagccgtggtagatcgagcaagcaaacaaagaaagggtgaaaaaaaagtaagggatagcaactgatgtgacttttataaaagttataaaattagaaacatggggatgatatggtttggtctttcaaaatcttaagacaatgagatatgtattgaataaattataagtaaaattatattaaaaatagataattttgtatggtgttagccgcacaattacgcgggccacccagctagttatattattaaaggaatagaaaaaggagcctccacgttcgctctcatgacctagaaattctcacattaatcggagaaaaagaaaaagtagagtccatatagaaatacaatttagaaatagctgaaattcggaattaaaaaataaggaatattagaataggggactagagtccatatagaaataaaatttagaaatagttgaaattcagaattaaaaaataaggaatattagaataggagattagagtccatataaaaatacaattaggaaataactgaaattcggaattaaaaataaggaatattagaagtagagtatagagtccatatagaaatataattaggaaataactaaaattcggaattaaaaataaggaatattagaagtagagtatatagtccatatagaaatacaattaggaaataactgaaattcggaattaaaaataaggaatattagaagtagagtatagagtccatatagaaatacaattaagaaaagaatagaaattcggaattaaaaaataaggaatattagaagtagagtatagagtccatataggatttttaaaactaactaaaatttggagtaaacataataaaattaaaagtagagtttagaatccgtataaaaatacaatttacaaataactaaaattcaaaattaaaaaaatatgggaagaagattttaaagtcaatataggaatacaatttagaagtaactgaaattcgaaattaaaaattaaagaatattgaaagatgagtttagagtccacatagaaatacaattagaaataataaaaattcagaaataaaaataaataatattggaagaagagcatagagtctatatagaaatacaatttacagaaattttggaattaaaaaaatattaaaagacgagtctagagtccatataggaatatatataatttacaaataactaaaatttgatattaaaaataattaataactaacacgtatataaaatacaatatggatatttcacattagtagttttgtaaagttattgcaaaatttaaaattatgttgtcattttaatatattagtataatataatgagaaaacatatatgctattatatatgtgataatataatgatgctagccgcgtaatctgtgcgggccaccatggtagttatattattaaaatagctttgaaaggaggcaccacgtgcgctgtggaagctagaaattctcacattaatcggagaaaaagagaaaaagaaaaaggagagtccaagtagaagtacaatttaaaaatggttgaaattcgaaattaaaaataagcaatattggaagaagtttccatataagaacccaatacgagattaatcaaaattcgaaataaaaataaaataaaatccaaaattagaaaaggaaaggagagtaaaagtagaagtacaatttaaaaatagctcaaattcggaattaaaaataaggaatattgaaataagtttccatataagaacccaatatgagattaatcaaaattcaaaattaaaataaaataaaatccaaaattagaaaagaaaatgagagtccaagtaggaatacaatttaaaaatagctgaaattcggaattaaaaataaggaatattaaaagaagaatccatataagaacccaatacgagattaattaaaattcgaaataaaaataaataaatccgaaattagcaaaagaaaataaaagaagagttcacgtaggagtacaatttaaaattagctaaaattcaaaattaaaaataagcaatattgaaagaagaatccatgtaagaacccaatacgagattaattaaatttagaataaaaataaaataatatctaaaattagaaaaattaaaagagagttcaagtaggaatacaattttgaaacaactgaaatgaaaataaaaacattaaaataatacaatacgatattaactatttttttaaaaaaaatctgaaattataaaaagaaaaataagatttaaattaggaatacaatttataaataactaaaatttgtgataaaaataaagattattgaaagaaaagatcatttaaaacacatgacgagataaattaagtaacatgcctataaaggagtagagtggtggcggttgatacgagatataaaaattgctaataaaacaccaaatagaatcctaataacgactaaaaggagtgacgtcaggcaggccgtgaagcaaatgagtaaggcggttgtcgggacttctagaaagtaaaaaaaacaaaccccatattcaatttttaaaatctcaatgacaataaaaaggagaacagcgggcgaggtgtataagagtataattgcagagccgccgacggttgacgggact

SEQ ID NO: 71100 - DNA, 777 bp, Oryza sativa
gattattaatttatttcgtattatatcatcaacaattataaaactagtatcacatgaaagtattttaaaatacgaatctaataacaataatataacatacataatacttggtgtagatatcattaatgtaattattaataaaaactatcgagtttgatttttttcttaaaaataagaacatcctataatttgagacagggagtactaatcatttttcttggtaaatgtgtcaaattaggcctctaaaatcacaacccttttaattgaattctatgctccgattactgacaactcggacaacatacagctgacctttgaaaaagggtatattgtgatcgagttaggcccgtgccatgatgggtggttatccaatcatccaggttttgattcaggtcgtggcctgcaagacaatactatagttaagagagaattaggccctggtttgacatttctgatagccggcacacattttcttccatcggtttttcttttgccacgcgtacgtgcatgctgccggttaaaggcccgtttgcttctaagtttagggttccttttatttaataattttggttttttaatatataacatcattaactttttaagatatgtctcatcattcttttttattttataacttaatttatctttaaaacttctttaaaatgtttgcataaaagaattatataagacgcatagtcaaatgtaaatctaaaaatcaacgatgtcatatattaaacaatgcattggctccatctttttcattaatcattttgcaat

SEQ ID NO: 71101 - DNA, 1723 bp, Oryza sativa
aatagagtacaattattactctaattaataggcgaataaaatgtcattacagaggtagatagttcctctcaatcaataaagatctaagcaacggaaaataagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaaggataccaaaggatggcataatagggttccatttgcataaacagcatttagcaaacatttcagaatttaataaaacagttaagtaaaaattaaacaatattaatccaacgctatacaacataccctgttgtataggcccaaccattctggacaaccacacccgggtgtacaaatctaatctccaaccaggaatataccattccaaaccaggagctaaacaaattattaccagttatagcatcttttattatgatgagaggtttgagactaatcacgaaagacattgttagacccgcccataaccgcgggcacggctattcgaatagttttactctgatcagaggtgtaccactgtacccacaagacacaaccccacatcatgtcaccatgtgccttaataccaccacggtacctcggaaaggagttgtgacaataccccttgcataacacaatccactacagcgcacctttcctggatcataatcacccccttataaacaaggtatggactccccagcgacccccgtgggcttatctccgccacttctcagtctggtgccccgcaatgaaccatgctatataaaagataaagccgttgcccatgctggcttgtggttggcacggttaatgtttcacaaccgaaactcgtgaaccggtccttaattgccatgagcacgactctcaaaaccatgtgctcacaacccaccattatcaggttttagttagcacattaattaattaaccaatcatgattgtccgtcgtgaactatcattaagccatctttaaataatagtgaatcataagttatcccaatagtgtgctaatgtttctaagcatggctaagcaatcacatctaatatctagctgaaccaatatataaagcccaactagtcaagttataataacccaaggtatcaaggaataaaggaaccaataacaaaaaggggtataacaaacaataggttaattccacccaatgacattcgaaaataaatgcaatagttgaatagaaacagtagctttaaacgggatcaatacgctcaaagggttgtttgggatctgggtgacttgccttgctggccttgaaactcttcaaattcttctcctgcgaaaacggactctctggaaacgtcggaatctaaacagaaaaaagcaaaaacaccaaaacagcacataaacaagcacgaacagtaatgtggatatttttaacatgtagatctcaattttagaaaaatttagagacttgaaccaactaaatccgagctaagatgaattagttatgaatttttgaagatttaatcggattaaaacacttatatggattttaattgaattatgacgcaataatgaattatttttgaaaaggaaaacggggtttattgtgtcagcggctagggtttacggtggaccgggtgcacggcggcggttcacgggaacggacggccgagatcgatccat

SEQ ID NO: 71102 - DNA, 505 bp, Oryza sativa
gagctcggtacccacctgatcagtgcatcctttcacattgtccagggatcctccatagaccttaatccctggcactgactgcgccatcttttcattgccaccagcatgatccctacaaccacaaccacggattagttgggcttttcaattaccacttctctacatcgttgctaatgaattcagcaaaatctggcaaataatattctatgcatagaatgcacctgagagtaatcctaaaaaaaatcaatccttttaatgtatttgtgtttattttatcatatggtgcaaagcacttcctcagccgcatgctcagacaccgtatttctcaatttattataaaatcctaatgcaataaatcccaatctgcaactaactaaaatcactcactttctggtggtaggtgattggtccctgagggtgggattggggaaaattttggcacagcactgattgcatcccataggaaactctggaaggccaacatttgggcggaatttttccataa

SEQ ID NO: 71103 - DNA, 682 bp, Oryza sativa
taggagttggttcgtttaggtggcgattaaatgtagctcgtggcgatcctgtttttcgttcatgcggatatactgcgcggttccaacttgttccagaagatatacatcttgcttatcacgatgaagtctcattttctcggttttctattggagaaattggaacaatattaatttgagcatctgatgcaagccatacagattggatattgtaaactgtgtttaaatctgtgctaacagcgttgctctgtattaatacagtgttatagtccagtgcaattagcttaaaatgtagaatttagatagcattgagtgcccgtgctcgtattattagcaagctattgcaatagatgcatttatttatttatgctttggtgatattttctgccgtctatatatggaattttatgagtttggttggaggtcatgtggtcactggctatgatccatgctttttaaagaaaaatggtaaatatcctccttaaaaaggacacggttagatctctgtaactaaatggttctttacactgtgcaaacgaactcaacaactcaagaatgggttgtctatctggttaaccttttccttctctagtttttgagtatttattttaataggttaccattcctttgcccaggcttttgcctttcagtcagctgcaaaggccaagcgtctaccagcacgatc

SEQ ID NO: 71104 - DNA, 1876 bp, Oryza sativa
tcatctattatttctatattgcagtgtgcaaggcaatgttgtttgtgtatgcacgtaacaagagtgaaactaaggttgaatacaaagtgtggaacttctttcgttctaagctggcatccgctgaaggaaattgtggcctccttttttctgattctttttttattttgtgttctttttttcatgtaggggagcagctctggtgcgaccgtgaagttggcagcacagacgcatttcattgagcacatctttagcgttctagatttcttgagtgttctatattgtggccagaccaacaaggtatccatctggcatacagttttctcatttgggttaagtgattggactggtttattgtatcttgcgattttttgtgttaaaaaatattattcagttttcttgctaaaagcaatctatctcttctgtcatccagatgggaggcctcctgtaattacttatggcatcttatgttagtaggcataattatggaagaactggattagcatggataattaatggactacattaattggcgatggttttggtttagttgacattttccattttaagtataagtggaatgcatcattagggcttctatggacacttgagtacctttgcataaactagctaaaaaagcctgtgctttgcaagttgctgctatggtccatccttagtgtttattcactcaaatcttacagatgcacaagagtccaacttttcagttatttatgtttctgttctgtctcgatggataaaacttacaattttaacaaatatgttcttggttatctgtacttgacagaaataataactactactcttttcactttgatagctcttttctgcttctaaaaggtgggttttccatgaggagatcactattagaagctaattcagaggatttcagagcagattttggatgccggaggatggcgagagtgacacatttcagtaatcccctaaggttgctgaattttgttggtagctttatcttttcctgtgtaatctcccaccaacgctgagagctctactctatgtagttcctccttccaatgtataacgtgagttgaatgggttggatttaagtataagtggaataaattgttagggcttatatgagacacttgaatgctaatctgaatattagaacatgacagtgccttggcttaactatttgtatggttaaatatgaaaccactaagtaattttgctttgttgagttcatttagaaggttcggagggcggcctgtatcactattcactcgagcacatccttttcaaatgatatcttaggatttgcgggagtattactatttgatgtttctggctcaaactatatgcaaactttatttaattgattctaaagttagatttctgtttttgtggcatttcataagctagccaacatatattttttcagctattttgtcctttggcatatcaaggaattctatctatattatatggttcgtcgattgcctattctttttaaaggaaactaatgtgttatgtgtttattttgagttatccacatctaaaggagactgatgtgttatgtgtcagaattgtttgatgtacgtaaagctcagatcatataatttatttttattttttggctaacttgacgttttggaaattattaaagacaaataaaattggacggcagcatttagctcgggcatattactagtgagctgtaatttcatatgtctatcgcatagagtgatattgcatcagagcgtaacatcgtcctgttcttatcgcaatctcccgcggctgaattcatcgccgtagaaataatcaggtaatgttaattaatttaatccacagtacattttatgacttgacatacattatgtccatttataactatgtc

SEQ ID NO: 71105 - DNA, 938 bp, Oryza sativa
atttaaaaaaatttagagactttaaccaactaaatccgagctaaaatgaattagttatgactttttgaagattaaatcggattaaaacacttatatggattttaattaaattatgacgcaataatgaattatttttgaaaaggaaaaaggaatttattgcgtcagcggctagggtttctcggtggaccgggcgcacgcgacggttcacgggaacggacggccgagatcgatcttatccaaaacggacggccgagatcgaccgatccacggccggaccacgagagacgacgacgatgacgtcagcggtgacgtcaccaccggcggcggctcgggagcacaagctcgccggcgaacgatggcgcggcggcgcgaacgaagggcaccaggacgtagagggcgacgcggcgaactcaccggcgaccaaaacggcggcggaagatcaacgaacggcgacggcgtcgaggaagaagcggcgtcgaccttcggttacagtaaataagtatttcaattagagtgtaatgctactgtaattccagttaaaatttacttatggaacaaactatctgatggcactttttcttataatatctgatggcactttttcttttctatttctttctatttcaattagatatgatttgttttggtttttacatatgtactacttttgaagtatttgataccctgttttttgctcgaaaaatctgaaatcatcttgaaattgagattaaactgcattagatcatgatttcatatgaattttacattgtttctttgtagttacatgtattttcaattgaaattgtagtgttcactctatatatttgtaatacaagttcactgtaactagtttcattatattctattttgagacattgaacaaatcaataatgatctattatctgaaatcttcattttgttatctgatgatgagagaa

SEQ ID NO: 71106 - DNA, 24885 bp, Oryza sativa
cgctttctcggactcgacttgggcaagtgatcctattgatcgtcgctctgtcactggctattgtatttttcttggcacttctctcctcacttggaagtccaagaaacaaacagcggtatctcgatctagtactgaggctgaacttcgggctcttgccacaaccacttcagagattgtgtggttgcgttggctactagctgattttggtgtctcttgtgatgtcccgacacctcttttatgtgacaacaccggagctatacaaatcgccaatgatccaatcaagcatgaattgacgaagcatattggcgttgatgcatctttcacacgttctcattgtcagcagtcaacaattgctctccactatgtgccctccgagctacaagtcgctgatttcttcaccaaggcccaaactcgagagcatcatcggttacatcttctcaaactcaatgtggtagatccaccttgagtttgaaggggggtgttaaatatatatacaagctaatgtactgtatagttggcccatgtccagcccatcggatgtccagtccattggatcttgtatcttgtatatacttctctattgctaatactattgttaggttgcaagttagttaagatgtgtgaggtcacagttttatcatcactgtcaggcagcatccatgccaatgaagtgtgccaccaacaactccagcagcttatgcatgaagacgtgaacaagcatctgaactttcctgttcctccaaacaaatatataccaacctctccaaatttctatgcctgtcttgccaactttctgatcaatgacacggcatgcagcacgaacaaattaacaaaggaaaacaccaccttctgaaacttttctttgaccaaacacctcaccttcttggccggccgccggccaccggccaccggcggcggcctgttccggcggccggtagcccggctgtcactgtacccggaccagaagggattttcttgatacctgcacaactgtatatgtattctggtagctcaggaccattctgacagtaagcagcaagggatgttgccaacagcatctgttattaatacttctcacaaattgacaaccaaacagaaaaaaaatcttgaatttatcagttgcccatcagagttaggtactcactactcactcatacatgtatgttttgcagatgtgcattgccattctttcaggattctctgtggattgtggccattggatgatacacattctgcctcagcattgcagggtttattatctgcagatgatccagctagctagcaagcaggaaactgtgcacttctggcagagtaatcagccagtcaggtgtgtgtatggctgttcagaattatgcaaacatgttgccaatggggagagagattagctaagcatgtgcagctgcataatgttaattggatagaaaattcttaaattctccctctcatgtggattatatgccatacttatacacccaatcattgggcagcaatgccaatctcctctctttatgtgtctatgtgtgccccttgggaatctctgcagcaacagcacagatcacagccagtgaggcctgtaaagtcagtaaagaaagaaagaaaaaaagagagagagaaaccctatgcaatcagagatgcaatgctgctagctgcagctgcagctgctgggcttggctttgcatgccatggctgccaagagagagttgtcatggttacatccttttcactttcacttttatcatcatcagtagtagtactcatccgtaaattgctcttctttttgtacatcctttcaggtgttttggatggttgccaccccttcttttttttttccttggccttccttctccctccctttgacctttgttattgcaaaacagcatcggatgcgccgtagaaaagctaaaaaggaagccaatcaatcgtaatccctttctcatctggagcaaagatacgtgtaattctttatatattcagtggaggtggtaggttctagacttctatagatcacatgataagaacagtgcccacggcaaaaccacgtcgatgggtcactgataagtgggtccttatttgatgatcgtcaagcttccgaggtaaagtttttttttttcagtaagaactctgatgctcacggtgaaaccgtgtttatgggtcactgataggtgggatcctttttcaacgatggtcaagcttcaaggggaaaggattttgctagtaataactctgatgccgattttatatcattttagattatgaaacaagatgttgaacaccaagatttggtctttaaataagttggttgcaacatcatggctggagggaggatccttgagcttcaaagcacctggttggaaacatttgctaccaagggacccagcttcaacctccaaatggccaatcagttgccatgagtttatcattgaaaacaatgtgcaaagcctttgttcatgttggttgcagacaaacatactgctacactttgaacaggttcaaacttgttcaaatttgcagctgaagcagtgcaatgaatcagtgcaaatgtgcaatgcatcagtgctaacaggcactgtgctgcaacaggggaacacaacaagatccagtacagttcatgtcatttggctggatggagatccagacttgggctgcctccaagaaaagccggtaagagtgtggcatttgcctccatgacaaagttggattaggcagaggccttgacaaattgtcgcggcaaaacataaaagatggcgaaaccaagaacaggctaaagaacaacccaggattggatccatatatcccatgcattgcaggataagtgaatggtgctgaagcttcagttggaattgacgttttacaggctagctcatggtaattcaggaactttacagagctcagaaccagcaacctcaagcttacgttatgccactgctttcagcaacttcttcctcacaagaacttcagggttttggtcatctccttgacaagatagtattcagagagagctgtgacaaaactactatccatgataatcaaagcattcaaaaaccacatcgaatccctctccaaaaaacctacatcaaatcagcatgacagcgtatgaattgaagcccttcatcaataatgctgtttactgtggcagtgtggtattctttcctcctccgaaaggatgtagtcattcagaggaagttgcatgtacttttcatgactactgatcacctaagcacttcatcaacatgcgcgaagagcagcattatttgagggtaatgtcatatatgactccttcaagatttgagatggttgttcttgtcccatccacctctttgacatgcattccatgtttttcagcttccttgagcactagaacatccatgctggtaatcaatgagagcagcagtgtcttagttaagcgaacacacaagttatttttaaatgatctatcaacacttgaagtagtacaaaatcaattaaagttagatggagagtaaaataacccaaaaaaaaaacatgggatgacttattgagagttgggattgctccagattttactggaatttgttacgagaagctccaaaaggtcccaactaagtgaaagggacaacactaaatagcttaattattttttaccacctttctgtattgcagttttttaaacagtacaatctggacataccaagtattatgctggcagtatgtgcaagatgtcagtacagtaatcacattctggcagtaccaagtaaaatatccacagtatgctgctacctgttctagcccagttaattgtaatcaaactactgcaagccaacctgtatattctatttgctcatgaatgcaactggagtactggacaatcattttgcagaggacaatgaactgtcaggtgcagagtatctcaaacaagcgacaagctgacgagagaatgggtgacataacaccttgttgccatgaaaatctgcagaacttctgtagatctacatgtcactaggaaaaagatttgcctgtgaccatcctctctaagtactaattaacgctagatcatatttcagatgtttaatctgctttacatttgaatccatcagatcaatatattttggatgcagcattttgattatttggtgctattgatgcactcctgatttcacttgtatatatctttgatcagttctatcatgactactcagctacctttcatactaagatattcattattccatgtgtagcaaacccagacctatagtacaagcaagttaatcggtatattaaaaagaatcaatagctaagtcagtccttgttcttggtagacacaataaggataccaccaataaaaatgtacctattccatagttttatcaataaaaggtacaatcatttatattttgatcagaaatgagacacgcattaaattggctttcctaacttggaacagcattcgggtacacgatttcacaaaatattagaaactctggtaaaatatgctcggacaggaagatgatgagttattgagttgagaaaacacatacactttagctcgtgatacataagccaatatgaatctacatttactagcctgaatacgaagaagcctctctacagtatcaaagagacaggaaatgctagattgctgaaagctttctgcgagtcaaggttcacaaaattcacaagatgcaacaatcgatatacgattatatgtcagaaagaatagaaagagaaaggatcagaactgaaattaaatcacgggaaagtaagaaagaagaaatcacagcaaagtaagaaagaaggatataaatatcagctccaaggatgagatcaaatccagaaggatgtttctcaatgatattgcttatatgaacatagtttccccactctagcttctctgctgtcaacactgcaacaaaagtatcagttctatttgatatctggaagatttatatttcagtgattcacataatgatgaaacataattaaccagaagttaagaagtggtaacctgcattggcattcccagaacatgactgcatctctatattcttctttataatctgtcaaacaatctttggaataaatagatgcaacatttatatagaataagtagatatgcaagtggcacaatggaatcatccttgaatattttataatgtatgactatgacaccactttctagaatttgaagataaagcagctgcaccgaataatatgtgaacacaatgtgaaagtctcaatatcttctgtattttgtcaaactaagtgacatcactggaagatattcgtaaggtttgaagcttgcctctagaacttcatcattgtgatcagtcaagacaacttctttgcaaaaacggctgcacaatatgccagtaatgcctgaagcaagtcacaagctcacaatactgtcagattttccaagatcacaaagtgaagtaaacatgagaggagaatgccctcaccaaccccagatcctagctcaattattgaatgatccttcacagtctcaggatgttcagacaagtaggtgttcatcagaactgcacctggccatactaactgtccagtaagatcataatcagctgccacaaatcattagaatgtttgtaagtgttggccccatgataaggaaacagcaaaaatctggcgttatgaagtgcaatgcagcattgtgcccagagcaaaaatacacccaaacaagttaatgtactgatgagaggttctagtttgtaaataagattgttcatatttgtccactgcacaaatagaaataaacttgagtatatcatgctcagatctaacttttgtgttccacggaagagctatctccagataaatgatagattgatagttactatgttacacaaagcagcatagcctcctggttatagaagcagacatgaaggacagaatgaaatggggcataagagttacatgacgacatatatgcacaaaatgaaaaccccgccattttgtttgatcctgtgaaacatggaccattcattgtactgacgtactagaatgacaatgtctgagttggaagggttcccaaaagggacaaggtaaaagtggtcctaaaactacatgattggtgtaatgaaaacccagtttgctactgcccaagcaacaagaatatatgaacagaacgtatcacatcttccagttgaactcatatgtaacaccaaattcagagatgatggagtaatctatagatggtagatgctatgctatgaccttaattcatgatcatcaagctaaaaaggagtggagatactaatttagtatccagtaacagctgattctgtaaatgaagccggttgaatagaacagcgctgttctacatagacttcttcaccaaaatgacaaccatactgagcagtataatgctcaaccaactatgctttttttttttttgcctctaaactaggctatcttagcagtggtttcaggcttccagccaagaaaatttcacccagaacagactagctaagtagaaattaaccatattttgcatcacaattgggcataatagagcagctttctggaaccatttccacatcaaagataactatacctctacacttagcaagaaagaacgagtaggagcaggaggtactaactggaagcagcgcggaggcagaggaggtggagcacttgcgagccgaaggtgaacgtagtcgtctcgtagcttccctcccagatcgacgaaccccagcaacaaatcgggacaaagcttcagcacacaagcaagccgatgcagctcgaccaaacaaaaatcagcagagagcgaaccagcgaagcacacctgcggtcgacgaagaacgacgggtccagacagacgacgtcgtcttcttcctcctcctcccttcccttcttcccttcctctcgccgctcgctcgcgctgccggagtccgccatcgccgccggtgactgcaactgaagtggacgtggcggcggcggcggcgagtcggcgacccaaaccctttattcgctcgtgggctatacaaaggccagagtcatgggctcataatcaagttgggcccaaactcgattacacaagggccaactaagtaataggcattaaatgacgattttgctatatagtgatttcctatatttgtcgcaattttttttctaaacaattcacacatgtaaatatattataatcatagtgtaattatattatataaaaattatatgtaacttttatataattataaaatcgttaaatttgtttcaaggtttatacaagcaagcaaggaagaaatgacagtgcgcgtataggtgagggtattccgtcacaacttacaagacatacacgcttcatggaaatagtatgctactacgtatcacttatcacaggatctttgaaaagttacatacaatttgtattataattatatacatacaatttacaaataattacattgtattatatttacatatatcaatttttttctaaaaaagttttatgacaaaatgtattagctggtcccttaaatgaaatgggccgtggaggtgggccggtccagtaggagtggaacgttctagagggccctggagaggggcaagcccgtaaattcgccgccgcgtcgcctccaccttaaaaccctaaaccccacgagcgcggcggaggcgatcgaagagtgtagaacttttgctcggtcttttttgcttgcttcgcaagaagaagaagaagagggcggcggcgatggcgaggcggctgatcccgtcgctgaaccgcgtgctggtggagaagctggtgcagcccaagaagagcgccggcggcatcctcctccctgagacgtccaagcaggtttcccccacgctgttcttccccccctcgatctctcgtggtgctactgctgcttctccttgctgcttcgagttggctgcgagtgtgatgcgatccggtgaggggaggggagtgtttagatcttgttccatgcgcgcgcgcgtgggggttaagttgggagcgtggtgttcttgcttagaatgtttgatttcgattgcctcgtttagggtgctgatggctagggaacaatttgttgaaattacttgttcgaatgatgcatgattgtgcttagcggggtcagattgcgtttttgtaggccgcaaactgttaatacattttgcaattgtagtaacagaaatttggttatgcctatgtcattagtctctcgtaaagaattgattttttctattatttgcgcttttggattatataatcatgctggattgctagttacactgttactgttttattacactagttgcatcaccttgctaatgttgattgtttaactctgaatgttccgctgaatccagctcaactctggtaaagtggtggctgttggccctggcgaacgtgacaaggatggcaagctgatccctgttgctctcaaggaaggagacactgttctcctgcctgaatatggtggactcgaagtcaagcttgctgctgaaaaagagtatgtgaactatctctccattgcttcacttgttagtgagaatgtacctttcggcatattgctagggcaatgtaattaccactcgttgcatactatcatagatgatagatcttgtagtgctctcatagtacaataatgtgtatgagccccatcggttggcctaataagccaaagcaaaagcatatatttgaattttcaaacttgaatttgaagttgattttaagatattttcaacgtaatttctttttagcattggtttttaagttgctaggaacaaatatataaaagttttacctataaattaacttttattccctaataagggaatatgggcaaccaatgaggctctcatgacctctatcggcagcatgctatagcaccgttgtttatggctaccatgtacgaagtagtaattactctctccgtttcacaatataagtcattttagcatttcccatattcatattgatgttaatgaatctagacatatatctatctagattcattaacatcaatgtgggaaatgctagaagacttacattgtgaaacagaggaagtacttgtgagtgctacagttaggaattgatcgaatacttggtggtggtgttgctgaagaaccgggaaccacacgtgcttcctcgtttaggctgctttcttctggtagttcaatatttagaatgcttgctgttgctagctattggttgaacgttgagtgggaaaatgatctattatgatgatttttgttcatccaatattctgtatgttcctgatagttatgctgatactgttgctgtcagtatatgatataaattatgttttaccattgctctaataatctttgcatctggaattccaggtaccttctcttcagagagcatgacatcttgggcacccttgtggactgatttggatcgtcatgaacgccatcagtaatcagttgcgctaatgcaaggcatgtttttttagtattggatcgacgggacacaatcctccagacacaactgtcttttatgatgtcgtagaattttggctaagaacatcatgaacttgcaaaagattgttgcttccttttatctgttgcgatgaaattcagtaaacgttaacgcatctgaagagcctcttcctttttaatctgctctgtcttctatgcatgtttgtgttctctgtgtgctggttggatatgtgtcgctgtgacccgagcttaatgcggagagatcgataagcggatgtgactatgattccctcgttaaatagttgattgattgaattatataaccgctttcatcccatttgattggggaaataaatcgcgctcatcgctcatctatcttggatgaaatagttgattgaaccctcttcacctcttatgcttcaggctgttgaagtcgtgaattatcgcatgcaactttgctgtaacaaatgtcatttcaaaccaggatttaacttaaattacaatatagtataaatcacggatgtagtaaactaggatatgtccatatcccatcaggctctaggttgctatattctgagacggaaggttctaggttgctatattctaagacggaaggagtatgtggttttgtcatcttttggaactatatttttcaccattctcattgtaataaagtttggcagaacagacaaatatacttctagaacagtttcaggcattttcattctcatgaaagctgacataaatccaatcacaaaaaaaccgatcagttgattggaactgtcgtctgttcgggaggatgtaataatctgaaataatgcggctagctcatgtctattgatattatcgtctatcacaattagcagaatcatacaagaaccagcaatcagaattatcaacagcgccagcacgccgcgcctcaataaaatccctcagtttggcgtctgcagatctttgaacaatatctggctataattcatgatcgtttctcataggcattcagaaatctttgagcagcatctaggttcagctctttgtaaacctggcacagagaacaatatcgtgagatctcaaggcagttttgcgtggtggtggttattgaagtgatggctgggagtcaagtccatacaagtttcttatgggcttcttcaaatgtcttgcagaacaactctgcctttgttgctccaacctgagacagtaaccaataacatattagtgcgcaatcagatcggcctgtttcaaggagagatgccactgagcactcaacagcgccattccctcttaaccaacaaaatatgtaccatacagcctcaaaaaacagtgcatgtaggatgtagcttacagatgtactatttatatttaccagctttaattgatggacacctcaaatttttcaaaaaaaaaaaaatccaggacagccatgctcacgatcattttgccaaatatttaaaatctcttaccaaagttcttaaccgcataacagcagacttttatgacaaatcgcatccaaggagatctttgatttattccttactggtttacttattcatataaccgacacatgatattaaacaatctttttgaaacttccatattatactgagcaggtagttttgtgaaacaaagtgaaatatataaagaggaaatcccacctttttctcagcaaccatcttcaattttttcatgaattgatctgagaaacatgcaagaaaattcatcaatatcagtatatgtaagctggtattctttattgaagggcagcatatgagaaatacatctacaactgcaaccaaagtcttcatccccttatgcactgttcatgcaagtcccacaggaagtaactgacctcaactcaagtcatattacaaatatcaccaagctactgcactagagaatatatttgtctattctaaaaaaatcaatactaccttcatccccaaatgtagctattgtccaggtgcatagctagaaatagctacaatttgtgacagaggtagtattattttccaatcttcatctccacaactattttgaagatctattccttatgatattcaaaactgcacattgctcagaacacagcctttccttatcatttcagtgagatacatctatagacttctcccatgagagggacttgtgctgcaagtatctcatcaatttctacaaccttgtgccaaagtgtacttaagtttgaaggccacaaaaaagatcagtttgtgcgagtgtctatttcaactctttgagtgttctggttctcaattgaatactggtaactcagactgttgttacagctcagtttagccatccaggaaatcaagcttccatatctactccctattaatctagtttggttatacacagcttcagttgttcaagtcaagaacaagaaaatcctaaatggggaattcaatacctacctgacccaattcataaagagtgatcaaatgatttctggacctcaaattgaagagaaattgatatgtgctgtgaataggagtccagcaacatgccaagttgatcattaatatggaattaagtcccatggaagtcatgagtatgtcatgtctaaccatggagaatgaggattgtggtgtgaaatgacaaacccagggcctcagaataaaggcccaaggctagttagcaattggaagaagtgaataagttccccatgggattcacatgaacagggatgaagcaggaagagcaaactttatggtagtgacacaggacgtcattccagcataagaatataaagttaaatgggtattgcaggtttagttttctgctgtaataattggtaagataagattaaaagcagagcaatcaaatatttatcgataagccttcagtaccagatgactcatttttgttgccccttgttgcctcctgcaaacaatagctttgttagaaataattacaaaatacaactaggtagcatttagatagttaaattagttcatacacacctgagcccgtgattgctgtgtgctgcctttgcttgatgcccctgattcagcctacatccggcgaaaaaaatttcatcagttcatgaccatatcacgagatcgtcaaacaggaaaacaagcactgaccatatttacttcagatcattcttcattgaagcattgcccattgatgtttccatttaaatttacttattattgcagcaaacattgttaccgttcaacccagttttctatttatgaaaatgagctctaccatctagttctctctcaaccatagcctccaactcaatgttatgcagagagaaacacaaacatgcttgcaaatagcctgttaaaagttattcctaatattaacctacacacttcaaggggctaaaattagtgtcactaaaaatagcctgaccacataaatggcatgggaaacacaattgcatggctctgtaattgaagtagcatggttatattgagatatgaccaacttagtgtatctctagcttttagaaccatctgaagtacagaaataaaaatcctacagctctacatcttcaaaagaaaattccagatgtactgcattctagcatccttatattgttaaagaaaaaaaaagagttttcctctctctatctcattttaactaacatcactcaggcaattaccagtgcactatcatctctacaacttctactgcgcaaacaactcaggctagaagacaggttcatgacgcaattcgacggatcagtataaccaaagtgagattatctcaacataatgcgtaatccagtctccacgcacatcagcccaaggccacaaatcaacagccacccaaatcaaccaacccatgccctaaaatcgagacccctcttgctcccccaactcaagcacctgaactgctagatcgccgccgaaacgccgattcgcccccgccctacacgtgctggaaacgagagagtagggtatgagaaagggggggaggggaggggatggaaattacgcagtagtcgcgagatcggacgacggggaagagctcgagcatccgccggaactccctctcgtccatggcgccgcgcgccgccgctactccggcgatgagctccgcctccgcccgcgctcgtagggttcgatccgattcgagcgagctcctcctctcccgattcgttgctctctcgctctcgaagcctcgaactcgctggagacgagacgagacgacgacggcgagtccaacccagacggagccgacgtctacgcggcgcagtcgcttgctggattatcgggtccaactctgtttcagattccggcccaaaataaacctctcaggtcttgggcctcttctgggctaggcccagaaaggacacaataaaatgggcacgaaaccaagcttaagtacagatgaatttttttcatttttaattttaatttttttaatatttacataaatattataccatccaaaatatttacacaaatggcccctgccgcccaagtggagggcggcaaggtgtgcgcattttacacttaggtcccttgccgcccttgtaccctctacaagggctgcaagggggtaaatacaattttcgccctgccaaaaatgcatttttctagtttttttttcaacttgtctgtccctcacgtcaccctgccgagggcagtagggtctatttctgtaaatattttcgctggtgcaatatttctataaatattaaaaaataaaaatttaaaaatgaaaaaaaaaattcaagtaccgatattgcgggagcaggaaccatcgacgtgctcaatgcccacttggtttattccatgagtttctgagacaatatttatttactactccctctgtttctaaatatttgacagcgttgactttttagcacatgtttgaccgttcatcttattaaaaaaacttttgtaaaatatgtaaaactatatgtatacataaaagtatatttaacagtaaatcaaatgatatgaaaagaattaataattatttaaaatttttgaataagacaaacggttaaacatgtttaaaaaagtcaacggtgtcaaatatttagaaacgaagggagtaagttatttgtgtcgaagcacaccatacacatttggcaactggcataaaggctagttcccctcctccatggaagagcagaggcagtgaagtgggccaagaagaagctgcataagagggagagagagttcgcaggaatctggaggctaaggagagagagttggtgaggaaattcttgcataagagggaggttgataacgaactaccctgagttcttgcacgagtttagggttgaggactgttgaatcattcgtcgagaagtaggaacaggagaagtagataagtcaggtggtggcgctggagacctcgggcggcggccggattcggcgttgcaggtctagtgtcagtgctcatgggagctggcggcggtgcgtcgtcttccttgttgccagtcagcaccctctcccttcttgaactcctccccttctttgtggggagtttcggttgggttgaggcggctgctggtcagcaggggaagctcaggcggccgaagtgacactgtccagtccggattctcctttggtcgaacttggcgaggaggccggcgggtggcgggacggaggtggcctgggccagctctcaggggaggagcggtgggatgcagcgagctggcggcagggttctgcggcaagttcagaagtcaaccagcagagaggcgctggtgcggtcttggtggaagccacgcgctgccaatgcttgtgtggtggttactgagttggtgggcgacaaactacttgagaggttctaggggttccaggcgaaagcctcactcggtgatcaccgggccggcaacggctacaccttcgagtgtcgtaaccctcttgggggcgctgtcgtgggtacctctccccctttcttggcgagttctctttgggtggaaaccacatctttcttagatgggcgatagcggcgtccttgatgtcgtgacctccatgggggcatcgtttttggagtcttgcctttgtggtgttgttgtaggccgggcggcgatcagccatgcttaggggggtcattttggtgctcagttccattttcagtggtttgtgcttgtgtggttagcgtgtggttcttggaggtgccttgtgcacgtccgtacttgacaacttctgtcgtgtttttctttgtaactttactcctccttaatatactcggatggcctccttcggcctttcccggtgaaaaaaagataagtcaggtgagatcttgttcatcctttttatcaattcattacccctgaggccctgaattaacaatcagtgttgtccatttgtcattgtaatttggtttcttgaaacctttgaagtctgaactcccttttgcatttgcaggagttccttgctggtatccgcatgactttggacttatttcaaactgtgggaactgaaaacaaatatagactccaggcctctcggaagtgatgatgagagctgctctcctacacaccatgaaaattatccacctcaatgtctcaatctcattgttcgtgctgtatgaatctagtaatgagctggcttttcagcatattctgtggtccaattctagtcacatttgagaaaatcaccaggcacgctcattggtgctattgcgcactaccatttgttgtgggatacagacaattcgtatgcggttggttgtattgcaattgctcgcctattcatttttttttaacaatataaatagatctcctgttctgcttattttgaattgctatgggttgtattgtcgctggtagtggcttgtgtctgacgatagcctgattttctggtaaggccactcgagcaatcttctttcccgatcagatcaggcagtggacggctcagatcgatctgtaccgtatgaactatgcataattggcgaatacttcacattctttcttgatcagatcaggcggtggacgtctcagatcgatctgtagcatatgaactagtatgcgtaattggcgaatacatttcgttggcggaggaggtcaagtcgtggcgaacgaccactctctgcaacaaactctattttccggtttcatgaaaatggagcagtgggcttcccctgctatttctggattatttttttaataatggaatagataacatcccggtctttactcaacagagttacagccaattgttacaatctaatactcgaacaaagaggaaaaaaatatttttgaaacagaattatagatgaaatcaagatcaacaccaggctccaaagacaactctctaaacgatcaaatagagtccaagagagcataaacatatccattcaaggcaaatctaaaatgcagtcatgcacaataaccaaaatacataacggggcatgcttttcaacagctagctctaattaatttatgcccgggcatgattttcaacagctcaaattaatttatactccctccattctaaattgatctacatatttcataggtacactaagaccaagaaaaattaataattctctcatgttatatttactctagcaacaaactcaatgcatgcaccatccccaatatttcctagccaatagcaaatcaagatattgcatatgggttataaatacttgtgtgtatggatgcatgcatcaatgtccatttactccaatacacaaataacgaatagactctactaaatgaacacaaatatgtagatcatttaggaataaacttaaaaactatatgtaaatcaatttggaatggagggagtaataatttatgctcgggcatgattctcaacagctctaattattttatgcccatttagtttcactccaaaggggcatgcatggctattccaagtccataggattatcgctgtcttcagtttcgtctttagttcccaaaccaaatccaatatccagttgcaatggctcatgcaagtccataggattatcgctcctgctgattgtttcacccagccgcttgtgaggatattgcgcatgaaatttcaaaggtctcttcaggtttccctttacacctgcacccagtaaaacagcaaaacaaagggcccatgagttagtgcatatagcctacacacaaatgtaggtacatttgtatgagagtgacaaaaagaaaacctacaagagcataaaccaatttagttcaagaatgtttaaaaaatgcaagagcacctaaagtggtcttctctctccccactttgatgggggcagaaatcttgtttctgttttcatttctgacaatttcttttaataaaggctcactttgtttaattatgtgcatgttcttgatatagcgtgcactgacaagaaaattttgatatgaaggcaatctagaatccaaaatgcagttgcatttggctgggtttgtgttccacatagcttgcatttcatgtactctggagtacatcttatctggaactgtactctataacttgtctagaatctcaccaaaggcggcttccataattagaggggtaaagagtctagcgaggttcaaaataattacagcctaaactaacaagtccaactagcactatagcagcagccacacaggtttaaaatatatgagcaatcacaactttgaatcaggtttactgtcatatgcaacacaaagttaccgaaaagaaaagcaataagcagaaagaacaggccaagaattaattaatcacctgcagctgtagtgaaatattgggagatggtagactgcgtgtaggagtaatcaaagtcgtcgacgatcctctcggcgtcatacacagacaccgtttgaagccttttgttggccatgtcaaccgccaacaccaccgccttctcatcagaggcgtcaaccttgcccatgacgtaggcaacattagcatctgtctacctgcagctttgccatggccggtcgaccctccagcttaggcaggagctggacattgcagcaagtggcgtcgaccgtgatgtcactagaatctaccatgaagcccttttgccagcccttgttgtcgcccagatgagccaccggtttgctccatgtggacagatcccaggaccagcaaccagtgtccgaatcaaagcaagtacgcagtctgacaatggtgagaaggccattaacgatggcaatgtcccggcaaagcgatgaggtattgaagctcattggagagttgatgagctctggcggcagtggcaggtgacttccaggacagccatgggcgagcacgttgcagatgtggattaattccccgcttgagatcaatgaaggccacctctccctgcccctcatccagagtaattaccttgttcgtcaaatggaccaggcacagatgtaggataccagcggcggtggggcggtaaagatggtggccgttgccgagatcggcggcggcggtggtggagttccggcggtcggcgatgtaggcgcggacgtcgaggaggatccatggtagaggctggtgtgcatccagagggtcgccgccatggcagggcgggcgcagagtgaggtgctcggttctactccacctgtaggggaagacggtagccatggctcaggaggcctctcctcccgccggcgatcgtcgtccgcccgcccgggctagcttaagtagagcagagcagaggagtcggagtcggagaggacatctaaatcgatctcagcaatcctatcaagacaagttggaattgacgaaagatggtttggatagaaacggattgccggcctgatcaaacacacagcatagtttacagtcttaactaagcaaagtattttcagagttcagacaaatgcattttcagagtagagaagagtgtattcaggggctcttttttcaacttcaaactttattttttttcgtttttcgttagcatgttttttaaactattagatggggtgtttttttaaaaaaaaattatatataaattgtttaaaaaattaaataaatcgaacttttaagtttataatagttaatacttaattaatcatatgctagtgagttctcttgtttcacacgaactgaaacatcttctccaataggatgaaacgaacgggccaatccactttttttttccaaattacaataacaatatcagcacgcatacaaaacactagagtcgaacgcgcggcaccagtggtgcaagaggggaatttgttgttatttagttatacaaagttaaggaagaagcattatggtagaagagtaatcttgatggaaaattaattaacaatttataatatatatgaccaaacatctttaaagttataggaatttgacatgatgttgtgtgctgtatgaaaaactaatattaagctagtatcaaagatcatgtgctatgaaaaataaataatagtttgaccataattgtatgtggtgctctgaaacaacatgataaggaaaagccatgtgtggtatttaggaagatgaaagagcaagatgtgaagccaggtgattttcagggagatatggttcaaattttaaatctcgggaatcagatggttgttgatggaatgcactgacaaaattctcaaccacccagacctatcacagctactttcactaatcagcacacccctgtgtcccaaacctaacgaagaatgaatcaatagatagttccaattccaccagcaagtatccaagaaaaagatgtatatgtatcccagtttgtaggagatagatctgggatcagagaacctgaaatgcattgccctatcgcttgcatttcagattttctgatggtcagcaccaatgcctgtcgcttgctaaccatcagagattgctaacaaaagagctctatatctatctcagtttggttgcactgcacatttgcattttaatgtatattcccaaaggcttatcagattagccatgaacattgtaccatcatatgataatgctgcatgggacagcatcacctttaaattccttgtacagcatttcattccaaagcttgaatgctttgtttatatagcacctatcttacagagctgaggtactataaaccattttgcaaacaattataaatgaattccaagaaaggaagcaattaaatgaagcaactgtgactttttttgggacaggttggagctgccagatttttactgtgattaaaatgcagcaccaaaggatgatttataacagatgctatattgttgtagaaaataatcaggaaagtgaagctatgttattctagaagataagaaaggaaaattaaggcaaaatagcaccattcaacaggactgactaagatcaaagatctataaagcttatgttgctagacatgaatctaactgggaaaaaacatgtctcccagattagaaacaaacatgtatcccagcttaatacatttctatttttccataacaacagtaatgtaggtcatcccagattagcaacaacagttggctgagagctatctcatgcatatttttatgccatatctttaccctgaaaataaggagcatagcaaagcagtagacatccagagtaataataattaagagttataggattccaaccataagtgcttggtcatagtctggattgcagtttcatgtaaagcaaaaggattctacgaagcaaacgccatatatatgacagcagctatttacattagtggccataatgcagaggttctaaacaaatggcgttgcttctaagggtgggtgtgcatactggtgacatcctggacatataaccaaaagggacagtaatgtgctgcatgttgtttccttcttcatccgctagataaagagcaaagaaaagtatggattagcaaatatgtattgagctatgtgtcctatgatatatagaattgagatgattgtttatgtactgaccttttcttatgtttctgctgactgtcatctttaaatagtttcttagcagctgaggctgaggctgaggctgcaggcctgtttttgttcaggatacagttagattatatttttgctagaatagaaagttgttgtaactgaggaatgatggaaaaatatacctttttgggggaatgtttttggtaggcggtgatggggatgctgatggagtatcttctgctgctattgctagtgcctttgccttgtaggatagtttatgttgtcagtgtttatagtttttgctgaaagcagggataagtattaattaccttgtcctgagtagcagaagatagctcaacagacgatgcaatctgcggaggttctcccttaatttttgtctcagttgttgcctgaccattgaaagaaaatgcaaagttatattacttgtgatgcagtgataaaaatagttattgtgtaagtagcgatgttagaatagaaaccttaggatcatgtgagaatgagatctgtttatcttgagctggcttgggagagactgataggacatagcttttcttgcttggtgctggtgcattagctttgctagttggtgtctgatctgaagcagaactgatagtataccttgttggtgtcgatggactatccattggtaacatactttctgtcgtttgtgcttctatctttgatcctgtactgccttcacttgttgctggtgctagttggagagagctgcttgagtctgctggcataatagctaatgtctgttgtgaactgcttggtgagataggcagtaggccctgcacttcagcattggatgagataatgttgttaacctgtaaggtttcttgatttttcataatagtatcttgtgtgaagctgatgttccagataaaggtttggttgaaaagagctacaatctcatctggaatatattcactgtcaggtggattttggtcaatgagagtctcaaccggtttgcgtacgaggcgttgtgctattctcccaaagaggataaatgtagcttgagcagtatcatcagcagcgatcaacacaaccttgtatctacatgcagaatagaaatagttatagcagttttgataactgtgaaataagcatggaggaaattgtgccagcatattcttaccttggcactggtatgcctacattggagcagctggtgcatttataggtggaaccatatggttttgaggtcttgtagcatatgtcacatgaataataccaccaggagctgttgcttgatatgcctttaatagtcactctgactataaaacgtgctcgctgcaaagaaatatgattttatcatttttgtcaaataagaaaggacaatattgcagtaacaaagcctgaggtggcactgaccgcatgtttgtgtgggttgagagcaaggatttgtgctatggttttttcttctggaatatcctggttaaaccctgtggtagcagttcaacccacttgataggttgaaagtttgcgctaaagctacagaaagaagatatcttaaataataatgtatcgcagggaaaatgtatatgtaaatggatgattgtgtaagcattaaaacaataatataagcttgtggtgtcacctttcttttaactcaagcacttcaggcatatcaaggttaatctaccatttgcatggtgaacttccatttaaagttagtcctgtatataattgtattaataaatatgtactgcagatttacagaaggcatgaaaagattttggtacaaatttatagagatatacctatccctttgtagttcttgacaactgttccaacaaaaacaataacctgaggtttcttttgaccagcattgtataattcttctgcattgaatgcagctgcagtatttccccatagtgtgataggcagtgtagaattgctagttttataaaatgattataaatttttggtgatcaatattagtaacttgttacaatagttagtgtggataatgtaaggtaaaggcagtttataacaaaagaaaatttcagtctatactgtagcttaccttgcatcccaaatctgcattgttcttttcaaagtttctgtgtttcttgattttgggcgtagagtgtctgttgcaccaatttcagttatgacacccataatatctggttaaagagaagatatatgtaaacaataaaccactaatgtataagaagtaaacataggaagacaaaaaagggataaggaggttataccaacatagaaagcatttttgtccacaagagacgggacgtcttgaaaaggtgtcaatgaaaaagttatggcagggaaatcatcagaagcatcaatgcattcttctaaggttgtccatttagtgaatgagatcatcaaagggttcgtaactggcctatatgttcagtttgcatatctgacagagaaggagtcaaagtagtaaaccttcccttcctgtagaagagtcctaagcttaatcatggcaggtggatagatttgaacatggatgctattgccctgcatattgtgtatataaagcaccttgttagtaccatatttgtatgtaagtattaataaagaagaaatgagtgttaattagactataaccttttcatccagcaagacaagatcagtgtggaagatttttgtttcatcattcagatcatggtagtcccattgcctagatactcttgccttgaactgtttattagtgtccccatacataaggtctgaaataagcacgtataccattggaagcctgtaattaaatattgaagatatttagttttacgtatatataaagcatcaatgtaatgaactaagcagtgagaaaatagcacatggaaatctagtagtctgttggtgcaccagtgctacagcatatactacatgtgagcacaatatatatactccaagatttatactacattgcatatactacatgtgagcacaaaagccattgcaattagctgatgagggaaagcatgctacacatggagtggtgaagcctgcaataggaaagaacgtccactgtgacaccaagaatgtaggtaaacatagagataaaatatgcagagcggcagcgagggcacaccgcttccattgtagcagaaagtatctcggtataaacaacatttcttgtttggtttccacttgacccgtcatcgttttcaatcagtattttgaggcctgatcggtttgttgctcttgaaatagcaacatagagttgcccatgcgtaaagacaggtttcctaaggtatatgccaacctgctcaagtgtttgtccttggctgttgttgatagtcattgcataacaaactcgaactgggaattgtctcctttgtaatgcaaaaggccatttcattttcgatgtgcttagtgtaattcttagtatataaactgtttcaccgatgtttgatccagttagtatagtacattgtaaaattgtttcgcctaaagcaataagtaatagtcttgttccattacaaaggcctattgattggttcaaatttcgtagaagcataacaacactaccttcctttaaaacaagtttgtgtgtaggaaagttagttgctacacctcctagagtctgtgtaggatcaaatgcacaagccacagtatgcatgcatgtttggctacttttgctatgagacgtttgagaaacactaaaaaccaaaattttgggacccagtaacctcttttcatcatattgcctcatgttaaaa

SEQ ID NO: 71107 - DNA, 11684 bp, Oryza sativa
cagatgaggtcgtcgcggaaggactccggcaacgacgtgcggatcccgccagcgcgcgtgcgcgtggggccggtggcgcagctcctggccgccaccgcctcctcgttgccaccgcgtagccagccgcaatcgaccgagcctgccgccaccgcgccgccctccgccggagcccgcggccgccgccgtcgaccacgccagccgccaccacgccgccctccaccggagcccgcggccgccgccgtcgaccgcgtcagccgccaccgcgcagccctccgatccgccggagcccacgcccgcgcctgccgccaccgcgtagccctccgccagagcccgcgcccgccgcccgtgcggcggggatggcagggagggagctagccatggccgccggcgagctcttcacacgtgggatggaggaggaagaagagccatgggcatttccgtccgggatggcattttggcgaagacactctggttgaggatggtattccagcgaagcccgttttcataatagtattctagcgaagccattcttatgggatggtagatatgcaattttctcacaggcgccgcacgcccggactcctcacactcgcgctcacagcctccagactccagcaccatgccacgccgccgcctgcctccaccgcgccggtgccacctccatccgctcacggcccaccgcgtcggcgcagcctccagcatcgcgccggcgccgcctccgcctccgcctccgccctccaccgcgcggtccgcgccggcaccgccttcgtccttcctcggcccaccgcgtcggcgccgcctccacctccgcccgccctccgcctccatcgcgccgcctccgcctccaccacgccggcgtcgtccttcaccaccgcggccgtaggattcggcgcacctggtggagattgacgggattcaaacatagaggctagagcttgatttgtctttctgaatctgcatttgcatatgcatcttgatctattgagttgcttttgatttgtcaaccttatatttgttatttggcttttgtgatttttttgagactgctcgggttattcggtcatgaccgagaccaaaccgaactaactgaaaaccgaagtgctcggtcctcagttttttttttgaccgatcggtcttaagttttttatgaccgaaattttaaaaagaccgagaaacagaatcgaatttctcggttagaccgaatgcttatccctaagtgcgcttagagattggacaaaggctaaaggcgccaccaatcccgccgccattgtcaaccgcatcatcaccattaactacaccatcatcatctcactgccattttgccgctaatcctactcccctagcatccatctccatgtgtcctcctctcctctccatcgtcaccattaaaaaatatgcatttcgacatccaaaaaattgttacgtcaagcgcattttggcatccaaaaaattaaattcttaggacaagcgtgacacccaagacctgaaaatggtattaggcccaactcattcagtcgaaccacacatatactacgatacactacttttttgtcaacgcttcatgcaaaaagaattcgtaccctgtgttgaaggttccggcctttcgggcaagccagtctcctactccctccgtcccaaaatataaacatttttagaatagtaccaaatcaaactttttaaattctgagtattaatagcaaagaaataaaaaagattaataatgtaaatttgatgttactagatttatcattaaacaaactatcataatatgcaattttttatttaaacattttaaaattttgtaaatattgttggtcaaagtagcatctcgaaaaccgggtcgaagtctaaaagtacttatattttggaacggagaaagtatttaagctgctccctctctttcaaattggcgagatggtattaatattaaggcttgttcactttgctaccatttttaaacttaactttttggcaaagttaaaaaaaaagtgactacatttagtttgttgccaaattttagtttagtacatacgaaatcttgccaaaatttgacaaccttaccaaaattttgacaatcttactaaaatttagcaatgccaaaacttaataaggttgaaaatggtagcaaagtgaacaagcccttaatattggctcctcttgcttgccggttagcttgctgctgctgctaaacactgcttgctgctgttgcttgcggctatatggcccaaggccagctactgctgctcgctgtaggaaaaagtgcaccgaaggtccccaacttgtcatcgagataaaaaacgtcctccgaccacaaaaccagatatgcggggtccctcaactatacaaaaccggtcatccgaggtccctaggtggttttcaacccggttttgtctgacgtggcggctgagtcagcatgggacccacatgggccccacatgtcagctggccacgtcagcctcatccctctccccctcttctctcccttcctcctctctctctcactcactcttgtctctgtggctctctgggcaggggagcaaggcggcagcggcggcgggagcaggggagaaaggcggcggcggcggcggcggcctccggtctcccccgccctcttcgctttgggctgaggccgccgtgctcgccccgtcctcttcactctgcccaaggtggcggaaacccaaattgatggagcgatggagatggagatggagttgttggtggggatgtggaacttgtcggcgacccacgacatctccggcgcgcgctgccgcgtccttggccacgcaccggaggcggttgtggaggtggacggtgtcggcctggaggtggacgtagtggagcacgtcggtgacgtcggcggcaaccttgaggcgagactgccacgacgcgagcagggtgaaggacgggttgttcgggttgcggtggagcgcgaagagcggcgacgcgtcgaggaggagctcgtaggcgaggaagagcgagccgttgggcgacgcggagacgccgaggaggcgcgcgatggcggcgtggtggcagtggccgaggacggcgaggcgggcggtgacgtgcgcctggtcgcgcgcggagcgggcggcggtgtaggatccccgaatcacaagaactaagccaaccagagggggggtgaatggttggtatacccaaaaaccgaaaacttttagcggaaataaaagttaccctcaaaatcgacggagatcggtctgaccgaagttgccttgccagtctgaccgctcggatgtcgtcggtctgaccggtatagatcaaccggtctgaccgctgaagctgcttgccgcgcctgtcgtcacctccggtctgaccgccgtgcacccgccggtctgaccgccgcttgccgccggtctgaccgccggtagatcgccggttagaccgccgaaacccggtgaaacacaaattgaagaactcttaaagtagatgacgactttattgattctctctgtgtttacaaagtgcaccaacagcactccttacaaaaatttcgactaaactcgaaaccctaactctaaactcaactcaattgctctctaaagcgataccgggaagcctcacgctccccctctatttatacatgaggtaggcagcctaaagccacgaaccaaactcatactaagagtcctaaacaccttaggaaaccctctagtacaagaaagaaactttacataaccaatcgtaccaaatttggactccttccaaattcgactccgcatcccatacgcacacaacacctccatcgtatgccatataaaatctccatcaaccacgtgcatcaactctagcctaagtatcccgcatgatctctgaccatcacggacgtcgtcttatccccaagccgactcccggtccatcaccgcaaatactctcccaagacatcgagtcacctacacatgaaacaaacaaagaaaccatattccgataccaagctatctccaacttgactcattagcagcaaacaatagtattacatacgtatagtatccatctagaagccataatcatgaaataaactcggatatccaaataaacaacccgaaaccgaaaccgacacagtgtcggccagtcagaccgcgggctgcgccagtctgaccgcgcattacacaccagtctgaccggcacacactgcccggtctgaccggtcacatgaaataacgatcctgcgattcacctgtaaatccaatcatctccaaaaccacttcgtgaataaattccaaataacaaaaccaataatctccaatgtccaattgttcgtcacagaataataaccaaaaacacctttaattttacaggcggaagaccgcggcggagtggccgcggagggagcagcgaaacgacgaggaagaactcaccgcggcggcggcggtgaggcagtgggaggagaagtcggcggtggcggcggcgacgtggaccacgcacttgtgcacgcttgccatggcaaatggcaatgatgccatctccgttgctttatatgcttgcagcgcgcgagcccacgagagaaaccggaagtctcttttgagcttgcaacgcacgcacagtttgcacatgcagcttagctagtgagtgacgagatcatagggtatgatgagtcctggtgtttcggccaagaagcgccacgccggcgtgaggttcacgctcggctgcggctgcaaggacgcgaagagcgtgtccgtctcggcgccggtggtggggacgccgtcgacaacggcgacgcggcgcaggagcgctgggatgaacccgtcggggtcgacgacgaccgacactcttaccataacgtccgcgttgtcgtccttcctgtgggagcgctccgtggtggagttcgacgatgacggcggcgactacgggccggagagcttctccggccttctgcgcgagctcagcgagctggagcagagcgtcgcgtcgtggggccggaagagccaccaccagaaccacgacaagaagcactcgccgccgtcgtcatcgccgttgccatcacaggaggacaggaaggagaagaacggcagcaacggcgatgccacggacaaaccaggagactgccgtgacggcgacgatggcgtcggtgtggggctcgacggcagcgtggcggtggtgaagcagtccgacgacccgctgggcgagttccggcagtctgagcgagccaggcgccgacgtggtcctagcactcctcggcgggttccccttcgtcgccacaccgacgctgctacaagatcgtggttgggccctcggcgacgacggcgagagctcccctgctcccacgccgtcaccgccgccgccgccttgctcccctgctcccgcgtcgtcgtcgccgtcgccgccaccgccgcgacgtcgccggccgccggacctcctctcccgcatcaccctgtcggccggcggcgccggtctacccagagcaccaaacgagaagagtgagagagagaggagaaagggagaggaggagagagggtgatgatgtggccagctgacatgtggggcccatgtgggtcccacgctgactcagccgccacgtcggacaaaaccaggttgaaaaccaccaagagaccttggatgaccggatttgtatagttgagggatcccgcatatctggttttatggttggaggacgttttttatctcgataacaagttgagggaccttcggtgtactttttccctcgctgtactactactgctgcagctagtcgccatgggctaggcccaagaacagcagagctgttgctgcatgcacggttagcgaattttttttatttatacatttttttattaaaatatttacaaaaataattttttgtttcgaaaatttacaaatctaattgcctgccgcccttaagaagggcgatttttaaaaatcgccctctcaaagggcggcaagggacctaaatacaaaatttttatttgtgatcaaacccttcccaccggttttaattgcttaaaaactaataatgcttattcgatactccaaatgattttaaatggaaaagtgataaactacaaagttatagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattatttttgtaaatattttaataaaaaaagtataaataaaaaaaattccacggttagctccctgcttgcttttatttttcttttcttatctaattattacggggcgttacataagtcatgcagaaaaatatttgagtttgaggatcgacttgaaagcatattgtaaaagatagtcctaaatgtaaaatccttatctttgtcagtgcccaagctacgtcatttgtaccatgaacttaaatatgatacattatattaaaccaagtttataaatctagatatacttcaatctaagtttatgacatgcaatctattttaataaaaatcttaatgctggaatggcaagtaatctgaaaggaagggagtacgtaagttcacctcataaactttttgttaaccagataattctcatgttttcgatgaactaattcagttaacaataacagaaactacaccagcattacatcaccgaattaacactaaacgttgaaagtaacatacatcagtgccatacatcatcagaatcactggaacgagcaagcacacccttcccgtcttctacaactgaatggtgacacccctggctcccatgttggtcagcctctgctccatggtgtcctccctgcccgcgccgcctgcacctcccgtcctcgtcgtctccggccgcgtcacgtcgaacttctcaccgtccccccacagagcgtaggcctcctccccgtgcgccgcgtcgtcgccgatcatgagctggtcgtcggacatgcggagcgggatgaagaggccgatgcagaggagaatggcgctggtgacgatgaggttccagacggtgacgaacagcgcgccgccgagctgcttcccgagctggccgatgccgctgccgtagaagacgccgcgcatgttcgggatcgggcaatcgagagcgcagagctccggcgtggcgaggaggcccgtgaggacgccgcccaggatgccggcgacggcgtgggtgtggaagacggcgagggtgtcgtcgaccttcatgaggaaggtggatttcttgtgcaggatcatcatcgtgaaccacgggacgctgccggcgaacatgcccatcagcatcgctgaccacgtgtgcaccagccctgcgtccatgcaaaacgtacgtgaggatttggacccatgaactgtgtgtgtgctgtggttttgatcggacgaaagatttgttaccggcgccgggcgtgatgcagacgagccccgtcatcataccctgcacggcgccgatgacggagggcttgccgaagaagatgacgtcgaggcaggtccaggtgaggaggctcgtcgcggcgctgacgttggtgttgagcacggcgaccgtggcggtgacgttgggggcgtacggcgcgccgccgttgaacccggcccagcccaaccacagcagcccgccgccggcgatcatgagcaggatgttgttcggcgagaaccgctccctgtcgctcttcagcctcgggcccacctgtcagagtcacgttgtaacatggaggcgtgtgaatagtgcaacaaacagtcgaacacgatgcatgcaatgcacggttgcacgtgtgtttacccagtaggcggcggtgaagccggcgacgccggaggagaggtggatgacgtatccgccggagtagtcgatgacgccccactggtagaggaagccgccgccccagaggctgaacgcgccgacggtgtaggagaagaggagccagagcggggtgaacgccatccacgccttgatgttcatccgccccaggagcgacccggcgagcagcaccagcgtgatggccgcgaactcgaactcgaacagcaccagcgccgcctccgcgtagaacggctcggtgcgcggcgtctcgagcgtgccgtcgctgccgtagtgcgccgtcgccgggaacaccgcgcgttgcaccaggaagtcctgcgtcagcgccggcccggccttggcccagaacgggagcagccggtcgccgaacgccatgcggaagccgacgagcacccacacgataagcgtggacgcgtaggcgtacagcgccatgaaggcggagttgacggcccacttcttcttcacgatgctgccgtagatcaccaccagcccaggcatcgactggatgccgacgaacgtcgccgccaccagctgccacgcggtgtcgcccttgttcagccacgccggcaccgccggcaggtccggcatgtacggcccgggctgcggcggcgacgccatccttaggtgcattctcagctcgaagcaaagcgagagagcgagcgagcgatggaacgcgaagtggccggctagctacgttgtgatgggcgtttaatagccgcgccgagatggcgatttgtgagtttaattattggtttgagacgagctctcgcgagtcgtgatgacgcgcgcttgaaccgatgcgaggtggggacgaaatgtggggagccgtagccggtttccgggtcaaccagggcaactctggcccatggttagactatggagggatacatacagtttgttcttccttaacctcttgttaagtctttcattgatttcttaaacttctttgcgattttttgtgcaaacgaactgcttgtcaaccgaggtccgatgcacgggaggatacaggagagaacgtaggatatgctgacagtacatgtgagtggtccactccagcatgtatgcttgtgggggcagccatgcggatgcccgctagatagcctttcagctgagaatctccaattttggaatgtgttaggggcttcgatttaagatacataacagtaaagtcgccagctttagttgggaaattcatctatttatcggtactgtgtccaattccaagttgtttagatgcatcaaaattagtcttcggtattgagtatgtacattttacaaaggtacattcaaatgatgggactaacctattaatctttcgtcagatttatagcttcaaatattatagaatttttaaccaatgaatagggcccgtattaaatgaaataaacaaataaaaaaacaaacatgtaactataaatttttcggtgtgagtgtaacaaatcttgatgcaagatcctgtggatgaaaaaatgaaagataggagccaaaaaaagctatcgcaagtgaaacagaaaaaccatttgattaaactattgtaaatttataaattcaagacagtgtataacataactataaatttaacaccaaatttattacgaaactacctgtttcgtctctaaaaaagtgtattttcagctatgaacttggacagtggccatagctaaaaggttattgttttagagatggatggagtacacattaatataaagtatcacaaaactacatatttaagacataagacatagtttcgagaatccaattccactacgaaataaagataaaaaaaaaaagagagaccgtcaccattgataagaactctcttgtatacataggtcaatgtaggcatttttttccctagcaaaaataaaagcaggcaattgtttgattaatcatgtggctgaatcatgtcatgtacgctgtagctaagaaaaccatgctattcagatataaatttccatggcatcctgcttttcttatctgaaaaatgatctgtacaacggaggtacagtttgcatctgaatactggagattggtcccatgggatcgctcttcagtatattccccctccaaaggtcctcgaaatggagaaccatctcttttatcgtaaagtgaccgtgtaaggttgactgtgatggggtaacagctggggattggatctcaacgggacattctaagtcacagtcatgtcatcctgtcatatttgtaaccacaacttggatcatgcgagttgtatagtgcacacgaatgcatgctgtggcgaaggccgaagcataaatataggctagatggtttagggttaatgatttgcttgcaggatccaacacaaatatgaaggtgaatcccaacaaggagttcagagtaatcgattaggtatgctcaatgcttgccaggattactgaaatgctgggaggcttgtctacctccgctgtagcatagccgaattatcaacttaccaacttgagagaaacttctataggttatcggaataagggaaccgtaaagttacactgtttcataacctgcaatagaaaaaaagccttacaaggagggacatgaacctaccgtcctggatactgaaaatcgatgctagttgaacagatccagtgcatcacttaagcgtttgggataagccagtaattcaatggggatcattttagaatgcttattcgcacatcaacctagggagcaaatggaagaaataaaaagcaggttgtttttttgacatacttcaaatatctagctaaatctgtacaaagtatataatgttttctttttcacaaggaagtacataatgctagttggtaaaagtaccagtgggcaattttgttcataccattggaaccaaagttccttattgaaatattccttacatgtcagaagatctcccagtaattttccttcaaaggtaaacatcagaaaacaaggctaccaactaggaatgatgttaaaggaacagtcaagttgtcatccaaatgtgtgctgatgggatgggactctacaagtgctgcagttacagaaacaacaaggaagccaaaagccaaggaccagctttcttcaatgaaaccgaatgactggaagtaatgcatatacctgaacaatatgcgaatgaatgacttaaaaacacatatgcaacagaaaacttcagtaaaagcctctcaaataattacccaattgaagccatgaaaccagctagtgccattgctatgctgcctgcatatgacttgttggggttgtatggaagcttttcttggccaagacgtctccccactatgtctgctattcctgaaagtgtagtggggggggggggggggggggagggaatgtcagcaaggaaagtatgcatagcttgtttacgctaagctaaggactggagatatacgcacataccgtccccagcacataagttgcaaataagggctatagcgattggagaggttctccagaatatagaagtggcaaaagttatagtggtagcataatacagtggacccttgagaagttccctgtgttcatgagaaaatgaagtctaaaggatcatgacctgaagcagcagcagcagcaactatagatattcaacagaaacaaagaataagcaaatctgtgccaaaaagaaggcatagaataggaaaaaggaaaatcagagtgaaaaatgcaaagaataaaaggcaaatatgagcagaaa

SEQ ID NO: 71108 - DNA, 849 bp, Oryza sativa
cgattttgattcttcaaaatatagttttgcaaatttttacatgaatttaagtagaatttatgtgagtaatttggagttctggctatgatggcacttgcttaaattactacaagtatttacttgttgatataacgtgaacaaaaaataagtatggtgcactgattattctagaacaatgtagtacaattggagtttgaaatgattaagagacatcaccaaatgtactgataataccttcaagttgacactacagctcttggttaaaacttacaaataaatgcatatcattgcgatatttgttgttttagaaagcttcgacagccccccctcctttttttttgtgatggctctacatgcacacacctgtttcgttaacattttagcatatgtggaattcttctgcttgtctttagtcatagttgcttgcatgtcattgataattcatatgattgggtagttatcctttttttattttaagatagtgcaatataaaatactacattagctcactgtttgtctctttaataagtaataactctgttgtttttgctgatctattgtgaggggcttcaaggctccagctatgcagtcatgcatgtatttataccttttatttatttttgcagtccaagcggcaaaggggttgtagaaatgtccacggatgatgaatcagattgtgtggttatatgtcccccaaatgggaaagctggtcatacagaagttatgagtggcaggcatgatgaagattcttcaagagggcaagaaaccccttctactatagactcacatatgaatgggaatgtccaggatggagtgcctgcagatcaagatgtgctgaagctggttgat

SEQ ID NO: 71109 - DNA, 775 bp, Oryza sativa
ttccctgcttggtagattgatctcggttttgtatatttcacctgtgctaatatctaggtataaggtggtatcggactactagctgatacatgttaggtttgccctatcggctatgctgcgagcatacataatccctactgtggggcacatttagatactgagtgatttatactgtctcggcataatgtccgatctatcccaatcactcgatctaagcacgttccattggatggattacgtatcatctacagccgatcgagtaggcctaataatctctaagttttatctacctttgctgatctgatgcaagttatatcagcttgcctttgctgatctatcgttgatggatttaactctttgtcttttttctatcttgttggttgcaggatcaaaccagctggcacgctcagaacccaaaggcaatctctttggacctgcactagagttaagcagatctcttaggccagtgcgtgttttttgcgtcaacagaggtgtacaactttacccacaagacacgattccacacatgttaccatgccctgaagtaccgccacgatactacaaaggtggaaatcgtgacaaaaccccccgtacaaccctccctaaccaaacatacccacctcaggtttcaccccctccttgtgccaagttgggcagtcccttctcgcgcctaggtaaatccagctacgcagagaccaatatcaaggtccgaactgcaccatcgcctctacctttgccatggtatgtcagctaggttaagttatactgtagattt

SEQ ID NO: 71110 - DNA, 747 bp, Oryza sativa
caaacagaggagcatgtgactctcatcataatagaatcaaatggaactcaatagataggttcaggtaaaaaggacacaataaaaaagctaaatggaagtatagtctgtactgtaccatgatgcataagaaactcggttatcactctcaatcctaagcaaacctaaaagaacctgtaaaagaaaattatctgtcaactaaaatacaattgcactcaatatataaatggcaaaaataactatatgggtaacgaaaattagcacagcgttttgtatagagcagttagtggagtgtatggcatggttgagataatgcttgtccagtatcaaaagaaaagtcaatgctagtatgaggttgatctgccttcccaatctgaccaagtggaaccaactacagtttataaaaacaatatggtaagaacagaaataaagcatacttttatttgacagctgcagagaaacatgtctgtattgtttcatcacttggaaatgtttttcaataatccagtcaaagaaccgcagtgtgttgatttgtactcgcactgctcacagcaggattgaagtaattggataactctcacacatctgggaaagaaacaagcataaataacaagctgagtcatatatatcccattaacttacacagtaaggtgattctaaaatcatacacacaatattaccttgcagcaccgtttaaatgttcaatcatactaactccaatcaactttagacaataaggggtgcaggaat

SEQ ID NO: 71111 - DNA, 1406 bp, Oryza sativa
tcatattagtcttgatgagatcatctggatttctgcccaacttcctgagtgtggcatatggcatcaaattcacagcagctcctccatcgaccatcattttagaaattggcttcccattgacaaacccattgatatacaatggcttgagatgccaattttctatcccctctggcttctcaaagaccgcctgctctggtgacaaaactaacttagctgaagcttcctcaacatcatcaacatcggcttgcctagcttcaaattcggccggtagcataaaaaccatatttactgatgccgatgcaagagccttgcctttgagcaccctttttgccttttcggcttcgacctcatcggctgatacaactgtacttttaacacgccattcttgcttagtctttgttttcctcagccgatgattaatctcttgatgcaccctctgaaattgctccctgttcctcaacctttgaacccttctcttttgattcttggtgaaaatgcctgtaggtacaccactgtgtattcctattttcatctttatcttgataatgatcttgatttaccaggcccagcctttgatgaacaggtactctcttctgatttggccgattacctctattataggatcggcttgaactccctgtatcttcactgcatccagggcaattctcaatcgatggcaacctcataccttcattccagcaaaatctgaaaaactcacaatcccaatgagggtcaaaaccatcatctttttcatgatatttctcatgctgtttatcatactttctttggtatttgttgataatcctagtcgaattcatgtgaaaatttctattcatccccccatcggctgtccttctagatgtatgcaccttattaatagggaaaggattaccatcaaccttcatctgcttctttgaatcatcaaatttgatctttcccccttcaatggctgcctggatttgctgcctaaaaaccttgcaattattagttgaataggaactagaattatgccacttgcaataccttcttttgcccagctcttcggctgatgggatcacatgaccagccggaagctgaatttgtttttctcgaagcaataggtcgaaaatcttgtcatccttggtgatgtcgaagtcaaatttttcctcttttccagaacttttcacccattggcatggtattactttcttgctcttgacccattcggctgccgccacctcggaatcatcgtcttcatcatcagaaccatacatgtaaggatatacatgattaatctttttgaagttcttcttggccttagcaaacctctgctcatgaagagtcaccttttgtgtgagatgtgataaactctcaaaatcttgagccgaaaacttttctttgatcggtgctatcaacccctgaaaagc

SEQ ID NO: 71112 - DNA, 24130 bp, Oryza sativa
tattagaagaattgaaaatttggttctgctcttcaatataatatgtaacttggttttggtaacactacagaaatgaaatgaatctggatttaaaaatgcacatttgaggagacattttttaacaaagaaaggccaaacctattttattatcagtcttgctgaactgttgtttgtttaccaacgtttgtgtgaatttgcaatttaattccagtcatcttcttatcctgtataaagatcatttgctgcttgcttcattaggtttactgtaaatgtttgttgtctttaggtcctggacttgtacacgatatcacagacaatgccaaactggatgatagcattgaaaagaatatgaaaaacagtagcgacaaatatctgaaggaaggttatagcatagagcctttccctgagagttctgttgatgatacctttgagtttggagatattggaccattgaatactgatgcgcaaaactcaactgctgctaaagctgaggaagaaaatccagagacaaatgttgatctcgctctcgctaatttccatcgagaatatgaggtatttgaactgagaattgtccaccgcaagaacaggttcacaatcacttcttgtttctcccttctcttcttccatttttggttgctaaatgatacttccaagttaattcttatgctcatatagcatgtcttcactgcaggaccggctttgaagtaagcaaagatttccccattgtcataaattcagttatagcaggaagatattatgtcactgaataccttggctcagctgcattcagtaaagttgtgcaagcacatgatcttcagacaggaactgatgtttgccttaaaataattaaaaatgataaggatttctttgatcagagtctggatgagatcaagcttctgaagtttgtgaacaaatacgatccattagatgagtatcatgtgttgcgtctctatgactatttttatcatcaggtatatcacttaagaaataaagttgactaagatactccctttgcattgatgttatgctgcatactttttggctattcggaagctaaggaagtttgaaagggatatattgttggtctttggcaactttgaaaaggatctatgatggctaaaagcaatatagcttcttattttcagttgatttcttaaattgcttgcatgcttgtttaattgtagaaaaatcatagaatttattagtactttattttttgcggttgcaaaatcatagaatttctgtaacggcatattgacattgcaacaggaacacctttttattgtcactgaattactgcgagcaaatctatatgagttccagaaatataatcaggaatctggtggtgaagcatacttcacattgcctagaatacaggtatgtttgaccgttctatactaagatgctatctataattgttgcatatgcatagacacttacagttcaatttgtagtatgcacgatatgcaatgttccaaaccaatttaatatgcttcatttaaacataaagtttttgaaccgtaattgatcattttcttggaatgatactgctgtaaataaaatgattaactgttttaagtgcaattaaatttaacttaagaaaaaaggttttgatgaacaaaagttcccccttttctttcaggcaatagctcggcaatgtttagaagccttggtatatttgcatcatttaaggatcattcattgtgacctgaagcctgaaaacatccttatcaagagctacagcagatgtgaaattaaggttatcgatcttggaagtagttgcttcttgacagacaacttatgtctctatgtacaatcacggtcatatcgagctcctgaggtcattctggggcttccttatgatcagaggattgatatttggtctcttggttgcatccttgcggaactctacactggtgaggtaagaagcttctgtaccttgctaatccttctttttggacacgtgctgaccttttagctgtgttaaacccatagtggcctgttgtcatacagcacatagaattttatggagatttcaacacactgcattaatagtgaagtgctgtgttggcatgtttgataccttctttcttgtctaaatgctatgcaacatatagctccaaacagaaaatagagatcaaacttctgtgccagaattatttttttttgaacgaatgcctgagtaaattttggggcacaaggactggctttaataaataaagacaaataagaacgttttacatggaaacgaataatgtgcttcaagttgttttgttgttatccatatggaaacaaagttgttttaaaatttaaaaatgctaatcgtctaattataattcctaactggtacacataacaggtactatttcctaatgaaccagtgcccataatgcttgctcaaatgattgggataattggcccaattgacatggaaatgcttgccctgggagaggagacgcaaaagtatttcactgatgattacgaccttttcaccaagaatgaggtacactattcttagtgctagtggaagtagcctttcctgtgaccactcgaatttcatcatgtccatctctctctgtggactgtgcgagttataacacattgaacactgaactcattttgttgtttacctcatttctattcaggaaacagatcaattcgagtatttgatcccagaaaagtcttctctgcagcatcacttacaatgccctgattcagagtttgttgattttctatcctatttgctgcaaataaaccccaggagaagaccaacggcaagtgaagcgctacaacatcaatggctttcatttgcatactaatgactaatgagaaaccaacaggtcatttcgtttgttttaagtgctttgttcaactgctcctaagctggatccctgcaatcttctaaagatggattgattttctgatgtttccccatgagtccatgacatgaaacattttacactttccttgagttttagaaggatttacctttgtgcttgctgaactagcatgcggcacaattttcttgtttcgtttcttcagggcaattcttggagtggaagccctgctctcagtgttaagattcgtgagtgtatgtaaatatgaggaaattttcctgtgtacatgtacagttgaaacaggctcttgtaagccatctgattcatctttcataacatagtgaaaatatgaaataatcatcctgcatttcttcagttgtcgccatacttctgtgaaaatttcccttctaatctcaatcccgtggagatatgttttgttaaatgcacaggaaagtacagaaggaattttattgtccatgagaaatttttagtctcatgagagagtttttagtatctttgagtaacccggaagagccgaaggtaccaccattgcagatttgcaggcccatgaagttgcacaacgcggcccagcaagggcagtgtaccgtgtacgtccagcccaacaactcctatccatccgatcttgaaccaacgtctcggatcagatctggtcgcgacacttcgctctgtcaccggcacgcaaaaatctccctcccttctatccattatccccgtgccccaccactggcgccgctcaccggtcacgaccaatgccgccgaccgccgccgtcgccgtcgccgtggccgcggccaccgcgctcccttctccctcctcctcctcctcccaccgccgcctccccgccaccgcaaaatccgtctgggtaaaccccagcctcccgagctcccagcccttccatcgccggaaacccgccgagccccagcaccagcgccaggaccacgtgcccgacctccccgcgctcctcgcggccctctccgccgcgcgcacggcctccgacctggccgccgcggtctccccgcaccgccccgtctccccgcgcctcctcggcacgctcctctcccgcctccccgacgcgcgccgcggcgtcgcgctcctcgacctcctcgcgccagacctccccgcctccgcgctcctcatcccgtacaacctcctgctccgctccgcgtgccgcgccgggatgctccgcctcgcctccggcctcctcctggagatgcgggacagaggggtcgcccccgacgcgttctcgtactccacgctcctcgcggcgccacccgcgcgggccacctcgaccacgcgctcaccttcctgccgctcatggaggacgacgccgtagcgcccgacctcgtgctcttctccaacctcatccacctcgccctccgcgggggcgacgcgcccaaggcgctcgcgctcttctcccgccttcggggcgccgccgggatcaagcccgacctcaaggcctacaacgccgccatcgccgcgtactgcaagtccgacctgctccgggacgccaaccggctcctcctccacgacatgccctccgacggcgtcgcgcccgacgcggagtcgtactcccccatcctcgccgcgctggcgcgccgcgggcggcacctcgcggccgtgtcgctcttcacgcacatgcgcgccgtggctcgcgtcaagcccgacctgtccgtgttcaacatcgtgctcaacgcgtacgggcagctcgacctcgcgcgggaggcggaccggctgttctggtccatgcgccgtgctggtgtcgccccgagcgtggtcacctacaacaccatgctccgcgtgtacggcgacgccgggctgttcggggaggcggtccacctgttcggcctcatgcgtagcgccgcctccgatggcagcgaccgcggtggcagcgtcatcaagccgaacgtggtgacgtacaacaccatgatcgccatctacggcaagtcgctggaggacgagaaagccgggagcctggtgcaggacatgcaggccaatggcatccagcccaatgccatcacctactcaaccatcctgtccatatgggtgaaggccgggaagctcgaccgtgccgggaagctgttcgagaagctccgggaagccggcacggagatcgacccggtgctttaccagacgatggtcgtggcctacgagcgtgccgggcttgtttcacaatccaagcgcctgttgcatgacctcaaagactcagaggacgtccccaaggagacagccatcaaaatcttggcgaatgccggccgagtggaggaggccgcatggctgttccgccgtgcagccgacgccggcgacgtcagggacacatcggtgtaccgaatgatgattgacttgttcgcaaagagccggaggcaccggagtgtgatcgaggtgttcgacgaaatgaggaaggcggggtctttgccggactcggagacgatcgccatcacgatgaatgctcatggtaagctgaaggagttcgacaaggcggcggcgctgtaccgggcgatgagggaggaaggatgcgtcttctcagacagggtgcacttccagatggtcagcctgctcggcgcccagaaggacttcgacgcgctggaggcactgctcggtgagcttagcgatgacccgagcatcgacaagagggagctttaccttgtggctgccggcgtgtacgagagagcatgcaagtttgatgagtcgtcacagattatcagccagataagaagccccaacgccattggtgtccagaagttcagatgagaacctccagtttctctgacgacaaattcaggtgtattgccagacagcaatacacaccatagtgtcattgacaattcaaggttgtaacttgtaagtgcgcgtggccactgtggaagttctttttcaattaaattttagacaccaaagtgttatcactgatcggtgctgtttgttgggcttaggcctttgtaaatataaacatcagataactacatttatataaatacatgttttttggttggagtgaagtgatggtacagtgccaagaacatttctgatgctgaaccctttgctgaacggaacaagcaggatgctggcagcataccaattagactaactgaactatcaacaatgaaattttacaacagaaggtgatatacaactggtgtttaaatgccccactacacaaataccaatctaacattctgctagattacaattccttttgtcttcagacatggcaattctgtacgaaccttgacttgatttttatcaggatccaggaaacctaaacgaatatataaataataatgtacaggtgctatcccctgagaacggacttatggcgtggcaggcgtttcagccttcatcaaaacaatttcatgtagcggctgcaaaatttacactgcctgatcagtttgggggatgccatgtttttggaaccattcaggcatatgaaatctttcgtatagtgctggtctaacatctctctggatagagagatgcttcagaagtggaaatataacttccatgagctgaaaacgtttaaacaagtcagaattagtaagtagtggaaactcaaacatggctaaagactggtggcagttatcagctacctgattatcattatgttgtccagctgaaaatggaacacagggtattccattcaaaggttgcaatatgaaactgaatgggttgttgtcaacaatgacaactctgcagaaatcttttgacacgcaagaaagatctttgacatgttctctgtattccctgaaattgtgcatcccatggatatcagaaagcgcattggccaaacaccaaataggtcctatgcgacatttccagcaagaaaaaaagccacttaacacatagccctcaactaatttggcacacatctcagcaagcatagtaatgaatgcagcagcactatgataatatggtaaaacaccatgtgtatccataggaaagttaacagtaacttacgtagtaacagttgatggacgatatagacggagtttgaatctattatggacatctattctgtcaactaaaggtcttgcataacctgagaacaaacatgggcatgtgaggtggcgctaattgggttcaaatgaatgaagaaaaatagtagcaagcacataccttccaaacctgctgtaaagagaataagatctgcaaattcactagttttctgcaagaactcgtgcaaaccaggacgttcaaaaacggtgacatgattcactttgtttctcccttcaacatcctttacagttcacacaagcaaaagatcctttagcagtagtgattaaaatcattacatacaataagagccaaaagcacaagttctgtaccttctcagtggatatgcactccatgtcaaagcaatgtaatccagcttcaacagcttgggtgcgtacaatagctggaagactggatgattcatatgcagaaactaaagtttcatccaaatcaagcacaacctgaatagataacccaaatattttcagaaatggtgaatgaataacttataattatcatttcatttttcgttttatgtaaaactgttatcatttcatcttttgttttatgtaaaactgaaagctcaacataaaaccatccaagttcttcacccactaaaacaaaatatgctaacaggaaaccctgctatgagcaaattagccaatgttaatcccacatgataattcatatataatcaccatatgtataatctcataattctgattcaattacagtcataatgtatcatcaccaaatgcattatcccacaacactgctcaaatatctactcatctacacatcgatttcaacggacgttctaaattaccatccacagctctgctaaagactgcagcaatgtattgtcccggttaagtaccaacaccagcaccgttgcaattttggaatattaaatcatcatttcatgaattatccaagcagtataattcagagagacggattaacgccattgttggctgctaaacgaggacttgattggggattgcaggacaacggattgcccatgctcgtaagccaagaaaacaaaatcatcgcaattcaaatccccacaaaaaaggtcagctttacaacccacacaataattagcccccaaaacaaatcgaattgcctgaattaagccggaataacacccagctaacctcaaatcaatcactctacgcatctaccaaatcctaaatctcccacgaagaccgggacatcaaaaatcagatcaagaggctcctcccacatctactgtttcatccaaatgatgcccatatcatccctaaactagccatttccccccttaccaaactaccgaggaaccccatagcgtcaacgaatccactcaaaaccgaatcttcgtaccgtgaggcgctgcagggattccggcgggggcgtcggcgcaggggccgtgtcggccgggatctcggagcggagcggcatgaaggccaccgacggcgactgctcggagtcggccggcccggagaggagcgggtagcggaacccgacgaaggagaggagctgggcgcaggatggggtgccccggaggatctggagcaggacctggaggaggaacccgatccaccccaccaccgcctgccacgcctgcgccgccaccttcccccgctgctgctgctgcgccgccgccgccgccgtcggcgagtacacctccgccgccgccatgatcgccgcccgcggcgagctgtctccccgcaacgtggggcggttgggaggcggggaggcgaaggcgatggcggtggcgaggccggagaggcaaccggaggagggaggagggggggaggaggacgtggtggtcgactggtcgtggtcgtgtgtttgagggggaggccgcgggtgccccgagtccgtattcgtctacgtgtgcgtgtgtgtgttggcgcttcgtttgcccgtgtccgtgtggacttagcggagttacaggagtagatttagcgggcccagttgtcagtgagaggctcggctcgtctggcgagctgccgggagtgtgattatacttacgtgcacacgaagttttctcctaaatttgtctagaaagaacatgcaaaccgctcacactcacacccatgtgatgcggacacccacaccctatctctatatgccctctggaagactaatatgatatatctcgcctaccaggctacctctatatgccctctggaagactaatctgatatatctcgcctaccaggctacctctaaaaaataattagacataaatacaaacgtctgtgtcaagtttagtacgaatttactattagactaatttctcacaaagaatttaatcataggtcctgtttagttcacatcaaacttctcccaaactcccaattttccatcacatccaaaactttcctactcacataaactcccaacttttttcccaaaataacaactttccctgaacttctcctcaatttcagaaactaaacacagccataatcgtaataagttaagctaaactcacttcatgtgtttctccatctcctgtgtatcatctactccctccgtcaaaaaaaactaaattaattggggatgcgacattgcctagtacaacgaatcgttggatatctaatgttctattcctaactggattgggttttatggaacggacgagtacatactacttgtgtatgtattttcctgcttgcgtatgtgtttatcctatctggtttgattttgacaaagtatcaatcgaggaacagtaacgttgacatattattatacttgagtacatgttaacgaattcaatcatgcgaattgatttttccaggaacgcatgtgtttttgttgttgtacaatttgttactgtaatcttgagtaaggcatggatttcttatacagggcaaaactgagtgaacgattagaatatgattaattaaatattagcttaaaatatttttcttattttttaagaaagcgtacctttaatagtttgaacgtatgtgcgaaaaaaatgagggaatggaggttgaaaaaattaagagaaaaacacagcctaattgtatacacttggaaaattataaatggaacagttataacctacatttgcgcatataattagaaaaatataaatggaacatgtgcatgctatctaaaatagcggtcatattgctttcagaaaaatgtcccagaaatattgcttcgagaaaactaaaccaatacatttatgtagtactagcaaaatggttggttagacataatgagttctgtaacttacgaaaatgcaatcaaatatttttcttagctagtgtacacagagtatttcctcgcctcacaaaaaaaaatcatttcctcctaaagatgccatgccttgcattgcaccaaaggcatgctttgctattatttctttcttgttgattatacctaagcaaagcagggcccctttgatcttttttagctataggggcaacggaaaaacaagtgggacatgctccatgaatatcgtttggtaaaagacacctaaccaaagcaggacaaggagagtacaataaaaggggccttatcttgttcagttgaaaaataattaccatcacgtgttgattaaagtttttttaaagaaaaaagcctgagaaatggcctctctaggactgaatattgtcacttgctgtcatttagggcttgtttagttcacgaaataaaattttttaggtgtcacataggatattttaccggatgtcggaaggggtttttagacacaaataaaaaactaatttcataactcacctagaaaccgcgagatgaatcttttgagcctaattaatccgtcattagcacatgtgggttactgtagcatttatggctaatcatggactaattaggctcaaaagattcgtctcgtgatttcccccataactgtgcaattagtttttcttttaatctatatttaatacttcatgtatatgtccaaagattcgatgtgatgtttttagaaaaacttttggggatctaaacggggcttagcttaaagttactgtggccatggtgtgtagtaggagtactagttgttttcagatgaaacatgctgctgattagagcatgcattctctgaaatctgtatagtcagcgagtcaggtactcaggttactatacagatgatacagttctgaagttttcacccatgaagttttgaacggcagaagtttcttgagggtaaaaaaaacgagttaaggcttgcatgtgtttttttttttttgaaaccaggcttgcatgtgttttatgagttctgaatgtcttcactatggtccctcaactcattagtttttgtcctgttcattgttcacatatgcttgtcatctttcatccctctttattgcagtggtcaataactgaacttgccatcaatgaataaacccaatgttaccttacctacgacaaaaaatgaaattctgtgacaccgaaaatactcatcatggagaggttgttggtagctctgaagctgtccaggtgaacgaattgaatggattaatttaattttagtgcggagactctcccaaatttctaatagcacaaactgattcattcgttttagtaaattctttgctgagaaagcgtcttctgcttggctacgcttaccggccactcgtagctagctgtctggctgctttgtaattggaacatatcaatactgttttgatgtcacaccatggatgagtccaaaattttatcaggatgtgcttctatgctgttcattggttgcaccatcgtctgtttcgtgctggaacacgaatatgcggagcgttgcgagcaacttaggatttaactaatagtttattgattttctttaagatttacttgatgttttaagatatttaacctatatttgaagataagtttagagctcaagcccttggtattataggcctacctccgcctttgattgcaacattggattataccataaacttagaataaaaatgaaaatgaccattagcttttcaggcttatctatactacttcatccgttttatattacaagtcgtttaacttttttagtgttaagtttgatcaaatttatagaaaaatttagcaacatctaacatatcaatttagtttcattgaatctaatattgaatatattttgatagtatatttgttttgtgtcgaatatagtactatatttttctataaacttgatcaaatttaaataagtttgactagaaaaaagtcaaataacttattagagtagacaaattatatttagcaccatattcatgcccaggaattatactactccatccgtcccataatataaaatattttgactttttatttacactgtttgatcactcgtcttattaaaaaaatttgtgcaaatataaaaaatgaaaagttgtgcttaaagtactttgaataataaagtaagtcacaaataaaataaataataatttcaatttttttttgaataagatgaatggtcaaacagtgtaagaaaaaaaatcaaaatcccttatattatgggatgggagagtactaacaagctggagcactgcacaaattactgttttcatggggtcctggcagtagaattttgcttgtttttgtcattttcgttgttattagctcgtactgcctctaattatagacatgctaaaagcatgaaaagatgctctacttgtttaagtttaacttggttgtcttttcagattccttggatctgaaagtaggcaacagagaggtgaagaaaaggggtgacaaactgaggtggcttgctatggcagatcaggaccaactagtcctaatccccaagagaggcagtggttttgagcaccttttcaacgcagatgtagattaaagattttgccaccagctctttggtagcattattttcttcaagtagggaattaatcaaactaatgtgagcggagagagtagggcagtcttcggctgagttcatttcagcaacataaaacaacaattttatcgttcttcgttggcacattttatgaatttataaatagtatgttttgtaaacaaaaattatatataaaagttttttatgttcaaaatcaaataaactctcttttgaatttataattgacggagcgtggggctcctcaccgggagaccgcgcgggcccccctttgccggttcggccaggggcgctaggtgaggttctaagccctcgatctgtggaatgtttcgcgagagagcaaatgcgcaagacacgggcgatgtagacaggttcgggccgctgagaagcgtaataccctactcctgtgttctggtggatctgtgtatgaaggagttacaaatagctggagagcaagagagttcaaactctaaagaccctcttcctctttctctcctctccgagctccggtgtttttccccccctcttctctcttttttctcttaagtgggcaaggtcctccttttatatctcaaggggataccacatgcaccacttctacctactcttcttttgggtggggactcaccctatcttccaaaaaaaagtggcttgcgccttcgcctagaagctaaatcacagcttgtctttgagtgaggcccagcgtcatcactcgcctgacaccggggatctccctgttactccctcattaatgggcggagatttgccatggctgctgtccgaatgaccctccgatgggatgagccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagttagcatgccggctccggctagggacgagtgcctagaggctctcattattccgacgggacggggcgaggcgtgcgaaaggccgcctgttgccacctaacccgcgatctgaccggtctgtgaccggtcacacactatgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccgcagggggtcggggcgccccagccctcggggccgaaacgggagcggcccaacccctcggggagacagagggaggggcggccacatcaccctcgggcccgacccccccgagggggtcaggccacgtgggtgaccgcagctgccccaaacctctagtcaagatacccccggtcccatgtcaccgacagtagcccccggcgttatgccagggcgatcgccctcctcgaggaaagcgctcgggcgtgacgccactccttaggcctggtgacaggcggggccggtctctacaggcgggcaggaatccagtggtgcgcgcatcggcaagggaaaaccgaccgacaataatgagcggctttcttcaagaccgctacattacttgagcagcgcgcgaatcgggacgagccggttcgtttcgcctggagatgtgatgatggtgcatcggtcggcgcgcacgatatgtcccatctcgactgccacggccgcacatccgcctcgtgcaccgcaaacgggcgagcgggattagtggaggagtgggcgtgagaaacgagggggcgagatagtgggcccgggaagcgaggagccgggcatagcgttggcaagggtataaagacgccgaggaagagactcgtttccttcctctcgccattattccccttgccttcgccgcttgcgctctaacttctcgtttcctgtgccctaccctcgccacactcactcgctctcaagcccctcctccgctggcgtcatggcacggggctccgcaccgctcgacggtagcatgctgccgccttctcgcatcgtgagcgagaggcaggccgggctgccgcgccgattcatgccggaatctgccaccggccgggaggtggtcgcgctgggtgagggacgcccggcgccacactacccggggcggtccgtattcttcctttcctttgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcgcccatctctccggctgttccgatggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgaaccagcccccggcgcaggcctccagctggcgggcgccggtagatctgggagacggctacgacgccgttcttgaccgcctggctggtctgcgatcccaggggctcacggggaccatggtgtacggcgattaccttcatcgccggatcgcgccactccagcggcgcgcccggggcgcctgggagtacaccgggtccgaggactacatgaggacccaccagggggtcaaatgggactgggtccctgaagacttcaagatggtgatccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgagagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgaggaggagcgaaaaaagaagcggctccgcaagatgggggggaccgaaccatgccggggaaacctcatctccccccccaaggtggtcgtttagccgacctcctcgcaggttcgtccccgcgcccactgcggccgtattcattctcccatctcccaaggcaagttttcactcacccgtttttcgtcttctggtttttcttctgcctcagcgagatcccgtcgcgcccttcccgccattccaagtccggccggtctgaggtcgaggagacggcgaccgcggaggcccggaggcgggaagctgaccggcgagaagccgcagaccgcctccgggaagccgaagaagctgcccaggaggccgtccgggctcgccaggctgaggaagccgcttgggaggaggccagactccgccgggccgaggagtccgtccgggagacggaggcggcgcgcacacgccgggcggcctgccaagcccccgacccgactccgcccgaggcgacaacgacttccgaggccacccacgacgaggccgcgggcgcgccgctcgggcccgacccctctggcgacgttcgggacgagcccgcgtcgggggacgcccccgagttcggcacgtcgatcggcgggccgagccgcgcggcgcccacaccgaggcggctctcccctctgccttccgctgccccactgagcgcagagcccctcctgcaggccttggccgctgcgaacaccatggtgttggacgggttaagcgcccagatggaagtcctgcaggcagagcgggcggaggtcgatgcggcgtgggcgcgcgtcgaagagggacggcgctcggtggaagccatggtggaggcgggccgcaaggcacaccgccggcacgcctccgagctcgaggcccgtcgtagggacctggcggagatcgccagggaggtggaggaggagcgggagactgccctcatcgccaccgccgtgttcaacgcggcgcaggacgacctctgcctccaatacgggagccgggcggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccgtgaggacgagctcactgagtgggagcgagctctcgaggaggccgaggccgcggcgcagcggcgggaggagcaggcgcgcctcaatctggaaggcgcccgcgcagagagggccgcactggatcagcgggctgctgaattcgaggcgcgggtgaaggagctggacgcgagagcgcgcagcggcggggcggccgcgggcgacggcgacctagccgcccgcctcgcagccgccgaacacaccatcgccgagctgcagggcgcgctggactcgtccgccggggaggtcgaagccctccgcttggcgggcgaggtagggcccggcatgcttcgggacgccgtctcccgtctagaccgtgccgggcggcaggcgggcctctggggcgggcggaccgcgaaatacgccgccaaccaggggggcctcgcccagcgcctctcagagatggccgggaccctccagcggctccccgaggagctcgaggagacgatcaagtcatcctcgagggacctcgcagggggggcggtggagctcgtactggcaagctaccaggctagggaccctgacttctccccgtgggcagcgctggacgagttccctcttggaaccgaggatggcgcgcgcgcgcaggtccgggacgccgccgaccacatcgtccacagcttcgagggtacggcccctcggctcgcgttcgccctcgactccgacgaggagggcggtgacggtggtgcggacgtcagcgacgatgaggccggcgacccgggcgcgtcggcgtgagcccccaggcccccgccaatcttaaatagctttttctttcttcttctgaggccttcgggcccccttcttgtataaactaatttaatctgcaatcaaataaagaggaaatttttgtgtcaatttcatttgttgtgtgtatgagacgaggatggtctgtgccacggtccttctgtgtctctgtgtcttagcttaaacaagggctcgtgcctaggtcctagcctcaaatggcgcgggtcggggctagtgcctggggagatccacgtgtcgagactggccaggccgggaatgtggtgaccgagggttatggatgacccgattgtgggcctttgccgattcccccccggagttcaccacgccccggggcacggctcggttctgggccccttttggcgattttagccggcccgggccaccgagggcaggatcgagcacgagcgtgctaattcaagccaagattcttcgaaaggaaacaatggcacagacacagtccttaggaaatcgaaaatgcttttattgaaatacggaagagaaaaaaatataagtttatgcatgtggtagcccccggccaaccctgcacgcctgggggggcgcggggttggcccgagcccgagacctgacacccgacccccactaggggtagaagcgacgaaggtgttcgatgttccacggattaggcagctctgtgccgtcgcccgtggccagccgaacggagcccggccgggggacgccgatcactcgatacggaccctcccatattggtgagagcttgctcagtccagcacgcgtttggacacggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctggcaactcctcgatccacgagtcgccgtgcttcttgaggatgttgaaggttttggttttgaggcccttgaggatttctgcgttggcgcgctccacttggccattgcttctggggtgggcgggagaggcgaagcagagcttgatgcccatatcttcgcagtagtcaccgaagagttcactagtgaactgggtgccgttatccgtaatgatacgattaggcaccccaaaccgagcagtgatgcccctgatgaatttaagcgcggagtgcttatcgatcttgatgactgggtaagcctcgggccacttaatgaacttgtcgacagcgacatacagatactcgaacccgcccggggcccgcctaaacggacccaggatatcgagcccccagacagcaaacggccatgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacgccttgtttccgaggaatgcacttcaggaggactctgttagccgtgcaccgatagagggtcccttccaccagcacgtagcgcttggagatgcgctggacgcgttcactcccttcgcggtcctcgggtagagtcttatctgtgaggtatgcctggatctcagcgatccaagcaaccaatctaagggagctgggagcgctcccctcgggtcccgaggcctggactccgacgggcctcaggggccgttcaggcgcgtccgtctcccctagggggtcgggccgcgccgacggctgggcaagcctttcttcaaaggcgcccggtggggtctgggcttgcgaggaagcgagcctcgagagttcgtcggcgaccgcgttatcccgtctaggcacgtgccgaagctctatcccatcaaaatggcgctccatacgccgcacttggcgcacgtaagcgtccatctgcgggtcagagcaccggtactccttacagacctagttaacgaccagctgggagtcgcctaacaccaggaggcggcggatccccagtccagctgccaccctgagtcccgcaaggagtccctcgtactccgccatattattgatcgcccgaaagtcgaggcgaaccagatatctgaggacgtctccgtttggcgaggtcaacgtgacccccgcaccggcgccctgaagagatagggagccgtcgaactgcatcacccagtaggcggtgtgaggcagctacgaggggcccgagctggcctcggggacggagatgggctcaggggccggggtccactctgccacaaagtcggcgagggcctgactcttgatcgcgtggcgtggttcaaagtgcaaatcgaactcagagagttcgattgcccatttcaccacccatccagtaccctctcggttatgcaagatttggccgaaggggtaagacgtaaccaccgtgacccgatgcgcctgaaaataatggcgcaacttcctcgaagccatcagaatagcgtaaagcatcttctgggcctgagggtatcgggtcttagcgtcccggagggcctcgctaacgaagcagacgggccgctgcacctttcggcggggccgatcttcttcgctaggggccacatctccagggcgctcttcgtccgagaggccgcgcggggcgcactcggcttctgtgccgacgacctcggggtcggagggcgacaggcgcggccttcccgcagtggccccggggccatcctgggggtcgggggtgcctggcaccgtcggacaagcgggcggagggccaactccggccgtcgggggcctcgggccgccgttcgactcgggggcctctcctccctgctctctcccgggtcgagtcgacacagggtggggatgcgcggagtgagggttgtcctcgtcgcgctccaagaccaacgccgcgctgaccacctgcggggttgccgctaggtaaagtagcagcggctcatctggctccggggcgaccaggactgggggagaactgaggtacgccttcaactgagtgaaggcccgctcagcctcctccgtccagataaacggcccggagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacaccgaacacgcacttgtcggggttcagttttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgctgaaaagtaggacctgcattctttaacccgaaaggcattgtcgtataacaataagttcctatgggggtaatgaaagcagttttttcctcatcctccctagcgatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcaccagccactccggatggataacctctcggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgccgtccagaagaccaccgattcgtgtggtcttggacgggccgtcgcccagggcaaccttcttgaccgggacctcgtcgcacgtgatcatccgctgcctcggggcggctgggatggaggtgctgagcctctcgttgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccggggccttgatggtgtcaaaggctgcgggggaaaggatgttgagggctgcacccccgtctatgaggacacgccccaactttacgttgcaaacggtgggggaaaccaccatcgcgatctgtcctccccgggcaacgcacggcgggtggtcggtctggtcgaaggtgagggcaacctccgaccaccgcgtcgcctcatgggtaggggccgcggccagaagctctcgcttcatggccttgaggctccgacgagaagcgtgagcgcacgctcccccatcgacggtggcgatggtggccccaggctcctggaaccctaggtcatcgtcgccatcgtcgatgtcctcagcgggggccttttgcttggcctcacttcgccggttgccggagggagccgccggggccttgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggcgctccctgctgggagcgccagcctccttctttttgttgctcgcaggcctcccctttcgggtggcccgcgaagcgccctcgacggcgaggacgtgaccctcgtcgtcggaatgggccgacctctttttcctcctcctgtcccgccgctctgaccgagcagcggatccgggggcggccgaagctgccacaccggaaccggtggagttccaggtccaggcctcctccttgcgagccacacggtccgcgagctgaaaaagctccgcggtggtctggggctccttggaggcgatcttttcgagcatgcggttgtgccgcacgccccgcctgaacgcgtagattaccgcgtgtgcagggatgcatggtatggtgttgcggacttgacagaaccgctgaatgtacgagcgaagagactcatcgtcccttcgctgtaccgcatgcaagtccgcttcttcacctgggcgtggatatgtgccttggaagttcatggtgaactgctggcacaaatcctcccaagagtggaccgtcgcgggcggcaagttcattagccaaccccgcgcctgtcccttcaggtccatggggaagaaattcgccatgaccctgtcgtcacccccggcggcctcgatcccggtcgtgtagacctggagaaactcggcggggttgacacttccgtcatatttttcggtgatagtgggccggaaccttgggggccaacggacgttccgaaggctcgccacaaaggctcgacagccgacaccaccaaccgggggcacggggggctggcccccgcgcccaaaccgaagtggcgctccggacgaggaagcgccttccgttgcgtgggcagcacgacgaccattgcgccggcgctcgatactgaggcgggcatccggccccctacgcacatcttcttgggtcggaggcgttgacgaggaaatggcagacgaacggcgggtaacggccgccgctcgccgcgccctccgcctcgacgacacggagccggcggtagcagcgccagaggccttggtggcggaggaccgcccaccggcgcctaggcgctgctgcgccgtcatgaccaagtcggccacgtcatccagccaacgtcgggct

SEQ ID NO: 71113 - DNA, 664 bp, Oryza sativa
ccattatcaagttttagtgggcaagtaattaattaaccaatcacgattaaccatcgtgaactatcattaagccatccttaaataatagtgagtcataagttatcccaatagtgtgctaatgtttctaagcatggctaagcaatcatatctaatatctagctcaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgcattgcaataatcggtcttcaattaatcttctgaacactcccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatgg

SEQ ID NO: 71114 - DNA, 35354 bp, Oryza sativa
  unsure (1)..(35354): unsure at all n locations
attgggtgcgttcttggcaaaaaataacttcgtgtttcgcgtggcgaagttttgtcaattaatgccaatattggccaatattgccacaagtgggtgcgatgtttttcaccggaataaaaaagttcaggaagcaccaaaacaagatttttggaaatattggagtgtactgggtgcgtccgtgtctaaaattcactccgtgattcgcgcaacgaacttttgtcaattaatgccaatattggcctatgttggcacacatgagtgcgatgtttttccccataaagaaaaccttcaaaaagcaccaaaacatgatttttggacatattggagtgtattgggtgtgtccgcgtcgaaaaatcatttcgtgactcgcgcggcgaacttttgtcaattaatgccaatattgatatatattggcacacgtgggtgcaatgtttttcaccggaatgaaaaacttcaaaaagcaccaaaacatgatttttggacatattggagtttgttgggtgattccgtgtcgaaaaatcactccgtgactcgcgcggcgaacttttgtcaagtaatgtcaatattggcccgtgttggcacacgtgggtgcgatatttttcaccggaataaaaaacttcaaaaagcaccaaaacatgatttttggacttattggagtatgttgggtgagtccgtgtcggaaaatcactccgtgactcgcgcggcgaacttttgtcaattaatgccaatattggcctatattggcacatgtgggtgcgatgtttttcaccggaaggaaaaagttcaaaaagcatcgaaacatgatttttggacatattggagtgtattgtgtgcgtccgtgtcgaaaaatcactccgtgactcgcgcagccagcttttttcaattaatgccaaagttggcttatattggcccacgtgcgtgctcggagtacgtgcctagcccggatgaaggaagaagcaaactgtgcgatgtttttcataggaatgaaaaagttcaaaaagcactaaaacatgatttttggacatattggagtgtattgtgtgcatccgtgtcgaaaaataactccatgactcgcacgacgaacttttgtctattgatgccaatattggcatatattgcgacacgtgggtgcgatgtttttcaccggaatgaaaaatttcaaaaagctcgaaaacatgatttttggacttattgaactatgttgggtgtgttcatgtcgaaaaatcactccgtgactcgcgcaacgaacttttgtcaaataatgccaatattggcctatattggcacacgtgggtgcgatgtttttcaccggaatgaaaaagttcagaaagcacacaaacatgtttttggacatactatagagaattgggttcgtccgtgtcgaaaaatcactcgtgactcgcgcggtgaagttttgtcaattaatgccaatattggcctatattggcacacgtgggtgtgttgtttttcaccggaatgaaaaagttcaaaaagcaccaaaacatgatttttagacatattggagtgtcgaaacaagatttcggcaataataaaagggggtggctatcaagctagcaaagtggatgggtttggagacaaggaattttatacaggttcaggtcttcttattcaagaagtaataccctactcctgtccggggatgattccaccgagtatgttattgattatatatattggagaaaagaattgcgccccgagaggcacacggaccctccttatataggggaaggagtccgctttacaaaatacagtccatatcctaacggaatatgggattatagataaaatacaatcctaaccgactaagatctcgggtatttccttgacatacaagtaaaaaactaactcgagtcttcataaagatattctatctatatttggtaccatatatccgactaaattataactgtcatgtagatatgggatatccatattctccacagtagtcccgagaccttcgcagttgacaaaatagccttctcgaaacaaaaaacagcaatccgagtgcttcaattcaacttgctccagtttgccgagtgctaaaatcaaagactgcgaagggcgaaaataaaacatggtgcatcgagtagatgcacctaattaggtgtagcgcccgactatgtgattagttgaaaaactaaacacgtagtcaagaaccgagtggttttatcaacactccttgaacatatcaaggataaaaacatgaaagggccaagtgataaacactcaaaagatccaaaaatagacatatttgataggaatccgagtaagaaactcttaaaatgattcaccaaacatgataaaaaatcacgggaattaatgagtctaatagcctaggctgggacccttaccataaccaaaataagcatataacatgctaaaagaatgactattagtaaaccagtcatctcaaatcaacccaaacagcttttgcagcctaataaggcttacaaaaacggtataacacctttctgtcgggcaccttttgtttgcatcgttttaattccaaagaattatcaaaccgcattaaaaagggttttaacagcattggaccacatcattgtgagcacaaattgccaaagcaaaaagtgcctaagtccctaaggatcacaatgggccacgctggaaataaaattgggctgaagtactgtgccggcccaggcctgctagcactcccgataccctaatatcaccgaagtgaaaaacgtctcttcgtcatccccgccgagactctcgccattttccccatttcctgctacagtacaaactgcgccggccaagctagggttcagcaatccgctccaatccatcctcaaacactccacaaaatttctgccggcatccaccactccaattccccattcctttccagccgtatctcagaccaaatcaaaccatccagtccacattcatggcggaagagagagaaagcttcgagagccagtaggcgccctccgatgtgacggaagataatctctagctttatgtgaagctggttctaagtgacgacaaaggcgacactcctagaaagcttggagaccgagaggcaaccaataaactgccgaagcaggctactccaaggaagaaaacatccagtcgtcctgtgccaaaaatcaggaagaactctaggtgcaactcatattacgatctccgttgcattgatgcgcacccattgcgataatagtactgacaatcaaacttgcaggaaaccatctgatatagatctatctagaaaagactctgacccgaccaacatggaggcgggttcctcaaaagaaaccgggccgactgcaaaagatctcccgagtgataatctgcaggccagcgacaatgtagaacccagcgacgaacccctgactggaaaccagtcggccgaagccgaagctggagttaatcaggagcccccgactggaaacctgtcggacgcagggccaagccaagagattccagaagttgaaacccaagcagacaaccctcgcggacaagacgccagcaatgaccggagatctggatctactttaaaggcatctgaatccactcgtcctcgtccagaaatcattacgggtaaacactttgtctgaaaccatgtcgacccaaataactctgatcaatcgtctaacctttgtcagtagatacattaggaccaatgattggtgatgaagaagaaattccccgtatacaagcagccgaagattcgtgccctcccattctggtcaagtggtgggatgacaacttgcaacctcaaggaattataataaaccggcaaaaagaagacgaagaggtctgcctaatgaagaaggcactcaaccaagcgactcgcattgtaaatgtaagttccttgatgcctgacctcagccatcttgtttgccgtctggctcgagcgctgattaaactgctctgcagaggattcatcttaggaacgaggcgaaaaccgcaacccttgagaaactagttcctcatcttggaaccctcgaaaccaccaggagtcaactgcacgaggccagagaacttgccagaaagaatgaacacgatttgagggattggattgctgagctccaggaatccaattataaactgagtggctcatccaaaggttcgcgcaaactctgcccaactgatttgggctgttatctctgtaatcttgattaaccgaagttaatgtactgcaagctgccaagatatctgaactagagaagaagatccaaactatggaaaatgacaaggcagagctggcaagatagagggattcagctttaaaggaggttgaaggtaccaataatcaatacctcaaaagccattatcttctatatgctgattcattaatgtgaatctgttgatgcagaccgcaagatcaagtctcaagcacagtttgatgtcttagttgacaagatcaacaagcttgaaggagccagggataaagtcgctaatgatgctactccactcatccgggccatgttcttcaataacgccggttcgagtacacttgatgctgccaaaatcttcgacaagctgagagtcgctccagatacttatttcaagaacatcaaagaagctggaagtatgggagcaagtctggcgttggcgatgaccaaatccctttatccaagggttgatatggatgccattgatggctttgcagatgggacgagcgaagaagctgctcttgacctcattaacgatgcgcagaaagccgctgacaagattgctgctgatgtggttgaaagattccaagaagtcgaccttcggccgactgggtctgataagtctgatgatgaaaaaactgatactgattgatataacaatgattttgataattaatgatgatgaaggctcaatttgtacaatactgatgaatttatgctatgcttggtgttccatacttagcttttgatttcttaaaagcctttatctagccttattgagcctaaaacccgcaaaagctattaaaaaccttcagtcctcatcgactaagtcgaaagaccaaatagggcaatgataaatcaagtaagcaaattgaattgataaaaatcacactccattattatcatagtagcccccgactgaaaacttcaaggaaaaacttgagattagcagtcaaagaggaaagatacaaacgaaacgcctaagcataaaatcgacgaaggtgttcaatattccaagaattgttgatgagagtaccatcttcgcgcttgagtcgataagaacctggccaagtgacttcagcaattatgaacggtcctgcccataagggagataatttatgccgatcctgtgtggtttgaattttcctcagaaccaggtcgccgactaaaaaggctcacgatcgaacattccgattatgataacggcgcaacccttgcaaataccgagtcgactgaattaaagctgcttcacgggcttcttctaatcgattgatgtcgtctacttggccctcttcataacgctcctcgttgaagttccgaaatcgtagtgattcaaattccacttcactggcaacattgcttctgcaccataaaccaaaaagaacggcgactggccggtagcccgactgggagtagtgtgtaaagactaaagtacggacggcagctgattgacccacttgccagcatagggatgtagtcggtcgaaaactcgtgcttttatcccttgaagtatcatgccattagcacgctcgacttgtccgttactcatggggtgtgccacggaggcatagcaaatttttataccgaagtcttcacaaaagtctttaaatgctccgccagtgaattgagtgccattatcagtgatgatccgattaggtaccccaaaccgatgcacaatgttaatgaaaaaatctctagctttatctgccgtaatcgtgatgaccggtttagcctcaatccatttggagaatttgtcaatagccataaagagatgcgtgtaacccccgactgcccttttaaacaggccgaccatgtcaagcccccagaccgcaaacggccaggacaacgggatggtttgcaactcttgggctggtaggtgaatttgtctggcaaaaaattgacaaccctcgcacgtccgcacaatcttgtcagcatcagatacagctgtaggccagaaaaaaccttgccggtaagctttgccgacaatagtccatgcagcggcatggttaccacaaataccagaatgtatatccttcaacaattgtcttccttcttccaaagacacacagcgttgcagtattcctgatggatttttcttgtacatatcagtttcatgaataatgtaaagtctgctgcgccgggaaatctgctcggcttcatttttgtcttgaggaagttcttgtttgctcaaaaattttatgaacggttctctccagtcggcttcgatcatgcttacgccttgagtatccatggcttcaattgtctcttttctgggcacggttggttcgtaaagatgttcaacgaacacatctgaaggagcagcttcctgttttgaaccaaaattggccagcctgtcggctgcctcattgttatgtcggagaacatgggtgagctcgagtccatcgaatttgtcttccaacatgcgtacctcttgtcgataagcagtcatagtatcatctagataggaccactctttcatgacttgattaacaaccaactgagagtcccctcggacaattaatcggcgaatgcctagagagatggcaatccttaatccatggagtagcgcctcgtattccgccacgttatgggacgcagaaaaatgtatccacaatacgtagctcaatctttctcaagtcgggagattaaaacaaccccagctccagtgcctgtaagcctcttcgacccatcaaaatgcatagtccaatattccctcttttcctctggcatgtcttcttggcactcggtccactcggcaaggaaatcagctaaagcttgtgacttgatcgaagttcgtggtttgaacgatatgtccaaagacatcaattctaaggcccacttcgcaatccgtccgtttgcttcgcgattatgatgtatatccccgagtggaaacgatgtgaccaccgtgaccgagtgactttgaaagtagtgagataatttcatgacggtaattaagacaccatataataacttttgaacctgaggataccttgtcttggagtcggctaaaacctcactgacaaaataaattggtcgttggactttttgaatatggccttcctcttcacgctcaacaaccaggaccgtgctcacaacctgggaggtcgccgtcatatataacagtagcggctcttgtagatgcggcgaggccaaaactggtggagtggtgagaagtctcttgaagtcttcaaaggctttttgtgcttcgggtccccactgaaaattgtcagtcttcttcagcagcttgaaaaagggcatcccccgctcgccgagtcatgagacgaaccggctgagcgccgccatacaaccagtcagcttttggacgtctttttgggagcttggcggtttcatgttgaggatggcgttgattttctccgggttggcctgtatgcctctttgagataccataaatccgagcaacttccctgacggtactccgaagatgcacttttcagggtttagtttcatcctgaaagcacgaatgcttgtaaaagtttcctctaaatctgtgatcaggtcatccttctgcttggtcttgacaactacatcatcaacgtaagcttcaacattgcggccgatctgagtcgagaaacatctctgaatcatgcgttgataggttactcctgcgttcttccatccaaagggcatggtgatgtagcagtaggccccgaagggtgtaataaacgagatcttcaagcagtcggattctttcagtcggatctgatgatatcccgagtagcagtccaagaaactgagtaactcgcagccggccgttgagtcaaccacctggtcaatgcgaggtaacccaaaagggtctttggggcaagacttgttgaggtcggtgtaatcaacacacatgtgccattgccccgtctttttccgaactaggactgggttagccagccagtctggatgaaggacttccttgatgaagcccgctgctaacagcttggttaattcctccttgattgcatccttcctgtcctgtgcaaaacggtggagtcgttgcttgatgggtttggcgtcttccttaacatgtaaagagtgctcaatcacctctctaggaataccaggcatatcggatggtttccatgcaaagatatctttattattttgaagaaaggtgatgagcgcgctttcctatttacaatctaactcagcgcctattacagcaatcttatcaggatcagagggatctaagggaatctttttcgtcttaccattgctttctccgcttttgagcatcttggttgcgggcacttctccttcgcttgccatggtcgcagccagtcggatctcttctcggtcgagtgtaatctcgcgggtctgggccatctcgcaactttctttgtcacatgtgacggctttcttgatgttgcttcgtagtgatatgactcctcgaggaccaagcatcttcatcatcatgtaggtgtagtgtgggacggccatgaatttggctagggccggtcgtccaagtatagcatggtatgctgtctcgaaatcagcgacttcgaaacaaacattttctgtgcgaaaattctcccgagtgccgaaagtgaccggaagagtgatctagccgagtggtgtagctgataatccagggataacaccgtggaagggtgcattgctcggctttaattccgtgcgaggaatctgcatatcgtccagggtcttagcgaaaaggatgttgagtgcactgccaccatcaatgagagttcttcggagcttgacattgcgaaccactaggtatagtactagggggtaccgccccgggtggaccactcggtcgggatgatccgagcggtcaaacttgattgctatttctgaccaccgaaggtattggggcgtgttgggctgaaccgcattgatctcccgttctgttagcttctgctttctcttagattcataagccagaggtccgccgaagatgtgattgagttctttgcgatgatcttgaaaaccagtcgaggcatcgtcttcatcgtctttcttctttgatgtgccttgctctccgtctgaaggcttacgtgcattcttgacgtattgctccgcaaattgtttgtagacgaagcagtctttggccacgtggttggagttaggatgatgcggacattgggagttcattatcttgtcgaatgtgttgacgcggggacgttgtcgggaagatggagaggttgttgccacaagttcttcgggcttacgcttgcgatccttgcggttgttacttccactccctcctgcggtcggcgtgtccttctttggcttccaagtggtgcccgactgcttggacgctgtaatagcatcttcggctttggcatactcgttggctttttcaaacatttgcttgaccgtcttgggaggtttgcatccgaacttgccgactaggtcctcgtggcgaatgcctttagtaaaggcagcaatgatgacgtcgtcggtgatgtcggagatcttgttgcgttgctcggagaagcgccggatgtaatcttgaagggatcctctagacttctgaacgacgttgtagagatcaaactgtgtgccggggcgttcaaaggtgccctggaagttggcgatgaagtgatcacgaagttctgcccatgatccgattgtgccacggggtagtccgtggagccaggatcgggcggaatccgctagagccacaggcagatagtttgccatggccttgctgtctcctcctgctgcgcggattgcgagaccatagacggtgagccaagactcagggttggtggtgccatcatatttctcaattccagtcggcttaaagccggctggccaatccactcgacgcagatcgcttgtgaaggcagcaactccgtccacatcgttgtcgtaacgatctggtgaatggtggcctcttgctggacggcgctagttgatggtgtcgcgaagatcgatggggcgccttcgatgtggggagtgtggtcgttcaactcgacgctccctataccgttcgggaggtgaacgaacagaccgttcatcatgtcctctgctcctgtgactagatccggcactggcaatgctgaggcatggctggtgatagtcttgagatcgaagatgagggactcggctaccagtcaaggtgcgggtgcttgcggagttggctggacccgaggaagcgatcatggtcttcgtctggttcaagatgttgacaacatgatcagcttggttgagtgcgtcttccttgaggagggtgtcgaggagagtgattgctgcaaccgcgttctgctggggggtgcgaaagaccgctgttccgtcgacgtcttgttgcccaatgagctctctcgctcgcctcccggattccaaggtgcgttgccgtcgatcttcagcctcctttgcaatccgttcgcgatcttgttgctcacgctatagtcgttctcgctcctgtcgctgtcgctcttcctccagtcggcgacgttcagcttcttgccgtgcgcgatcttggtccgcttctcgggctcggcgctgttcctccgtttcgttgtcagccatgaatacaccgaagaagaggggcgtgtagttatcctcatagctgtcgtcgaagttgtcgaggtcgtcgtggtcgtcgtagtcgaggatctcggttggtcgagaactgacgccgggggagctgaggtagccatccaaatcttccgtcgagactgtcccaagaagttggagtataacgccaacctccctggatctagactggatcagggccgatgccggagctcgcctagatctctgagtgggagatgttttgactgtgaagacggcgtccaagtcatcaggaagtttcatcaagattgaaggataggacccgtcgtcttgatctggtcgcggaggagtagattggatctcgtccgagtggtttgaagccgactcggaagatatgatcttggagtaggcctcggccgagttcggaataccgaacggcacggggacctggtctctccctgactggttcgaatccgagtcaaggagagagatcttgctgaagtcgttggtgatgaagttgaggctgccgaaccggaacgcctgcccgggagggaaggcgaagtcgtcgatgccagaaatggaacccatcgcacttagtcggcaaaaacttgacgctgcccctacctggcgcgccaactgtcgaaacaagatttcggcaataataaaagggggtggctatcaagctaggaaagtggatgggtttggagacaaggaattttatacaggttcaggccttcttattcaagaagtaataccctactcctgtccggggatgattccgccgagtatgttattgattgtatatattggaaaaaagaattgcgccccgagaggcacacggaccctccttatataggggaaggagtccgctttacaaaatacagtccatatcctaacggaatatgggattatagataaaatacaatcctaaccgactaagatctcgggtatttccttgacatacaagtaaaaaacaaacccgagtcttcataaagatattctatctatatttggtaccgtatatccgactaaattataactgtcatgtagatatgggatatccatattctccacatggagtgtactgggtgcgtccgtgtcgaaaattcactctgtgattcgcgcagcgaacttttgtcacttaatgccaatattggcctatattagcatacatgggtgcgatgaattttagcggaataaaaaagttcagaaagcaccaaaacatgtttttggacatactgtagagaattgggtgcgtccgtgtcgaaaaatcactccgtgactcgcgcggcaaagttttgtcaattaatgccaatattggcctatgttggcacacgtgggtgcggagttttacaccggaaagaataacttcaaaaagcaccaaaacatgatttttggacatattggaatatgctgggtgagtccgtgtcgaaaaatcactccgtgactcgcgcggcgaacttttgtcaattaatgccaatatagatatatattggcacacgtaggtgcaatgtttttcaccggaatgaaaaacttcaaaaagcaccaaaacatgatttttggacttattggagtatattgggtgcgtccgtgtagaaaaattaatttgtgactcgcgcggcgaacttttatcaactaatgccaatatctttggacatatttgagtatgttgggtgagttggtgtcgaaaaatcgctccgtgactcgcgcgacgaacttttgtcaaataacgccaatattggcctatattggcacacgtgggtgcgatgtttttcaccggaatgaaaaagttcagaaagcacacaaacatgtttttggacatactgtagataattgggtgtgtccgtgtcgaaaaattactccatgactcacgcggcgaagttttgtcaactaataccaatattggcctatgttggacacgtgggtgcgatgtttttcaccggaatgaaaaacttgaaaaagcacgaaaacgtgattttttggacatattggagtatgttgggttagtccgtgtcgaaaaatcactccgtgactcgcgtggcgaacttttgtcaattagtgccactattggcctatattggcacacgtgggtgagttctttttcaccggaatgaaaaagttaaaaaaaaaaccaaaacatgatttttggacatattggagtgtacagggtgcgtccgtgtcgaaaaatcactctgtgactcgcgcggcgaacttttgtcaattaataccgatattggcctatattggcacacgtgggtgcaatgtttttcaccggaaagaaaaacttccaaaagcaccaaaacatgatttttggacatattggagtatgttgggtgagtccgtgtcgaaaaatcactccgtaactcgcgcggcgaacttttgtcaattattgccaatatagacatctattggcacacgtgggtgcaatgtttttcaccggaatgaaaaatttcaaaaagcaccaaaacatgatttttggacatattggagtatattgggtgcgtccgtgtagaaaaatcaatttgtcactcgcgcggcgaacttttatcaattgatgccaatattgccacacgtgggtttcaccgtaatgaaaaagatcaaaaagcaccaaaacatgatttttcgacatattggagtgtattgggtgcgtccgcttcgaaaaatcactccgtgactcgcgcggcgaacttttgtcaattaatgccaatatagatatatactggcacacgtgggtgcaatgtttttcaccggaatgaaaaacttgaaaaagcaccaaaaaatgattcttggacatattggagtctgttgggtgagtctgtatcgaaaaatcactccgtgactcgcgcggtgaacttttgtcaattaatgccaatactggcccatattggcacacgtgggtgcgatgtttttcaccgaaatgaaagacttcaaaaagcaccaaaatatgatttttgggcaaattggagtatgttgggttagtccgtgacgaaaaattactccgtgactcacgcggcgaagttttgtcaattaataccaaaattggcctatgttggcacacgtgggtgtgatgtttttcaccggaatgaaaaacttgaaaaagcaccaaaacgtgatttttggacatattggagtatgttgggtgagtccgtgtcgaaaaataactccgtaactcgcgcggcgaacttttgtcaattaatgccagtattggcctatattgccagacgtgggtgagttgtttttcaccggaatgaaaaagttcaaaaagcaccaaaaacatgatttttggacatattggagtgtacagggtgcgtccgtctcgaaaaatcactctgtgactcgcgcggtgaagttttgtcaattaatgccaatattggcctatattcgcacacgtgggtgcgctgttttttcccggaatgaaaaagttcaaaaagcaccaaaacatgattttaggacttattggagtttactaggtgcatcagtgtcgaaaattcactccgtgattcgcgcaacgaacttttgtcacttaatgccaatattggcctatattagcatacgtgggtgcgatgtattttaccggaatgaaaacgttcagaaagcaccaaaacatgtttttggacatacttgtagagaattgggtgtgtccgtgtcgaaaaatcactccgtgaatcgcgcggcgaacttttgtaaattaatgccaatattggcctatgttggcacacgtgggtgcgatgtttttcaccggaatgaaaaagttcaaaaagcaccaaaacaagatttttggacatattggagtatcttgggtgagtgtcacaccctgagatttttctcccaagcctaaattgaatttataaatggtctcaacaaaataccgctgcaaaagcaagagagaaaccctaaaataattgatgcaaataataatcggaactggcatgtgggattttttcctgagttctacatgtcgaaatacgctaacaagattttagtggaattttaagagctctagaaataattttaatcaattaaaaatgaccacaagcaatatttaattccctagaaattcttttccttatttttctttctttttccctcttttcttttcggaatggtccgccggcccattctctcctccctccccttcccgctgggctggccgcccgagcccctcctctctcccggggtcgccgataggtggggcccacctgtcgagtcctcccccaacctccagccgccgccgcaccctcactaccgcgttttccgggccacgtcggccttgcccgcgcgtgcgcccacgtctcccgcgcccactccctctctctcccgcccgcgcccgcgctcgagacggccaggattcgattttcaaatcccgcctctctctcctctcccactaccccacgtcggctggcgattcccgcctctcctagccacgttcgagctccctctcccctatttaagcatccccactctcccctctctctttttctccatttcgcgagctctcccgtgccctctatcgccctagcgctgtcgccctcctttccgccgccgccgccaccgctccggtcgctgctagccgccgctagccgctgcgccgagccgcgtcgtcgacgccgtcacgttcgccgtcgtgcaggtcaccccgtccgcccctctcccgtcggattccgcctccggaacccactccgcgccttgcgccggtgagcaccgccatggccaccgccttcggccggcgtcctcgccctcttccatcttcctctctctctaacccctttcatcgtgttcgctaggtggttccagagctcgtcccgttgccgtcatcgccctccgtcgctcgccgtcatcaatcgccgtcggtgagacacctcctccccttcctccctctctctcccacgccgcttagtcgccgcgctgccgcctagctgcttagccgccgctagcatcacccgcgccgtcgcgccgccgccgcttgccgtcggtcaccgctgtctgccgccgccgccctgcggtagcgccgctgtgcaccgtggccatcgggccggcttgggccgcccgtgtgtgccggccgcgtgctccccgccgccgtccgatctactctcgggtagatcggggccgtcggttcggccacccgcgtggcgtgccatgtggccgccacgtgtgcgccacgtcggcgccacgtcagcgccacgtcgtgtgcctcccccttctccggtccgtggactcggtccactgtggaccgccacccgagtcactgccatgtggggcccacatgttggcgccgcccctctctcctagggtctatttattgcgcaataaatcaattaaggatttttctgtttatagtaaaagcacagtgaatcttctaaaattcatatctaattcatccgagctccgtttaagcccattcaagtctcagtaaatcaagaaaaatgagtagaatccattaaaaatggttttgttctctgtttcagtagtcttattgcctgtttgtattgtttgctttgtatgtcgcttagattccggctctcccgacgctccggtgtactttgaaatagtcgccgaggttcctccagcagcagagcaaggcaagtcatgcttgtcacttgaagatgttgatcctatattgcaaatgttctattgttttccttcaaatattgcattgtttcataatgatactatgggatgtttacctactgttacagccatgctatttctgtaccatgctcctttgttagcttgggatataaacatgactagagattggactagggattgcttagccatgcttagttcaactagcacacaatgggggaaatcacattaatgcatagatatcagattctagtaatgacgttggttaatgccaccgctccggtgttggttaattaaaatatatcaaatggtgggctgtgggtgcatggttttgttggtcgcgcccatggcatttaaggaccggttcgcgggatgccctggaagaacttatcatacttaccacaagccagcgtgtgcaacggctgggcttgtagtgtagttttcctctagttgacgcatccaggaaagggtgggcgtgatggagcagggcgggccctgtgacggcctctgtcgcttccggattcacctaggcacgagaggggactgcccgttgcccgctggggacggggtgaaacctgaggtgtggtgtgcttggctagagggggttatgcgaagagtcctgtcacggcctctttccggtatgtcgtggtggcatgtcggcgcacggaaacgtgtcgtggggctgtgttttgtgggtacagttgtacacctctgatcagagtaaaactatttgaatagccttgcccgcggttatgggcggtcaaccagattcaccgtgattagtctcaccctagtttaatatgatggaactgattagttcaggtggttggttgggcctgttgcaacgtggtgtagcgttggacagtggatggctaatattgattaattattacacctgatttcctgctttcaactactgtttataaatgctcgttttacgcaaaagaacctctctagctatcctttggtaatatcctgcatcataccccctgttccggtatgacttgctgagtgtggtggttatactcagtcttgctctattttccccaaaccccagagtttgagtatgcgttagatggtggtttctccgaggaataggcttcgttcgtgccgtcgaggatgcctgtggactggtgttcccgctgcagtccaagtcaaggcttagctccagttatcttttatttttccgctacatttatgtaagacttttataatttttgtaagacgtggatctgtatgtcaactttgtcgtttgtgtaccccccggccggtcctggatggggattttaatgcacattctgcttggaattctattcgggaatttctgggcgtgacaacttggtatcagagccaaccttgaccgtaggacaagccaaatgggaaaaaacctaagagccctctgaatccttttcattgcatatgttctttgcaattggatttgttccgggaaaattgggatctgttcttgtggttcaagggaaaaatcttggtcgctcgtttaagtgagatttgtcaaattaggtcagtctagggtttgatgggaggaatgcattaggtcctaactcaggaatatgggttgcaaggtattaatgctcttattattattattagtatgtatctaatttctcattattttatcgctatgtaagtccgtcttatttattcgccctcatgcaaaaatggtctatgcacaaaactctgctctcaattgttcattttaattgagtcttttactactttatttaaattggatttgagcatgcattgatcctacccctttgtcttctctagatggccgaccacccacccaaccaccacggagaaggcatggatgattttgtggcagagttggctcgcatgaccctggtggtgggctacctgttaacaaccgaatttggtaacatcagcatcatgaaagaagattagatcgaagcaaaattggaggcggagatcgagttcggaaacagggcaggaatcgctggagtccaaatcggctacgattaggatcggctgggtctgagtcagactaggtaagccgatacagctgattccgacaatgcagcttgatgtatgatatcgggttggattgaggtgcttcaaggtgattgccgcacatggatagagtcctgagaaggcaattgtatctattaattagggtgttttatgtaatctccttagagatacgattgggcaaaagtctgccacaaagacttatgctatcttagagtttgctagagatagtagtcgtgtccgttatgtacatatcttgtaattcagagtatcataaagctgcatcggtttcgatcttcaacaagaggtaaaacttgttatgacgacttgtgttctcgggattagtgcttccatctttatgatactctgatctcgtttatgtaattcgtcgagttatcatatatcttacataatctccggcaatactgctatctaatctacaatcggctaacatctgtctgtagaaggcagccgattaggttagatatcgatgttgacttagattgtataaggtatctaccactctatgaaacttctagcggcttgattgtctagatattgttcttcttttcatacttaatgctgcatcagttgagtttgatctattaagtcgtgcttagaatatcaatctctagcctgccttctggttgccgattagggtagcatcggagtttcagccgaccttatctgatttaactatatttgctctatatgcttcattgacatgttaaatctgcccattatgtcaagatattgctgtatctaagtatcttaggcctttgtttgatatattatacctgttttaatatcctgatatagagtagtatcagagtattagccgatacatgctagatctatctgatcggctatgctataaacatatatagccctgttattaatatatacttcgatctaagtgatttataatgtcttggcatggcggccgatctatcccaatcacttgatttaagtatatatcgatataagaactatatattggaaatatctacagccgatcgaatagatttggttctttattgtctatttacaactgccgatcaattcacatatgacatcggctcaaagataaatgatatgtcatcggcacctagccgatcggctatcatttatagatttaaccgcggtttctttgcctttatttcttgttaattacaggatcaaatcaactggcatgctagtacacccgaaggcgagctttggacctgcactggagttaagcagatctcccaggcctcgtgttttctctcaacactaccccaacgtgccggagtactcgaccgttcctccactcagtggcgagcttccccaccattttcgtctggaggttcatggctatgtgggcacctgcctcgctaatacggtggttgaggcatctggaggctccgcagatcacgcttgtcaggaggcagcatatctgatgatggctagacttcgtgatcgccacaactacatcttctacaacacggcgtaccgcttccaccctcgccgagcaagtggcgacgacgccagcaccttccgcccgacagccggcgagaacaacaccaccttcggccacatgtgcgccgtgatgaggggaatggacaggatgcactctgacctgcacaaggcatccaaggccttgaatgatgggaagcttgtgaggatcatagctctaaaggatgagatagcacgcctgaagaaggagaacgctcaattgaagggtcttccagcgccaggaggagttcggatccgcaccacgccccgcaagtctacgactgctcccgtgcgcattcagcttgcacccaagaacccacctcttcccgcagctcctcccgcagcacccgtagctccagctccagccccagctcctgtgccagtgtcagctcccgcgtccgctctctccttcgctccagcgtcagccgccaggggtccagccagtggcaacggaggttggttgcctactactcctagtggcagccgcgaccatagcagcagcagttccagtggctcagagctgggcagcggtgagacgtatctgccagactccaggagccgctcagaggggcctggcgacgagcaggaggacgccttcgactccaccgactgcaggagccgttccgagcattaggctcattttcccttagtttatcgactgtttagtaattgcctgttagtttgtgtgtttaggattgttcgcttgtgggtcagtcgacagtcgatatcatgtgcctatgatatggctgtcttaataaggatttgcttgctgttttaagtgttttaattcagatcaaaacaattgcagtttaaattctgtcacgtcctgatttttcgctttctgttcttctcgcctatttgcgaaatttcacatttggtttattcgtctaaaatagcttaatgaaaatttcgttaaatcaaacggttttaaagtgattaattaattaattatgttgttcgctttgtgattcttaattggagttagttggatttaatttgtatttcggaagtggagctcaatccctaattcaaattccatccaaatccaatattccttttcaaatcctaaatccttcccaaaaatttcaaatactttatatttggaattttccagagaagtccctgtctttttccctttttccttcctctctgtttctctattctgcccttattcttctttctttttctttttcccccaccttcttctacctccagctctctctctccttcttgagctgcaggcccggggaggccaagccccgagcccacgtgccgccgcggcccggcctcctcctcctctctatgtcgccggcccaagccgccgccgaccgagcccgcgccggccgcgccgcaagcccacacggccgacgccaaatcccgcaagccgcgccaccaaattcggagccgccgcttttccaaagcttgcaccgtgcgccctaaccctagctactccctcccctataaataccatcggccaccgcccctttttccccctttttccaaagccgccgccatctccaccgtgagcagccgccgccaccgttgcttcgtgccgccgtcgggagccgcgccgtcgtcgtcaccatctccttcccgtgccgccgccgctggtaaagccccgaggctgagccctctctccctttcgagccgccgtttctctctccacctcaactccggcgtccgcctctcatcgccgtgcgccatctccacgccgtcccggagctcggtgctacgccaccgcgttggcctccacctcctctgcctccaccactatttgctgcagccgccatgcgccatcgccgacgaaagccgccgatgccgccgcgctggagccgccggtcctgccatggccagagcacgcccaggccgtgtgatggagcagctgctgcttgccttctcccctgtgacaccgacgtgtgggacctgccatccaaaatcctcaaataaatctaagccgtccaaatccctagatcaaatcccagcagttggatctacataatcccttctttcgccacgtcagccctatatccatccatgtcagtgccacctcatcgccttgtgtcgccacgtgtcgttccacgtcatcgagtccacatacaccgagtccacccatacactatgccaatgacagtgggcccacatatattttttcctatccaaaattaattcaatttccgaaattaaatatccagagaatattcttggaatattcctttttcttttatcctcggattttccccgaattcaaacttcaggaggccataacttttccgtttgaactccgattcgatccattcttcctcctaaattcttctaaaatcgagctttacctcctgatttaattggttatttcatttgatgttatttagttattttttctttgtgtttatttgtttttcgtttgcaatcgtgtagacgttggagcggaagagcagtttgcttcagaagacgctgtgcaaggacagtactaggatcaaggcaagtgcactctttgaacatattgaacccatttgtgaaatgttttgttttgaatacatgcattgttttgtttataaaccatcgatgggtagcgtgacctaattgttattattatcctacctttgataattattgattgcccatgattccttgtcaccctagtctttgtgaattgaacattgggctgaactcatggtagatcgtggcacaaaagaagagagaattccgagccctccaccagggcaacaggacagtgtctgagtatctccatgagttcaatcatctagcgcgatatgcaccggaggatgtccgcactgacgtagagaagcaggagaagttcctagcaggcctggatgacgagctgaccaaccagttgatctctagagactacgccaactttgagaactaggttgacaaggcaatccgtcaggaggatcagcgcaacaaaatggacaggaacagaaaggcagcgtagttccggtccaaccaaggaaaccaccagcgatcgcgcttcactccaggacagcagggtggacctactgttggcaactttttgtgacaagttgacaagcacgatcgcagcacctaaagccttgcggtgatcctagagtcgccaaccacctcgatctagcaaagagctaaacctagatgggttttgataactaaaccggctagcggagccgatttctagataactacccatcttgtgggcaaaacggaaggttttcaggacaaacctacaaagaggtgtcgcactctcgcagcggcggtggacggtttacggcgcaaaccgacaaagatggacaaactaagagaaaattaaaagcaatatgaaaaacgattcgattgattgattgtagattgattttttacaatgaaccggccatgtcccttatataggtgttggtcttgccctatacaggccctcctccaagtccaactgcggggtagaaaccaaaggaaacccaaaacatgccttcccgagcaaggaaccttgagacccgacgaaacacagtcggactagaacctgccggtcagaccggccacacaccgccggtctgaccggctctcaaccggcggtctgaccggccaagacacggcggtcagaccggcccactcggaggaaaccggtagacttccaaattttggcaatctttcctattttaatcctaggtgccaaatttgggtgtaaacatatgcccccctgcctttttgatgaacaacgtgaatctaaaagcatagaacatgttttggtcttaggacgataaatcaattaccagccatagtacctcctaagcgtcttgccaaacgctcgggaagtatttcttcaagtatttcccgttgattgctcgctgaaaacgctccccttgaagtgtctccaaaaaatatgcgttccctcgaacaatgccgcatacttgataaggaccctcccaactaggagaccactaactgaactccttggatcgagtacccaatggcaaaattgtcttccaaaccaagtctccaacttgaaacaactttgctttcacccttttgttttacgccttggccactctcttcttctctttctctatttattccaatgctttcaagcggttgtcgatgacttcatcaagattgtctcccatcaacgtcttgtaatcttcatttgacaaatcatcttgcttgatataacgaagagaaccaagatttacctccaccggtaaaacggcttcttgaccataaaccaactcaaaaggagtgactttagtggcaccatgtttagaaatcctatgcgcccacaatgcttcggaaagcatctcatgccacctctttgggtgttcctcaatcttcttcttcactaacttcaacaatgtcttattactcgactcggcttgtccattagcctgagcgtagtaaggagaagaactcaacaatttaataccataagattcggtaaaactcttcacttccttagacatagaagaagcaccttggtccgtagttaatgtttgtggaataccgaatctatggataatatgcttcaaaataaagtcaattacctctgtatgagtcatattcttcaaaggcacgaagcccacttggtgaagtaatccgtagcaactagcagaaacctatgcccctttgatgacgaaggataaatttgaccaatgaaatccaaagcccatcctcggaatgaccatggtttgattatgggattcaacacggcggcgggcgccaattgaacattgccgaaccgttgacaagcctcgcgtcctctataatatttgaagcaattatcaatcatcttcggccaatagaacccagctctcctaagcaaccaattcatcttgtgggccgattgatgagttccacaaattccttcatgtacctctcccatagccactttagattgatcttcatctaagcacttcaacaagacaccatctatatttcggcgatacaaatctccatcaagcaatgtatatttgaatgcttgccgccgaattttgcgatcaaccttcaaatatcgaattttgcgtaggatctttcaaatatcgaatcaaaggaattctccaatattcttctgttccctgggcacaaatgtctgaattcacagttaattcagcctctaaattgattgaaacgtgccccccagcattctgcccagaaccggtcagaccgaccacgcagggccggtcagaccgctctgggtcgccggtcagaccggcagcatgcggccggtcagaccgcccctggttaccggtcagaccggcagtgcaatgccggtcagaccatccctggtctccagttttgccaatttcgcacaaagatttaaaatcaagcaccggctcttctaatatcagaaataatcccttcttcacattatagccagatgcttgttgtgccaagtcatttgctctagaattatcatgcctaacaatatatctaatagaaaaattatcaaaattggcaataatatctaaacatgaattgaggtacctatttagtgatccgtccaagcatttgtagactccggtgacttgttgcaccaccaattccgaatcaccaaaagcttccatgtatttagctccaaccatcaccataacttgtaagccaaacaataaagcattgtattcgacttgcttatttgtacaataatactccaaacgaacagatgcttcataacacatgccattaggtgaaaagaaaactacccctatgccttgaccttctttgcaagaagaaccatcaaaataaatcttccaaggataacttcaactaagcaaacctctccctcataagcaatatctgtatgatggtctactataaaaccacatacaatttggcctttcatagatttcaatggttcataagccaaatcatattctatcaaaacatatgcccacttgccaattctcccacttagaattggcctttgcaacatgtgtttaataacatcggcttgacaagtaactatgcatgtactatataacaaataatgcctcaatttggtacaagcatagtataagcatagacaaagtctctctataaaaacatacctcgttttggcatctaaaagacggcggctcaaatatgtaatgatatattccttgccatcttcctcttgtgtcaaaacggcaccaataactttgtcttcggaggcaatatataaccgaaaaggctttccagctttaggcgctcgtacaacgggtggagtagacaaatatctcttcaactcttcaaacgcctcttgttgttttgcccccaagtaacatcggcttcttttttcaagcgaagtataggaacaaaagcatcgattttacccgctaggttagaaataaaccttctcaaataattcactttacctagcaacttttgggcctccttcttgcatgtcggcgctttgaaatcacgaatcttctctatcttcttaggatcaatctcaactcctctctcatacaccatgaatcctaagaacttccccgccgacacaccaaaagcacatttaagtgggttcatcttcaaaccataccggcgcatcctctcaaaagctaacctcaaatcggccatgtgtccttccataccatccgatttgacaacaatatcatcaatatagatctctaggataatacctaataaatcatgaaagattaaattcattgtcctttgatatgttgcaccggcattcttcaacccaaaagtcatgacaacccactcaaataaaccaacaaatcctgggcacctaaaagccatcttgtacatatcctcttccgccataaagatttgattgtagccggcattaccatctagaaagctaatcaccttatgacccgaggcatcattaatcatcatgtcggctataggcataggatactcatctttgggagtagctttatttagatctctaaaatatatgcaaactccaatcttaccactccccttcttctccactaggactctgctagagacccactccacataacgacatggcctaataaaccctgccttcaacaaccgatcaatctcctctttgactcggtcatatagcaaaggattaaaacgacgaggtggttgcttataaggcctaaaacctggtttaattggaagccgatgctcaacgagctcacggctaagacctggcatctcatgatattcccatgcagagcaatcaacatactctttaagtagctcgattatcttaaccttataatcggctcatatttttgtttacaaaagtcagccttggtttggttccatcacctatgtccacttcctccaatggatcggccgatgtaaacccttgtccaagcttctctacttcatcaaaatcttcaatggtttcgccaatatcgttctttgtagaccgatattcttgcaccctcttttgtaaccactctaaattagcctctttactcattatacaaatttatatggcttagccgtgctacactagccggctttacagaaataggtacaaatttgccatcggagatactaataaaatcatagctagaaagttccctccctgataagcattggatattcccatgacgccactcaaaagtagcatcggccattgcaacctcggccgatgtatccgcttgaacaatttcaacatcatcgccgtcccattgaattaaacattgatgcaaggtagaaggcacacaacaattggcatgaatcaaacaacgacccaaaataacattgtagttaccttgcacatcgacgatgaagaaagcggttggtagcgtcttgtttcccacggtgaacttcgccgaaaagataccctttgcctctgttggttcaccattgaagccattgagaatcatgttggtcttcttcaactcatcatcctcacgccccaacttcttgaacaatgaatacggcatcaagttcacggcggcacctctatccactagcatcgtagagaccggcttcccaccaacatggcctttgagatagagaggcttcatgtgacggtttgactcatcgggcttctcaaaaaccgcgtctttaggacctaatgagaattgagcaacctcggcttcatccatagcacaaaactccataggcaacatacataccatgttgatatccatgtcttcttttggagatgattcacctttatcaaccgattgctcctccctctcctctacaacaactggcttttccttctctatggatttacgcctccataccagtggcggtcgcaactcattgaaccttttatctctttgttcttcagcttttttctctcttatctcttgagcccgaagacgttgcaaccttctcttttgagtagccgtcaaatccttaggcatccacctaggattcggctctgttctaggaggtaaataatgtcccctattaatcttgtttgaagacgatgaagccttcatatcgccctttgcaattcccctgtcaaaccggcgctggagcctgatcagaccggacgtagaccaccggtcagaccggccagacatgccggtcagaccgacacttgacgcacggtcagaccggcccgaggcatcggtcggaccactgtcgggtcggcggtcagactgacctgatgacccggtcagaccggccgcatggctgcggtcagaccggccagaaggcctggtcagaccggccgactgcgaggagttggttttggcttcggattttttgtttgaggatactccaactccatctccagaaggtattggcacatcatgagaccccactttgatggtaattacttctgaagtccttgcctccaccttgacgcgctttccttccctcttttcattattagcccgattcttaccataaaaccgcctattgtttggtgaagagaaacgctcatgaattggcctcctcggtcctccccatccttggttaaattgcattggaggcatatgattgaaaatttgcggcgttgccccccatggcatgaagtaaggataaggataacccggcggcgacattcgataagaaccccatgacatgtcttgtggatgatgatatggaggtgaatgcgaccgtcttggtgaatgaccaaatcgctccctaggaggtgatcttggtcttttccccttgttgtgaaccctctcaccaccttgcttctcatacttctccaaaagcataccaaaagtcactttggtcttcctaggggctttagaagttgaagcgccactcttattctccttccaaacactaacttccggtttctttgtcactatcatcttaggccttggctcgccaatgaccactccttttcctttagtagattctgcttgctccggccgaattaacacctttttatcattgaaattaattgtattcaccgaaaaaggatcatgatcaagcttcatcttggagccatcagtgaacttcaatcgtccttcatctatggccgattgaacctgtcgtcgaaacacattgcaatcattagtagaatgagaatgagaatcatgccatttacaatatgctcggcgtttaaactcttcttgagatggtatgacatggcctttaggtaatctaatttgtttttcttgtaaaagataatcaaaaatcttatcacacttggccacatcaaaactatatttaacctcactttgccgatctttgcgaggagtcggcattaggttggagcaaacaaaaggcttgtttttgttagtccatgaccattcagcaacatatatatcatgatcaccctcctcctcactatcactagcctcagggtaatcaatcacattaacattaggctttttgtcataagatctgacaagttttttattatccttaactcggctttcttgagccagagccctttgcatgagttgactaacatcaagaaattgttggccatctagtctttctctaagaggagcaattaaaccattaaaagcaagatcagccaaatctctattagttatattcaaggtataacatcggtttctaacatctctaaatctcttaatataatcaatgacagattcattatatttttgcttaaccgatgttaaatcacataacctaagctcagtttctccagtatagaaataatcatgaaatttttcttctaattgagcccaagtatgaatagaatttgctggtaaagaagtaaaccatgtaaaagcattaccggacaaagataaagaaaacaagcgcagattaaaagtatcactattagcctcaccacattgcaccaaaaaattgacctacatgctcccatgtggtcttactatcctcaccactaaacttggtaaattcgggaactctataattacggggaaacggcacattatcataataatcaggatacggctttttgtaaaccctagcacaatacccagtttcaatcccgaatctattcctaataatctcactaattatgtcctccatattattaagcccatgttgatttggcggtggatttggtggcctaataggttgtgtttgttccgcaatatgattatattggccttgtctagtatcgggaggataccccctagcaacatcattataagcattaggaacatgtgggggaacttggagattatttgcagcagtagatataggaggatcaaatgttctaagatgatacaaataactagcattagtcatcggatcgatcccctgtatcggtataattgtgccgttctgatcggccgtttggccggtcagaccgacggctaagtcgtggtttgaccggccgtcaggcccggtcagaccggccgtgtgcgccgctccatcggttttactacccgtttgatctataggaggttggttagcagtggtagaggctttatcctttgacatgtaatcggccataagagggccgaatttaacccttaaaaactcatcaaatttaccctcaaaagttgcatctaacttatctttaaaagcaatcatagatgaatctattgtagatgctacttgttgttggatagattgtgttacctcatcattacttaccaagtcgggggcgagcttaggacgtggcccgggcttaataatcacgccttgacgagtcctagtgcttgccctcatcaacgcctcccgtgtgagctcgttgatgtactcctccatagctttgcggtcctctccttcggaatcctccaatgtgaccggtatcacattagatggctccacctccgtcttggatggcggcttcgtcatggtgaagtcgaagttgagttgacgatgaacggatctccttcccagtggagtcgccaaaaatcgtgttggcaactttttgtgacaagttgacaagcacgatcgcagcacctaaagccttgcggtgatcctagagtcgctaaccacctcgatctagcaaagagctaaacctagatgggttttggtaactaaaccggctagcggagccgatttctagataactacccgtctcgtgggcaaaacggaaggttttcaggacaaacctacaaagaggtgtcgcacactcgcagcggcggcagacggtttacggcgcaaaccgacaaagatggacaaactaagagaaaattaaaagcaatatgaaaaacgattcaactgattgattgtagatcgattttttacaatgaaccggccatgtcccttatataggggttggtcttgctgatgaaccctgagttcctctcgacactcaaggctgttgttggcccgatcttttggtgagttgtgataactacgatttgggagaaacgttgacaatccgactacaaccgtacgagacgttgtgttgcgccttagcgatcgatacacctctctgtgggttgttgatcttgccggtgcagatcaaccctatacctgcaagcaaatagaagaaacaagcaagaacaagataaaagcaatctgatattgcaaataggaatttaatacaaatgataagttggggttccgaagaacaagcagacggacggtctagccgacacgcgcgctgcaagcaagtagcaatggcttgcatcaaaaccctgaaggggtaactagctatatataggggtgggaggacgacctaggggtgcctagggtcgtactccaccagcttggggcgcaccccacatgggccccacctggaccggggtcccaaatgaagaagttacaagcccacaggttcatgacaggtgacgcagcaccttgtttcttcatctgtggatgacttcgatggaatttggcgatgatgccaaatccgttggaaagaggactccgagagctttccatcaagtactcatgggccgaaaaggaggtcgtatgcagattcggcggccatttgaagtcagcagtgtagcaggtggccgaatctgattccagcacttggaggacttgatctggatattatcttgttcatccatgatgtgagcaatggttgtatccatagtagccatggtcacatcacttgccctctacaggccctcctccacatccaactcgggttagaaaccaaagganacccaaaacatgccttcccgagcaagcaaacctcgagacctgacgaaacacagtcgaactcagacctgccggtcagaccggccacacaccgccggtctgaccggctctcaaccggcggtctgaccggccaagacatggctgtcagaccggcccactcggaggaaaccggtagacttccaattttcggcaatctttcctattttaatcctaggtgccaaatttgggtgtaaacacctaccaccatgatcgtccgccaacatcgccctttcaactcgagcagcttccaccagggcgctagtggcagccagaaccaccagggaggtcagcccaaccgcagtgcagctccacgcccaccattggcaccagcacagtcagctccatcagcccaagccaagaaggagactggagcaaagccaggatcctgcttcaactgtggcgagcatggccactttgctgacaaatgcccgaagccaaggcgtgccgggccaaggtttgcccaggctcgtgtcaaccacgcgtccgcagaagaggcgcaagtagcaccagaggtcgtactgggtacgtttcctgttaactcaatccctacaacagtacttttcgattctggtgcaacgcattcgttcattggaaagaagtttgttgggatacatgggttaataagggaagaacttagtacaccaatgcgggttcataccctagggaatagctccacttcggttcaattcagcccttctataacaatagaaatccaaagatcaccatttctagccaacctcattcttctcgaatccaaagacctagatatcaatcttgggatggattggctaaccaagttcaagggtgtcattgattgtgtgaatcgcacagtcaccttgaccaatgagaagggagaaacagtagtgtacaaatctccagtctcaccaaagcagggggtctccttgaatcagattgaggtggaaattccagtggtcaccgaggagaagagttcgaggaagttggaagatatccccatagtctgcaagtatccagaagtgttccccgaggacctcactaccatgccacccaagagagagattgaattccggattgatttggcaccgggaactgctccaatttacataagaccgtacagaatggcagccaacgagctagcagaggtcaagaagcaggttgatgagcagctgcagaaagggtacattcgaccgagtacttcactttggggtgctccagtcatttttgtggagaagaaggacaagacgaagagaatgtgtgtcgattatcgcacactcaatgaggtcactttcaagaacaaatacccgttgccgcggattgatgatctgttcaatcagctgaaaggagccaaggtgttttccataatagacctgcgatcaggctacaaccagttgaggatttgggaagaggatattcccaagtcagcctttaccacttggtatgggttgtatgagtgcacggttatatcttttggacttaccaatgcacctgcattcttcatgaacctgatgaacaaagtgttcatggaatttctcgataagtttgttgtggtattcattgacgacatacttatctattcaaagtctgaagaagaacatgagcaacatctccttctagtactcgagaagttgaaggagcaccagttatatgccaagttcagtaagtgtgacttctggttgtcggaagtcaaatttctgggtcacgtcattacagctcagggcgtggcagtcgatccaccgaatgtggagtcagttaccaaatggaccccacctaagaccgtgtcatagattcggagttttcttcgacttgcaggttattaccgtcggttcattgaaaatttctccaggatcgctagacccatgactcagttgcttaagaaagatgagaaatttaaatggacggccgagtgtgacaagagttttgaggagctcaagaagagattagtgtctgctccagttctgattctgcccgaccaaacaaaggacttccaagtctattgcgacgcgtcccgccacgggcttggatgtgttctaatgcaaaacggcaaagtggtcgcttatgcctcgcggcagttgcgtccacatgaagggaactatccaacacatgacctggaattggcagcggtggttcatgctttgaaaatctggaggcaatatctgattggcaaccactgcgaagtatatatagatcacaagagtctgaaatatatcttcacccaacctgatctaaatctccgacagcgaagatggttggagttaatcaaagattatgacatgagcattcactaccatccaggcaaagccaatgtggtggcagatgcattaagcaggaagagctactacaatgctttatgcaccgaaggcatgtgtaaggaattgcagcaagagcttgaacgtctcaacatgggaatcgtagaacacgggttcgtagctgctctagaggcacgtcctacgctcgtggatcaagtcagagcagctcaagtaaatgatcctgagatagctgaactgaaaaagaatatgtgggttggaaaagcccgggatttccttgaagatgaacatggcacaatctgcatgggagaaagattgtgtgtgcctgatgacaaagagctaaaagatctgatactcactgaggctcatcaaactcaatactccattcatcggggtagtaccaagatgtaccaagatctcaaagaaaatttttggtgggccagcatgaggagggaaatagctgaattcgtcgcgctctgcgatgtttgtcagcgagttaaagcagaacatcagaggcccgcaggattgttacaacctcttcagatcccggaatggaaatgggaagaaattgggatagatttcataacaggtctgccaggacatcatcgggccacgattcaatctgggtggtcgtggatcgacttaccaaagttgctcatttcattcctgtgcatactacatatacaggcaaaaggttggcagagctctatctctcgagaatcatgtgtctgcatggagtacccaaaaagatagtatctgatcgagggagccaattcacttcaaagttctggcagaaattgcaagaggaattgggaacccggctgaacttcagcacagcctaccatccgcagaccgatggtcagaccgagcgggtcaatcaaatattggaggatatgttaagggcttgtgcgcttgattttagtggagcatgggacaa

SEQ ID NO: 71115 - DNA, 56116 bp, Oryza sativa
tgggaagaaaaaaacaacaagaagttgtcgcactctgttgctccagctcgaggaattttgtttcttccccaacgttttttttggactgtgttgtgcgcaatgatcacggagtaattaactttgcttgtccgaatgcagatcatacttgctggtcctggggataaaactcactggtgattgatgaagacgaactgtaccagctaacctcttgtacgagctcagaccctgtgtttggaatcattgtacatctgtgtcgttgtagttagatactctaatacatatctgatctgtgaggtgtattgtagtgaggggtagtttagtagtagtaggttcgccaaggcatcgtttttactgccttgcgggtcagtctagtttagttggtacattatatttctcatttctgagagagagacacccacgcatgttgtagctgtgtcagtactctagtgtatgtaactttgttcatgaaactgtttaccaaacataatggactatccccctttctgcttatcttggctctctgtttggagagcttatggtagatggtgcttctcataaaatctcgacctctcttgaataactcagtttttttaattctcaatagctgtttttcgaaatgtaaagctctcctaagagcaagtttaccgcggaacgtgcgtgaagcgtcatcactgttgtggtgccgtgcagcgcagggctcaatactgggtgagttggcccttggccggtcctcggcaagatgccaagatgacctttgggcaagactgccacttgttgtgactgtaccttggaagcaactggctttgttcggtcaattcccatgaggcagggattcgagggaaattattccacacctattgtggtgttgaattattctccctcaatccccttcaatctccctcaaaccgaacaaggtcttaggccctgtttgttttagcttaagattattgtaatctagattattgaactagattactataagctagattataataagctaacataaaataagctgctagctgtttgtttctctagattattatctgtttgttaactgttagccacccattaatctaaaaaaagcacctttagagtggcttaccagattatagtaatttgacttatagattataataatatattataataagctatctgtttatttcagcttacttctaataatttagattataataatactaagctgaatcaaacatggccttaagctggaaaataatcctgggagagcaggtaaaattaatccatacttgaaaaaaactggtctcataggattattttctcttttaaggcctcgtttgaaataaacgaagaaaacacatgaatagaaaaaaaatgcaggaatatgatatagtgtaaagttgataactaagaaattcaaaacacatgatagaagaagtttaggctgtttacatgaaaaaagagagagagagagagagagagagagagagagagagagagagagagagagagacggatggaaggatgaagcaaagggaatcttcctttggatcaaagtagatgttttatatttcctaacaaaatggaggaaatgttttccgaaggaattcaacaaccccattcctttgttccaaacaagctcatagggaaaaaaagatccaaaggattgcaaacctccaaaaatcctttaaaaaccaatgttccaaacagggcctatgcttgtatagctcgcttattactcactgatcagcagggagcatcttccttcagattgctcgtcttccatgactcctctagtcctcttgaacgcagaaattttacaggaattttgcataaattagttctgcacccacgaaaatcctcaaaatttctactttctgagctcactgactttttcacactacagctatttagtatcaaataacttgaacttcacatctatcaagcaagcaagtcaaaagcaggggaaccaattgacttccttttcctctacggacagacaaaactgtcataaacaagtcaacatgtaataacagcaaagcttcccaagcgggagctttaagaaaacactcagtgagcaacagctttttgagccttgtttgggaggatactgtccgggaggataagctctggtgggatctcacggaccacgccgagcatcgaatcgtactcctcgtctttgtgcgcaaacttcttcctcagcatcttctcgagctcaatctcatcgaaggtcttggcattctcggctgcgtggacttgagccaaattgatatagtttgttgctgactgtgcaatgaacgccatctcctcttcagtaagctttcttaggaacttggcaggattaccaacccagacctagcaatgtcaggaaacgatatggtttaataaagccatgcaatgtattaacttaaccataaaatataaatacaaagcatatttaaatcttgcagctgttcacaacaagtgtggaacataaaacatggacatcagtataaacatgcagccagcagctttgtttagtaatcctccagtccccgattacagttttataaataaggaaattcatgcaaaatatgtgtcaacacatcataactgtaaattaagggaaaaatgcagactaaacctctacctcagaatcattcaattgcattattcgaaaacaattaggtatttttctgaacaaagagcatgccaattttgtaatcatataccagcatctctgagaattacctcattacaaaatgttggcagttgattgcacatttctcatatagcaagtgaaaaaaaaaaacttgcttagcaagaaaataggaaggtaacctctccagaaggaatcctggtgttttgctttacaagggatcctgcaccaaccatgctgtgcttttcaaccaccactccatcaagcagagtggcacccataccaacaaaagcttcatcctcgacgatgcatgcgtgtagaacagcactgtgacctggcagaagctttattgtttaggtaggtgcatagcacagtgtcacagtgaatagtccatgcgaaatgaagctcagaattttaactcgtaaatcaatcacaaagcagcaatggaaaccatatttttacgattttatcaggtataaatgatgccatgtggttaatgtcttccagaaaagccaaatcacaacttcaatagcatatcagagtgtatattacgaattaagataggaagtgctctactgacctattgtaacactgtttccaattatggttgggagaaccttcccactgatattagcttttgaaacatgtacaagggaattgtcttgtatatttgttccaactccaatatgaatgctgttgacatcacctgaggacaaaagaatgaaaaggagctaaaatggttatcaccgcaccgtggaagtatccaaagtacaacttcaacactatagttactgaaactttaaatatcaatatgctagggttaacccagtatgtatgacagcacaaatgcctcacaccatgataaaagatcatatggtgtaggaggaacgttatcatgtgaatgaagctgcttgaatcctttttctacttggatttggttgtaaaggagaccatacaggcattggtcaaaaccattctcacctaattgttttcttaagagctactagtatgttactccctccgtttcatattataagactttctagcattgcccatattcatatagatgttaatgaatctagacacacatatatgtttagattcattaatgaatatatgaatgtggacaatactagaaagtcttataatatgaaacggaggaagtagtacttaatgctttatggttgggagaaccttcccacatcatcgttgagagcccaacacatcatcgttgcaggttaaaaactcgaacttcatgtgaagtgtcagttgagagcccaacaatgaaaagatgagtgtactagagctgtttgataaaactgtgcatctccgtacgactggtggttctgtcagttgtctatgtagtaccattcatcataacaatgagtgtactgcagtcagaagcaagtttattccaaaaacaaaaatgtacagtaaacaaggtgtaacaaagaaagaaatgggaaacaaattatcaagacaaagcccatgcttactcacatgtgtaataatactacagtgtatatcgaccaagagtttacctcttaaaatggagccataccagattgaggatccatgtccaatctcaatatcaccaatcacagctgcactgggagcaacaaaaacatccttgtggattctgggctctttctcaaatatgttcatgattgtgcgatgccttggcactgacaagggcatacaaaacggtaacatgatagtcaggctcaaccataaagtttatgtaccttgctaaattcattagctcgtggttattctaaaatgacctatctagacataataccaaaacctttttgatacaatgtccaatttatgctaattcaaggccctctacaagatgcagcatggtggaaatcaatcaacaccaactacagcaccacacctaactagaaggtggaacaaatgacattcttcatgatgctacgcaacagaaaatagatgcataaccactcgaaaattggcatgccaaattgccaatgtgacactcccacaatgggcagtatgaccgcaataaccaatatgcgcaatccttgatttacttgctgcagttttcacacacgagatcgatcactagttgaaaacctggaatgcagaacttcacaaataaccgacgataatttaggctcatttcgagactcctcgaatccagtcaccccctatccattcctaccaatttcttcccaataacaactgccaaattgtcagagagagagacggcggctgctgctgcttacgctgctcgtcgacgcggaggccgccctggatggtggatccgaggcggtccatggcctgccccgtgccgcggatccacttccccgccgtgtagatcgcccgccccagggtccccatgcctcgtcctccccgcttgctccctccgctgtccggacctcgccgccggccgccgcccgccgccgaggtgagaggtaactgtgtgagagagagagagagggagaggaggtcaaacagcttttggcccaggttttttatgggcctggatccggcccgatcatcacagaggcctcgcggcctattgagatttgggcccaggtttttatgggcccagcctgttgcgcgaattctagagtgatcacggccgtccaaaattcgattgaatttttttctttatgtttcaaacgattaaacagtactccatccgtcctaaaatataagtatttttagcatagtatcaagtcaaatatttgtaactttgactattaatagcaaaagaataaaaaggatcaatcatgtaaaattgatgttactaaatttatcattaatgtaactctttttatttaaaacatattacttttatagatattattggtcaaaatagcatctcatagactatgtcaaagtctaaaaatacttatattttaggacggaaggattagtaataggctcccttgttgggaacttcggatacgggcttaaaatttgaagtgaaatattggcttacccacatgattggctaagagttccaaatcgctcaaacttaacgtgactgattatgttgcagtcatctacggactgcagggaactggagtcttggatcctgcttgctttgcatcaacaaaaacaaaaatctaaagcttttacaacgtgcacgcattctgcagctgccgtctgccgatcatccgcaccaggactacagagagtgtgcaaccgaacaaaaataattgaccctgtttggatggtgttacatcggatggatgtttgtacaaagtattaaacgtaagctattgacaaaacttattctatcctagttaattcgcgagacaaatttattgatccaaattaattcatgattagcctatgtgatgttacaataaatatgtgttaattatgaattaattaggcttaaaaaattgtcgcgcgaattaacactcatttatataattagttttattaagtagtgtatgtttcatactacatcagtcccaaaatacttgtcgctttgatttttttcttgcaacctttgaccattcgtcttatttaaaaattagtgtaaatataaaaacgaataagtcacacttaaagtatttttataataaagcaagttacaaacaaaataaacaataactctataatttttgaataagacgaatgatcaaaagttatgtaaaaaacacaaaacgacaagtatttttggacggaggtagtatctaaacatcctatgtgacctaggagtatgtgactgggacggacaacagtgtacaacctttcgttgaacaacagagacgtacacgtacgcaatgttgcacgggtcacagatataaaatgcacacgctacaacgcagcggatgtactcattgcgttggtgcactgcacgcatgcagcgagagatgcccgccgacgctgacatgacgcgccgccgccgctcgccgtcgctaccgtgcgcggtgcgcgtgcaggcggccggcttcgcgctcgggcaccgccgggacggcagcgtccggcgcctcgtcttctccctcttggacatccacgtcagggccaagcgccgcgccggcgtccgctccgtcgacgtcaccatcgacgcctcacgcggcctctgggcgcgcgtcttctccccgccgccgacgaagggagaggcggcgcaggcgctcccggtcgtcgtcttcttccacggcggcggcttcgtgctcttctccgccgcctcctgctactacgacaggctctgccgccgcatctgccgcgagctccgcgccgtggtggtgtccgtcaactaccgcctcgccggccccgcgcgccgcttccccgccgcctacgacgacggcctcgccgcgctccgctacctcgacgccaacggcctcgcggaggccgccggcgtcgccgccgtcgacctctccagctgcttcctcgccggcgacagcgcagggggcaacatggtgcaccacgtggcccagcgctgggcggcggcgtccgccgcctcaccgtcgtcgtcgacgacgctccggctcgccggcgccgtgctgatccagccattcttcggcggcgaggagcggacggaggaggagctggagctcgacaaggcggcgctcacgctgtcgctagcgaggacggactactactggcgggagttcctgccggagggcgccacacgggaccacccggcggcgcacgtgtgcggcggcggcgagcacgacgtcgaggtggcggaggcgttcccggcggcgatggtggcgatcggagggttcgacctgctcaaggggtggcaggcgaggtacgtggaggcgctgcgcgggaaggggaaggcggtgcgggtggtggagtacccgggcgccatccatggcttctgcttgttcccggagctcgccgactccggcgagttcgtggaggagatgaagctgttcgtccaggagcatagaaccaagcgtgtgcagtagatggcttgttggcccaacgctgtaattgatccagtgattatgatgattccagcagaatttacgagattatttttcgattacacgacaggctcatatgtatgcacatgtactcccccgtcccaaaaaaaaaacaatctaattagagatgggatattacctagtccagcgtatctaaacaaacatatgtccggatacgctggactaggtaatgtcccaccttcataggttgggttttttttttaacgggaggagtatatgacaacacacataacaacacaatcatacgccaccaatactgtgagaggcactacacgagaaataaattttattattcattcctaaggaatactcgatgggatgagaaataaataacaaccttgaagatgagtaaatatcatagagcaagttttatgtcatttaagagatatgcgagaaatgaagacatcacatgggagacaaaaatccatctgcggttatttgctgccttttgttatcataatggttgccacctgctattcgttgcctttcgtcgatatacgattatattactatagtgaagtgtgtgtcgatgggttatacctcaatcacatgattcgttcatatacaaattgtttggaggacgtaggaattgattgttaggaggatacaaacaaatctgtaaatggagcaaggggaaagggatttttatataggtagacccttgatgacgagtaatagcattatttctgttgaccggagctggtgttgccatcgtatatcaatctatcacaagtacaaagtagagaataacctaatctagtgtaccagcgtatcaatgtaaagctcgagtatggttagtcgttggttagctatttttggcttcctcgagaatccattcggcgagattggaggttgctctatattttttttattaggcttgtccttcacttctgggatcttgtacttatatttttaggtgtttcctttttaagtagaactaagaagataaacatagatacgatcgtcggttttgagggctctgtatttattttatgtgactcatttcttatctatttaggacttccgctatatgcacgagagttgtttccgtacaaatggtatatgatggtcttgcaaagctaaatacatgtgtatagggtactacatatttagagcactcacggtctaaatttaaagtacttttggttttggcatatatatttatctattcattttatttaaaaattatgtaaatatgcgaatataataaatcatacttaaaacaacttcaataaacaatacaagtcataacaaaataaataattttgtaactttttttttaaaaaaatatcaaacatacattcaatgtcactggcgtcctagagtctcaaaggtcactctaatctcaaatattcttttcagcataaaatatatagtaaactgagaccgaacaggatgtatctttttacaatgaatacgaatgtgaataaaaaaatctatccagattcatgaaatcattatgtatctcatctaatttcaggttgctatattttgagatctcctctacgtcttcgtctcaatctccttgcaagcgactactaccagaatggaaagactctacgtagtccaggacactgcgtgtgatacacttcttgtctatcaggtgggtaactgggcacgcatggcagatagttgctgcctaggactcgccaagaacgtgccacacaggagttcagagaaattcatctggagaaaatggcaaaacggtaaaaacaaaaacgaatacgaaactcacaactcacaaggaaaaagtctagggcctgttttgggggagcttgttccagctgcagtttttcctaaaaactgattctgctagaagttgcctcaaacagtccacaacttctgagaatctgtagttacaaattctgaaaaatgaactaaaaaatcagaagctggagaagctgggtttcagagcttttctagattatcaaaaactagctaccaaacagctgcttcttataatttaaagatcccaaacaggccctaggagtagtatctctctcatgattcattacttgatacatacagaaatcatacaaccccactagctagtttatttaagtctattgcatactactctgtcgaaaaaaaatcctacctacgaacctaaagcatgtatccatgtttataggtaggattgattatttttttttttgacggaggggtatgtatctgtaaatatttaaaattttctcctaaattatgcagaagccagcatgatagcgtcgaattctgcgtgtgattcgatcaattggacacttaaaaaaagaacaaatataattaagccatacggttggagctatgctcctggacgaactgcttcatctcctccacgagcttgccggagtcggcgagctccgggaacgcgtggaagccatggatggcgtccgggtactccaccacccgcaccgccttccccttctcgcgcagcgccgccacgtacctcgcctgccatcccttgagcaggtcgaacccgccgatcaccaccatcgccggcgggaacgcctccgccagctcgacgcgctcgccgccgcacacgcgcgccgccgcgtggtcccgggtggcgccctccggcaggaactcccgccagaagtagtccgtcctcgccagcgacagcgagaggctcgccttgtcgagccccacctcctcctccgtccgctcctcgccgccgaagaagggcgatatcagcacggcgccggcgagccggagcgacgacgacggcgaggtggtggacgccgcccagcgctgggccacgtggtgcacgatgttcccgcccgcgctgtcgccggcgaggaagcagcgggagaggtcgacggcggcgccgagctcggcggcggcctccgcgaggccgttggcgtcgaggtagcggagcgcggcgaggccgtcgtcgtaggcggcggggaagcggtgctcgggggcgaggcggtagttcacggacaccaccacggctccgaccccgcgggagatgcggcggcagagcgcgtcgtaggggcgcgacgccgcggagaagagcacgaagccgccgccgtggaagtagacgacgaccgggagcttcaccgccgccgtgttcgtgggcgggcagaacacgcgcgcccagaggccgcgggaggcgtcgatggtgacgtcgacggagcggacgccggccgcgtcgggacgggggctggccgcggcgtggaggtcgccgaggtagaagaggaggcgccgcacgctgccgtcggaccggtgcgcggccgagagcgcagcaagctgcacgcgcaccgtccacggaagcggcggcggcgacgacgacgaccggcggctgcggtcaacgccggccatctcttgctgcaccaagtgtggaggagagttttttttttctttttgagtgaattgcaggagtgatgtggtgctttgatcttcgatgtgaccaatgcgacaaatctgtcgcgccattaattaatgtttaaggacaagttgttcgcaagttgcacacggcacagtggctgtggagttatattttatttcaatttgtttgtttagttttactactagtataaattattgtttgataaagctcaaactgtaataagagtgccaaagtactgaaagagaagtgcagatgactcaagagttgcaaatttctgccatatgtaaaagcttctgttctttattgtgtagatatattttgacccttgaatatttgaacattggtaatggtaatatgatgtaatcctagttggccaaaatcatgtccaattagctcaaattctctgtccatatcccgcaaattctcaaatttccttcgtctcttcggttgcttcccgttcatcttctccatcatcgtcgtcatcgcatccacagtcgctgtccatagccttcctcttcgtcttctccacgaccggcgtgtgcacagccgcaggtgcaagggttgtcgccgttgtcgtcgatctcgcactcgacgtagccatgggcagcgagctccgccttgacccactcctgctgctccttccagtactcgttcaggtgccgtatatatggcctccgcaccgtcggcgtccaagctgcaggagcgcctcctcctccgcctcgctcgccgccagatcttcgctctgtaacacggtcgcggggcggacatcgtgacaggatgtgcggtcgatctgctcctgcagcatcctccacttcctcagcttcttcattatcttcttcatcccttcggcttgcgacgaccaactccagttcatcgccggcagaatctggatttgttgggatttttctgatggattcatggatcgctacgggaccacgccataaatgggccagaatgcccgtgttctactcggcctcgggctcctagtttcctttgtgaattctccgccgcgcccatgtgtgccggcccaggctcccaccaaatacttctctgtgacttgtgaggaggaaaaagtacaccggagatacctactcttgtcgccgatttacaaaatcatcccttaaccaaaaaaccaaatacaatgtatcctccaacttttaaaaccagtgcaaacaaaatccttcgatggtattgtccccagtttcagctaacaaggcaccaatgtggctccttcgactagatcttcatctcacatggcgcttatgtgacggtttcatcaagaaacaaattataaaataataaaaatgggtgggccaattgatcagatccccttattccttttctctcttcttcctctcttttcttgcgtcagacaggaaggaaggacatgaggacgatggcgaggtatgcaccttgcccttccccatttctctcccaagcttctccactcctccgcggatgaccccgcccatctcctctgcgccatccagctcctattcaccgccggtgccctcctccatggtatggtcaccgtggttgcctcctctcccacctcacctcgccagcctccttcgctcccgacgcttccctctacccagcgccgccatgtcgctcgtcgtcggccgtcggacctcctcctctccgcaccggacagccagcccacccaaatgacgacaagaaaaacgagaaagggtagaaagggagagaagaggataagagagagggtaatgccgtggtcaccttgatatgtggggttcacgtgggttccatggtgactcagtcgtcatgtcggacaaaaccaggatcaatgttgtctaaggacctggaatgatctagttttgtaagttgagggatcttatacatctggtttttttagttgagtgacgattttgtaattcggtgacaagatgagggacctcggacgtactttttccgtacgaggacaccttgtctccatatggcccatcaaaagcccatcaccgtcgttctcttccttcttcccaccaacgcatcctccctattcttccccaacgttcaagttcaaagttcaaacaagcagccatggctaccaagaaacctccaatcatgctgtttaactattaaaactggtagacagcaggctagtattaatcacacataatcatattaaaaaatataatgcagaaattatcagtgatcgaggttccagccgtctaatttcccgaacagattttcttctcttcagtttcgtcctcataacaatcatcgtctccttcttgttcttcttcttcttcttcctcctcatggtcggcagcataggcgcagccgcaggtgcaggggttgtcgtcgtcgtcgatctcgcactagacgtagccatgggcggcgagctcggccttgacccactcctgctgctccttgtggtaccggtccatctcccgcttggccaccgcgtcgtcggcgtccacccgccgcagcctctccttgagcgcgtcgctgatctgcaggcggccgatgtccacgtcgtagcgcggcggccgggctggctccggcgaccacgacaggatgaggtcgatctgctcctgtggcatcctccacttcctcagcttcttctcctccttcttctcttcgccgacgttgttgacctcgtcgacggccatctccgtcgtcgcggcggtggttcgatcgatgctggattaatcttggattgcttggggattttttttttctgccataaataggggcagaaaggtctccatgttcttcttggtttcctttgcgaattcggatggaataagttcacttcatgaccctcaaaagtgatcgaaatctaatccatgacctcaaattacaaaaccggatatcttgacccccaaactcttaatacccgtgcaattttactcccagtgcggttttggagagcggtttcgctgacgtggcgcctacgtggcagcattgactcggtcttctttccacgtggtgttgacgtggcgctgaggtggcattagaaataaaaaaaatatgcgtgggacccatctgtcattcacacacaaaataaaagtggggcccactgacatgtgggccccacatgtcatcctctctctcactacccttcttcttcctcctctctccgttgtttctctctctccgttgacataagccgccggcaggagggggctcgagtgccggtggtggtgggtgggtgatggagtggtggtggcggtgggcggtggacggtgtacctccggcgacgggcgcaggagcagctccttctaccgcactgggcctcgggcgactgggcgacggtaggcggtggacggtggggagcacgggcggcgggagctaaagaggcggcggcggcggcggacctcgggtgtgtaggcgacggtgggcgatagacggtggggagcacaggcggcgggagctaaagaggcggcggcagcggtgggctggatcgtccggctgctgcccgccccctctatctcctcctcctcgtagtcgtcgccgtcgacctccccgaccatgcagagtaccagatcgagaccagccgtccgccgcccctcgtacgcccgccgccgccgccgccgctctcgtctccgaccttgtcggctgcggccatagccaccacccacgggacgcgtcgccgccactccgggtcagcacgcggcagcgctgtcgtgagcgcgagtgcgggaggaggcaccggcggcggcggtggcggcgacaacacgagctcggcggctccgcctctcccctctcccttccggcccttacacaccgccgcctcctctcatgtcacccatcacatccgtttcctccctcacctgctctcctctcctctcctctctccacttggcgaggccgccgccaccgcttcagcttcctccgccgctgccgccgctctggcgcccgcccgctgccgctccagcctcccatgctccccgcggccggccgaaggagagaggagaaaaagaaagaaagagagaagggaggaagaagaaagggagatagaggatcccacgcatatttttatttctaatgccacctaagcgccacatcaacgccacgtggaaaagaagaccgagtcaatactgccacgtaggcgccacgtcagcgaaaccgccctccaaaaccgcccagggagtcaaattgcaccggttttaagagtttaggggtcgagatatccggttttgtggtttagggtcatggattagatttcgatcacttttgagggtcatgaagtgaacttattccaattcggattcggcctctcgagcaaatgctattatgtgggccttgtgttgatatgggccggtatctcggcccattaagagcctgtaataaaagtacgaaatgttcttcaaaatgtactgctgtacttttgaatttagtttctctatatactcgtgtaagtcgatcgctctcgttttaatactgatttaattctcgtcccgtttcccctttttttttgcgacaaaaaaaagtctgaaatgtgccgatgtgcttgtgctccacgtgaacagaaccgtgtagtttattttatccttaagagtgtcacttttaaatgtgacaattaactctttgacattggacccacatatcatggaggggaggggccaccgcgcaccgctctcccccttgttgccgcgccgccaccggcctcctcctctccagccaaatcaaaaagagggaggtgaggggagagagtggggcagccgccgcccctggcctcctcccctccaaccagatttgggaaggaagggggagtggggcgctgccaccgacgctccatatgctgccttgctgccaccaacctcccctccttgactccaccagactgtcacccgcgaaagtcgccgccgccggatccaccacacgcttgactcgccgtcaccagatctgccacccgcttgattcgttgccgctggatccgtcggtgaagacggaggaggggggtgtgcaccagtgaggaaggaggaggggtgcacgccggtgggcatctgcagggaaggagaaggagaggggtagggaaggagtgcgtaccgatagggatggagagggagtaaagagttaggtgcggtggagagagctgatcttttaatatggcagtcctcttcaaccgccagtggaaatcgctaaagtgagccgccagcaaaaagatacactttcgttggccagcgaagatccatttttgctggcggtctatagccccattgtcgctggtagttttcacgtatggccgccggagaaaataataaggtgacgccataaaagatcgattttgtagtagcatacgctcctaaagtgttcgactttggcacacgtgaaaaaaatcattaaacatttgttttatacaaaacgccctctacttaattagaaaatatcattaaacaaaagagtgtgtttcattttggaccgtgtaatagacgactaaagttggaaatagaagttgtttaaacttacgaaataattgtatgataacacaatgattatattttctggcccaataagggtgcgattgtttcggctggggcggtggacggtttagtcgcacgcaaaacgagaaatgcgattagtatatgattaattaattattaatatataacttttttatgaataaatttgttggatttttttaacaacttctttatagaaagttttcgcacgaaatataccatttggcagtttgaaaagcgtgctaacagaaaacgaggagaatctaatcctataggctcaaaacgagagcctgtaagaaaaggatagaaccctacacgaaaagtgttcttcaaaatagcttttgaatttgattttttctatcgacgtgtaatgcgtcgcgtacgtctcaaaagtcagactgattttacttgtcgcaaaaagtaattcttatcatgtttcaaggctgtgtgtttagatctaaagtgaatccaaacttcagtccttttccatcacatcaatctgtcatacacacataactttttagtcacatcatctttaatttcaaccaaaatctaaactttgcaccgaaaacacagccttcctctctctctctctctttttctcttgtcgcgtcaaaaagaagtcagaaatgtgcagctgtgctcgtgctccgcgtgaacagaatcgtatggtaggttaatgtctccgtcagcatcatgggatccatgcgatgaaatcggaataaaaaatacgctgctagtaaaatcggttttattttattaggtatgtttaattcatttaaactacgttcagtgtttgggtgttacttttataataattggctgtagctctgatgagcaaaagccgagatgttttatttcattatctaaaaaaagtaaaatctgtttatttcacagagcaattcatcatcgcaaaacttgatcaaatttcagcaaaatatatatgaaatagcagtccaggttaacattttgaaatgccaaaggtaaataaaacgcttctaattaagcattcgatttgggcggcgcgttgcgctccatgaacgccttcatctccttgacgagctcgccggagtcggcgagctccgggaagacgtagaaggagtggatcgccgccgggtactccaccacctgcaccgccttcccattccgccgcagcatcccggcgtaccgccgctgccagtcctgcagcgtgtcgtaccctccgaccaccaccatcgccggcgggaactcctccgccagctcggcgttctcgccggtgacgtgcgccgccgggtggtcgcggtcggcgccctccggcaggaacgccctccagcaccagtccgcgcgcgccatgctcaccaccggccccacgccgtccagcctcagctccgcctccgtccgctcctcgccgccgaagaacggctgcagcaggacgacgccggcgaggcggacgcggcggctcgaggaggtggtggcggcggcccatcggtgcgcgacgtggtgggcgatgttgccgccggcgctgtcgccgacgaggaagcagcgggtgaggtcgacggggacggccgctactacgtcggcggggaggccgacggtggcgaggtggcggagcacgtccacgccgtcgtcgtaggcggcggggtagcggtgctcgggggcgaggcggtagttgacggagacgacgacggcgcggagctcgcggcagagccggcggcacaaggcgtcgtactggctggaggcggcggtgaggagcgcgaagccgccgccgtggaagtagacgacgacggggagcggcggggattccacggcgctgctgctcgcgggggagaacacgcgcgcccacagcccgcgggacgcgtcgacggtgacatcgccggagcggacgccgtgggcgtccgggcgcgccgcggcggcgctctggcggtctgcgagggagaagaggaagcggttgacggtgccgtcgccgcgctgcacgatgtcgacggcggtgacgagggcgaagagctggagccgcaccgtccacggcaacgccggcggctcgggccgccggagctcgtcgccggccgtttcttgctccttctcgtgccccatttcgccggtttctgtgcgagtcatttcagtgtccagaggacactatatataggtgaaccgattaattttttttggaaataaagggggtgtttagtaaagtttcggcgtgtctcatcaggtattatatacggtgtgccataaatgttcggcactaataaaaatactaattacagaatccgccggtaaaccatgagatgaatttattaagcctatttaatctgttattagtaaatatttactgtagcacaacattgtcaaatcatggaacaattaggcttaaaagattcatctcacaaattagtcacaatctatacaattagttattttttagtctatatctaatacctcatgtaggtgtttaaacgttcggtgggatttggggtgggatccacacaggaccaaaattatcccttgatttttacgtgaatattccaatttgatagtagaaatttgaaataccgtgtaactactcgtactacctagaatttaagtccccagcgccgaatttagcctaaattggcattcatgagtcatgaccatatcgtcgaaccaatgaactctagctgcgttcaaatttgacaaattggcacttgatacctctcataatctcatgtacaggtattttaatgcaattccatacgaccatatatagctccgttgcttctgtttgttttgagtataattagtacgtcttcaatttaagttttatagttgaacacattggtactacgtacgtacaacccaatagcttcaatgcgatatgattttgatccaatctcattattgtgtactgctcaactgatgagcacatagccacacgtttgtagcgatttttctttgtttgattgaaggatataattaattaatccagtagccttttgcaatgatgtgtatctgattatctgatacgtacatttgtggttgtggttaacgtctcaagtctctcgcaacgaccatgcttacgttgatggcgatgcatggctgcctattggggactcttgaggaatatcttcttattgttattgtatatatactcacatagttataaaaaagtttaaaaggatgtattaacatgtaatatatcactttataaatatataatttaaaatttaacttgtacatctcgcaactaaaaacaaactaacaaactatagttggatctttttttgctgagatgagctaaagcatcattttttttccttcacttttttcttcataaaaaacaaactaaagatgttactccgataatttccaacgagacatagtccccattggttggcaagagcttagcggcaaaaataattaatgaaatttttttatatatccattacttatcgacttaaaagctaaataaaaaaaaactacattgagaaaactttgaaattaaatttaaaattttatagcgataggtcaaatgatgaggccctcgtcactaagcagtgggctgcttggacgtgatgcattcttccacgaacgccctgatttcaccaacgagcttccggtgatcgtcggcgaggaactccgggaagaagtagaaggagtggatggcctccgggaactccaccacccgcgccgccttccccttccgccgcagcatggcggcgtaccgccggtcccagtcctgcagcgggtcgagccccccgacgaccaccatcgccggcgggaacgcctcgtgcagttcggcgtcgtcgtcgtcgtctccggtgacgacgtgcgccgccgggtggttccggtcggccccctccggcaggaacgccttccacgacaggtccgaccgccgcgtgttcagcaccggcgccacgccgtcgagcgcgcgctcggattccgtccgctcctcgccgctgaagcacggctgtatgagtatcacgccggcgaggtggacgacggggttatcggtcgtcgtcgtcgtcgtcgtcgccgtggccgtccatcgctgggccacgtggtgcgcgatgttgccgccggcgctgtctccgacgacgaagcaggtggagacgtcgaccgggccgacgtggtcggggaggccggtggcgccgaggtagcggaggacggcctccccgtcgtcgtacgcggcgggagcccggtgctcgggggcgaggcggtagtcgacggacacgacgacggcgcagagcgtgcggcagagcgcgtcgtaggcgcgggaggccgcggagaacagcgtgaagccgccgccgtggaagtagacgacgacggggcgcggcgacggcgacggcgagtagaaaacgcgcgcccagaggccgcgcgaagcgtcgacggtgatgtccgtcgagctgacgccggcggcgtccggccgcgggtcggccggcgcccggcggtcgaacagggagaagaggaaacggttgacgctgccgtctcggcgctgcgtcgcgtcaatggcggcctcgaaaacgcagagcctgagcctcaccggccacggcagtgccacccggcggcgccgcccgtgcgcgcccgccatttcttggctactccgacggttctaccttttcgtttgggagactgataaaaaaatgcaggttcagaaacaaaattcagagaagttcaggaattttatctttcagtgtgcagccacaaaattcagaggttcagaaagtgttgtttcagtgttcaagcagccacaaaattcagtggttcaggaagcgtgtctttcagtgagtgttcaggcaggcacaaaattcagagaagtttaggaattccttggtctgaaaacaactttcaaagtgatatgaaattgatattacgattgaggcctggatagaggtgacatggagttatggagatcgccaattctccgtacttgaagataacgcagacgctatctttgcggtctcacgccgtaggattgttgtgagaagggtgcaagcaacacatacgacatgtgactatatgaggtcgcaatttgtttgtacgcttatcagttatcacatctctcttccttttcgcaaggcaaattcaggtgattcttgacttaagtattgaaaacttaatcttttttgctgattcagtaagttcagtgcgtactatagcttagtttactgaacatttagaagcgtctgacatgggattttgaagtttaacaggagcaatatcctgaaaaatcccagatagtattaggctgattttgaattacactaggcctacactgtttgatgaaaaacagagtgtgagtaaggatgggtaagaacaaggattttctacgcctaaatgccatagcacccatcatttacatacgacttaaatacttatagaaaaaatttagtaacattaattacgatgatataaatctatacagaaacatgcaagattatatttgatctacaactagataaaccaaaataataatcgatatcgtacaacgcagataaaatttattatttttgtttttcatgtgtatatcgaatttagacttacatgtttgtagtatcttatattatcgtagtccatcttatcaaattttatgaaatttttatataactatttaaactacatgcatacacctgagtgtagaaaatacattcccgaatgcgtaactattggaggtatgtactcttacgagtcgtcgactcatacataatttctataccaaatgccttttttttattttttatttttgccaaacacggtacaaacatactaatttgtcaaaaaaaaaacaaactctaaaaatgaacctggacacacatatatccagattaatagttaggattggtttatttggacggagggggtaaacacttacatacgtacccacacttactccttactatctccaaggactgcaccggtgtaaacccactctctatccgtatgaacatctccaaagactgatccaacatctttcagtataaagcgggtatgacacctaccattaaaaaaagggtaaaaatagttagctgcaaatacgaacaccctagtaagtctatgacatgttggggtgagcatgttttcaacacatgaaacttagccaagtgatcttacactcgcttcgtatgaaatgccaaaatttcatcgcggtggcaatgcatgatcatacaactttcatcttaattcatacaactttcacatgacacttagctgtgacctcaatttttcatttttgaattaaaaaccgttcaaattcaaatttaaaactttcatatgaaaacttaaaaccttcatactcaaattatacagttttcaacataaaatcatacgaaacttttaactgcggccttaaactttcaccttgaatcacagaaatcccaattcaaaatctcaagtatatgaagtgtacgacgcgtgtacggtacgaagcagatcaaactctcgaatctcaattcaggcggtggcgcgcgccgccctgttgctctggacgaacaccttgatgtcctgcaagaccttgccggcgtcggcgagctccgggaagccgtagaagccatggaaggcgtcggggaactccgccacctccaccgccttccccttccgccgcagcacgtcgacgtaccgccgctgccagtcctgcagcgggtcgaaccctccgatcaccaccatcgccggcgggaacgcctccgccagctcggcgttctcgtcggtgacgtgcgccgccgggtggtcgcggtcggcgcccaccggcaggaacgccttccacgagaagtccgaccgccggaggttcaccaccggcgccacgccgtcgagcgccagctcggagggcgtcctctcctcgccgccgaagtacggctgcacggggatcatcccagcgaggcggaggttcttggccgtgggctgccacgtggccgcccagcggttggccacttggtgcacgatgttgccgccggcgctctccccggcgaggaagcagctggcgaggtcgacggggacgacgtcgccgtcgaggcccgggatgccgttcccgtcgaggaagcggagcgcgtccacgccgtcgtcgtaggcggcggggtagcggtgctcgggcgcgaggcggtagttgacggagacgacgacgacgccaacgtcgccgcacagcctgcggcacacgccgtcgaacggcgccaccgccggcgagaacagcgcgaacccgccgccgtggtagtacaccatcaccggcatcggcgccgccgcctgcgccgccgccgcgggcgcgaacacgcgcgcccagaggccgcgcgcggcgtcgatggtgaagtcgaaggagcggacggcgccggtggcggcgtccggggacgggtcggcgcggacgctcatcaggtgttcgacgaggacggagtagagcgcgcggttgaccgtcccgtcgcgccgctccaccgcgtcgatcgccgccgagagcccgatcagctggagcctcaggcccagcggcataggcggcggcggcggcgggcggcggttgctctcgccgccggcggccacgtccttgcccatcttccctcccattcgcgagcttgacgaacactctcgttttcttctctcgctttttcggtgtggatttgtgagtcgtgatcacgcaacgctgtttccgaaatgggcacgttatcgccgtcccgtaaatgaggagtacagtgattgtactaacgtgtcgctgtcggcgatgggacacgttccaaaaaaaaaatatttttccatccatttcacatgtatcaatacaaaaccaaaaccaaaagaaaatttaaaataatcatcgcttcatcaaatcctaatacagttatttatctactcctaatacatttattctttacttcctccgtcccattttcagtgtagccatgattttttacgtccaactttgatcgtccgtattatttaaattttcttaaaaaaaattgaaaacataagtcacgagtaaagtgctattcatattttatcatcttataactacaaaaatattaattataaaaatttttcaaataaaacggacgatcaaagttaagcgcgaaaacttatggttgcacttaaaatgggacagagggagtatttttcacaaatttcggtgtgctaacggtaaacgggaaagttgaagtttggaattgagaaaaaagaactgaggccttattttgggataaatgggagagaaaaaaaatttgtcctcaaacagtggaagtactagtaagaaattgctttagtagaaaattgaactcggaattgttagaggacagtggctgtttaggtgctgaacctgtccagtcagtcgtggctgcgcctgcgccgcaagttcatcagtcaattgcggcatctggaaatccatggcaagaacagagctaacactgccaaaagcccaaaacacaactagagcataaaacggtggggttcggaggatgaaactccgactcccctttgatctctctctttcagcttattttctgcagttttcttttgttcgtcgttcaggtgcccagacgcaaaattcataccgtttaaattaaagccgtctgatacggatgaaatgatctgttataagaaagaggaaatgcaattttcagtgttattccaagatgagagtagatcactgaacagaagagcagaggaatgaactcaaatatggattctgatttcagaaaccatgagatggctaaaaggattgtgggatgaggtcatatgagtccgtagagggtttaactgaagatctctgaatattaacaggtgagcaggtgactgacaagatgacgccgccggctgttcttttgcgctgtcggtggcgagcaatcattttgtgcattagtttaaagcttgcatgtgaatcattttcatctaatataatacttctccattattcttgggataagataatccactaataaattggtcgttgaggatcgtgcctgcgccgcaagttcatcagtcaattgcccgatcaactgagaaccgcatgatcactttcaaatagcaactttccttacggcaatttaatttgggtgcatctttttttcttactggaggagtcaaaacaaactgaatcaaagttcagtgcaaactttgctgaaaattgaacccaagttcagtgtataatacagagtagcatgatttactgagcatttagaagcatataacattttttttgtgaagtttaacaggagcattcatccagattccagcctgattcattatattgagagtgctcctattgattcattgcgaagagaattaacatttcccaagcagtggcactaggcagttatgaaaccatcaaacatcgtctgccatttacacttttggtcttgccatgatttgaaattttaattctttgaacactacagaccaacaaacgagaggatatcagctgctgctatgaatcaacgcttctctaaactgcttagcacttggtacccctgcaaaggagacgcagtatgcgataggagtggggtccggagtttaaactccgaacctctttggtctccttttttttttcctcaaggtaattttctacaattttttttcatcgttcatgtgatcagacgcaaattgaacctgttaaaattcgtctgatacgggtgaaatgatctaataaaagaatttaataaattgcaatttgcagttatttcaacaaacggaaggaaaaaaatatttgatgattccttttcaaatggatttcgctgctttgcacttggacaacacctccaatctgaacttctctgcaggatgattaaggtctaaggagtaaggaacaacgaaagggtggaaacgagccggctcggctcgcagtggctcgcaacaaacaaggcttggcttggctcgactcagttagggaaacaagtaaaacttgagcacggctcggctcggctcgtttcctggctagcattcatgttgaaacacctcttcatatatattttataattattaaaaaaaagcaagaacaatcatcaacatgtaaaatttaaataagtttcaattcttcaaaatcttaatggtaaatttcaagttgacaaataatatctccataaaaaaaataaaataatcgatataaacacatgatggtctaggctcgcgagccaaaagaagttgctcgcaagccagctcgggctcggctcatttcagcaatgagatgaaaagaaggcttggcttggctcgttttgcttacgagccgagctaagccaaccaaggttgagccaagcccgagctgagctcatgagcctaagctttttttttttccaccactagctaggagtggagcgaccggagcgagcgaggagacggagtttgtgatgggaaaggggttggagtttcaaactccgacagaccgacatcctttggtctccttcttttcagttaacgttctgaattttttttcttcgttcattattttgatcagacgcaaattaaacctgttcaaagccgtacgatctgttaaaacagaaaacctattttgcggtcattccagtcttccagatgaggctaagcaacgaactgccgaactgctaggagttcttattcggaaaaaaaaaaacgaactgcgaggagtgaggaatacaggaatgaactcaaatatcgattctgatttcaggaaccatgagaggactaaagcctaaaggtagggggaagagttcgcatgaatcagtagaggttttaactgaaaatctcagaacataatggccaaatatttaaagtgaaatgctgataagtaccaaaaactacaagtttcagaattttaatttcattgtcaatttgtaattggtagttggaattgaacctgcctcacaggagaagggaatactatgcacaatgatgctatacttttgtaatctttgtacttcattttagatagcgtagcacctaaaaaaatcctccttaatatttatgtgatttttttaaacttttaattcagctagccatcttttttagaggagttggggacctgtcccatcacacgataatttttgttttctcagatggctgagatgtaaataatttccattattaaaagaaattgaaccatccccaataactgaacagtactagacagttctgaaaccatcaaacactatctgtaatttacacttgtcttgtcatcatgccatggtttgaaattttgattccttaaatcctacagaccgacaagcgagagaaaatcatctgctgctacgaaacatgaatcaacacttcgctcttccagtttgatgattctttttcagatggattttcgcagctttgcacttggagtgggggtcggaggactccgatcccctttgatctctttttttttcaggccatgttctgcattttgttcgtcgttcatgtgagcagacgcaaatttatacctgttgaaagccgtctgatacgagcgaaatgatctgctaaagaaaacaatttgctgcatgaactgaagagcagaggaatgaactcaaatatggattttgatttcagaaaccatgagtgggctaaagtgtagggtggtgaggtcaaataaaccattagtgggttggactgaacatagtgaccaaatattatcggttgaaataccgattaatatcggaaattagaaatttcagggtcaatattactgttaatagtaattggtactgttgaacttattagcgtgctccccaataaaatccattagacccctccccctgatgaagcaaatcagattgattggtccacaacaaggaagaaattaaggcctgatttcactaatgatttcgactgcatggacttttgtggaagcacgtgtgtggcggcgttttgcagaaattaaccaatcaagcacttggctagcataattcctttgttgttttcttcctttaggtgatccatcttctttgtaacatttcttatctttcatgtaattcaccaactcttcttataatatatatattttggtaaccctccattgaagctagccttttgcagcctctatgttcatgaatgtacgtacagtaattaacctgtatgagcatcagcatcagatcatcattggaatcaaagcaatattcaagcaacaaaccccaagaaaagcgaagggaatgacaatattatagttgtgcctcagcccctctaagtctaaggtttgcctctcagccaccctaaaatttaaatattaaaatttaattttgaagttgattttagagtttgtcgtagtagtttatttttgacaccggctttcaaattgttaaacatgcatatataaaaaatgtattcacaaactatttttttctttaataaatagttgtaggtgaaatgatggtagtctcactatccctcttgatccaaacaactccagcttgcaaagacattttgccagataattggcatgcatgcagcctaccattttcaatattttaaatagcgggctaagatatttagcggttagcttctaaaactgctatagcgggctaaatggagctataccggctaaattgtacatgaaagcaaatagctagaaccctctcaaacagctatagctgaagaccctgaccatttctcatctctataaatagaagtgcaaatctcgagctcctaatcacaggcagctgcagctagctagctaagcttggataacagtgcaagggcgccggacggctacttggtccatggcgtctctgacgatcgtcgtcgccaccatcttcctgctcagcctcacctcggcgagcgtcgccgtccatggccggagcagcaggaggaggttcgtcaggagctacgacgagccgtgcatggagatgaggctgtacctccacgacatcctctacgactacagcaacagcacctccaactccacggcggcggcggccaccaagccgacggcgctggccaacgccgtgccgtcgaccggcggcaccttcttcggcgaggtggtggtgttcaacgacccggtgacggaggggagggcgctgccgccgtcgctggaggagacggcggtgagggcgcaggggctctacctctacaacagcaaggaggcgttcaacgcgtggctcgccttctccatcgtgttcaactccacggggcgccgcggcacgctcaacctcatgggcgccgacatcatcgccgagaagacgagggacatctccgtcgtgggcggcaccggcgacttcttcatgtcgcgcggcgtcgccaccctccgcaccgacgctttcgagggcttcacctacttcaggctgcagatggacatcaagctctacgagtgctacgtatgatgcatccatccatggtcgtataatatatactccatccgttctaaaatataagtatttttagctatgaacgcttatattttaagacggagggagtaccaaacactattcattattgtcgatgcaaatttcagtgaagatgtgacatctttggtcagggagacaaatgatcagccaattgacaaggtgatctgatgctcctagcttcgtctacctatagatttatttgttgctgctcccatcatcagatcagaccaccagctgtatgagtatatacacagtttgtatgctaaattctttctaaataaacatccttatgcaaatgtgttgataatgaatctatctattatatactaaaagtccattaaactccctataaacactctaaagccaccacgtgagactcctacaaacgctcctagattgccacgtgccgctttaataaatcttacaaattctaagaaaaaagcaaaacatctagccatcaattttcatttaatttggtggatccaccaccaactgcagccgccgccccaccaccttcaatccctgccaccaccaccaccaactgccggctgccgccgccacctcacgccgaccctccgccggtggcctccccaccagatccggccgcggcggcccggatctgggcggtcttcactgtctactgcgcggccctccaccgccgacgggagagggagacgaagatgacgaagccccgccgccgccgtccttgcggccgcgcggctttgccgatggccgcttgggcagcggcgatgcggcggaaggaggaggggggggggggagcaggcggcgccggcggtttccgcctcccgtgtcgcccatgagggaggacgacgcgggagcgggcgacgctttttgaactacgccttcttggtagcatgtttaatcaaaataaaaatcttcttttcattaaacaataaaagttgacaagaacattgtatataaaaaagagagatttaattagattgtttatgagataggattttgtaggattattgcaggaatgactccaattttctcctaaacagttaatttatgccattggaatgattttgaaaataacatattataatagtatatgtcttacgattgcaaattttgttcccatttctacttttagaatttcttatatacaaaacataattgtatctatgaaaataaaaattatagttaattatatacatattattatattatgtttttaaatctggtttggcgcaaattaaattgcatggggaaaaacttgctaatctcatcaatgatttttgactgctcagatttgctaatcttctagacaagctcacctccgggatccggctattatgccgggtttcaggagattaagcgattggctaggcgtagatcacttttcttcctttacgactttaagcactccctcttctatagatacatgtaacatcgatctcattaattcacccactctaatttcttataatattttaatagacatgcgaccagatctgtcagaatttttttttctggtaaccctcccttgaagcctttgcatacctccatactgctcataataacatgttacaataccctgcatcagcatcagaaattcagaatcaagcattcgagcaaacagtccaaagtaaagagaagggaataacaatataaatatataaatataatagagtagcctttgcttatatctcactccctcttgatccaaccaactataggatatgagatttgctccgatccaacaaaaagtactttgagttaccagtacctcacggtaccaaatcattttcgatcattggatctaacagtacccattctgtccagttagattcaacggtcgaaaatgatttgataccgtaaagcaccggtaccttgagatacttgttgttggaccagagcaaatctcagaacctacagcaacacattttgccaggcatgaacatgcatatattattccatttcacacctctataaatagagatgcaaaactcgagctccatcacagctgcagcaaattaagccagcaacacttgctaagtggagtggagtagctagcttctccagctagttagtgaattaagctcattaagctgagttaattgcactaacttactactccaagatagcaatggcgacttggtccaatccctccctgatcgtcgccgccatcttcctcgtcatcagcctcacctcggcgaccgtcgccaatggcggccgtagcggcggcggcaggaggctcgtcaggagctacgacgagccgtgcaagaagatgacgctctacttccacgacatcctctacgactacagcaacagcaccgccaactccacgtcggcggcggccgccaagccgacggcgctggccaccgccgtgtcgccgaacggcaccttcttcggcgaggtggtggtgttcgacgacccgatgacggaggggacgagggcgctgccgccgccgtcgtcgctgagggagacggcggcggcgcgcgcgcagggggtctacctctacgacagcaaggaggtgtacgacgcgtggttcgccttctccgtcgtgttcaactccacggggcgccgcggcacgctcaacctgatgggcgccgacctcatgtcggagaagacgagggacatctccgtcgtcggcggcaccggcgacttcttcatgtcccgcggcgtcgccacgctccgcaccgacgccgtcgagggattggtgtacttcaggctgcagatggacatcaagctctatgaatgctacatctgatcattacatgcatgttttttttaaaaaaacaaattgaatttccatttttttttaaaaaaaggtgaatttccatctcgatatatagttgcttgatttgcgtgacgagttatatgcaccgacgagtgtgcaaaatgtatcccaaacacagttttattttccccctaatttgtgtgtgtagaatgtatcaaactattatcgcacttttatttcattcaataaagactaaccacataatcgtgttttgcgcgactttttatcctgtttaagaacttttgtatgtggtctattagtttaccttagctcttaataaggttttgatataagttaatttatttataaagtatctattatcctagccaacaatagaacttccttcgtcccataatataagggaatttgggtggatgtgacacatcctagtgcctctcgagggtcggcgccgaccctaggtgccacatcggcgcaccagatagaccaagaggccagggtggcagcggggaagatgccagcattcgttgctgcttgcaaaaatagttccacaaaaaaaatgataagtattccacaggttgagtttttatatcttaacaaacatactgtttgagacaccagaatccaacagattaaattctggagctctgtctccctattaaccatctgcagggaagtcttattctaccagtcgtcacaaaagttgatacaagctcgaaagtcgagatcaaacaaaaaaaaaccaaccgatccgtagattcgctacataagtaactatagttgccatgaaagtaaaagaaacacaacagctgatgacatttgcactttgagatcggcaatatcaacatcatgacctccttcaaccaagccccatctatcaacctgggggaattaaacaccataagacaagagaaaagtaaatagccttaataaagatagacaatggttgcagaataacctggtgatcttcttcaagtctgatcaattcaattgcctgctcaattcccagcttccctctgaatattgcgagagggattaccagggaatgggctgctgctgccatagcatcaatagatgccaactcaaagtcggtggtattcttcaaaacagtttctacagcattagctaacccttcatcttgctttccaccaaaaaagcttgtgtatacaacaggcttgaagccaaactcagtgtttacccagtctagtatagggtcaattttctccttctgtctttctgcacacacacacacacacacaagaagcataagaaagacattgctggagggaaatgaagagaagacatcgctaaccaaaatgtatggagttatatgctcacaacactatgaattcatatggacgtcattgcatacacagtcaagaggaaacaacttacgataaactcctacagtcagctcattatcatcaggtgaacggcagaataccaaatcttggtggaatttcttcatcaaattatcaattattttttttcgtgtcaatggaactcgttccagtgcagtgcaagcaagcttcataagaggcattgtaaaaggccggattccatctgcttcctatgatgtcaagaaagtttggtatcagtatatgttacataagaaactagaaaatcaaatacataaagaagagacttgcaaagaagttaaattcaaatataattctgggctgtgtagatgagaagcacatcaagtaaacagaattcgttgtaacatctcctgtcacttgtaaaatagatgatgtttgattgcagcaattcagccatgaacatatgttacagttgaaggcagtaatcaatattaattggatgcacacccgtgatgctaatataaccaaagaacaaacaaaaccgattacttatgacatgacagatcttttaattcacatatgcaatatggaagtatagagcagctgactacttcctaagtttacccaccgcaacatataagtacagacatacatacattttaagggttgccatgtgaatatgtgatgcaaatgcaaaggcgcaattgccttatgaagtttgcttttacttagctgctggaatcaacctgataaatttgaatacagtccatcttgtggtagtactattatagggatgataagataagaaccagacaacaaaataactctaaatgctgcattcttcatatcctactgaaacaataactctataataccagtatccgaattaattaggagtcctggtcatcttctttgctacttcccccgtttcacaatgtaagactttctagcatttcccacattcatatagatgttaatgaatctaggtatgtatatgtgtctggattcattaacatctatatgagtatagacaatgctagaaagtcttacaatatgaaacggaaactattctttaaagctgaacaatatttgtagttattctagctgctctagccgcaacagggagaaagaaaagaaatgtaatgccaaaaccacctctaattgcacgatctaaatcatcgatgccactgccactgaatagtacactatggcaagcgagattcactgattgaatagatttaaattgcacaaaatccttccgcaactcattacagttctgggttaaactgaacttacaagattaagatcgacctaagcgctactagtcacccaatttccatttcgaatcatttgatttaccatcttccatccgaatttgagtaatcttacactacagttgagcagcataaccaatcgagggccaatcaaacagaagatggggatcatgacctggtactcccactcggcggcgatggccatggcgagcgtccgcgactgcagcttgagcggccgcttcgccggcgacttgagggtgcggtagtcgagcatcaccgaccacccgttgccgtcgtcggcgcgccgcacggtggcctcccggtagaaccgcttccccaccaccgaccccgtcatgaacgacatcggcatcgccaccgacgtctcgtcccgcgtcgttaccgccgccgccgccgccggcttcttcaggtagatctcatctccccctcccccgcccgcctcttccctccctcccggagaggaggacgcctccgccgccgtccccagcagccgccacctcccccccgccgccgccgcggatcgctgcaggaggaggcggcggcctgcgagtgtcgccgccatgactggtctcgctccgctgtttgggcctaagctgctgttctagtagaggcaaataagtctgtttcgtctccctcatctcttgctcctgtaaatcgtctccctcaactgcaaaaccggatatagcgccgctcccggaaggctttttttgtcttcggaaagtagtgaaaatcaactccttcgatcgttttggaagtggtttctactgacatgacagtttgaccacggtttaacttgctaagtcagtagatgggatccacgtgtcagcgactttcatgtcacctcatcttcttcatcatctctctctctttcgggctcattcggtttaaaggatttttataggattattgtaggaattcaaacattaggatttttttcctatatgcctcattccttccattcctataaaatcctatcaaatacctaaggattatagccttacaagcttattccatatgattcttattatcatgagataagacctcttagaaaaattcctaagaaataagatgcatctaacatcctaattctttaccttccctgtacctttgatttgggaatcctataaaccgaattagccttccatctgtccccccccccccctctctctatcatcaggctcaataactaggcccatccgcaaaatcggcccgatgtttgaggcccaactaggcccagagaaggttcgagacgcgtggagcagcttcgtctccgcggcgacctaaaatcgcgaggactacgaccaaatcacgcaccttcgctctcttttccattgcagagccctcacgcttccgcaaccaccaccgcgtccgtgatcccatccacctccatcgccgccgccgccgcgtatgcgccgccggtgaccgggatccatggcggagccggacctactcgcgcccttcgccgacctccccttcccccccggcgacgatttccccgacttcccgaccctcggggatgacgccttcgcgctggaggatttcgatctcgacgatctggacttcgacttcgatgtggatctcttcccgccggatgcgccgccgccggtgacgacgtcgtcgtcgtcctcggccgccggatcgccggaagcggggacgtcgtcggccggcgacgggggttccaagaacgaggagtccgcggattcgtcgtcgccgtcgaggagcgggagtgacggcggcggcggcaaggatgggaaggatgatgaggcgaagcggcgcgcgcggctggtgcgcaaccgggagagcgcgcaccagtcgcggcagaggaagaagcagtacgtggaggagctggaggggaaggtgaaggtgatgcaggccaccatcgccgacctcaccgccaggatctcctgcgtcacggccgagaacgccgccctcaagcagcaattgggtggcgccgccggtgctggtgccgccgcgccaccgccgccaatgcccatgtaccctgcggtttacccattgccgatgccatggatccacccagcctacgcaatgcgtggctcgcaggtgccgcttgtgccgataccccggctcaagacgcagcagcctgcgtccacaccggagccaccggccaagaaggcccggaagaccaagaaggttgcaggtgttagcctgcttggattgctgttcttgatgatggtctgcgggtgtttggttcctgcggtaaatcggatgtatggtgcagcgtacactggggaaggcgctgcgattgttccgtcacatcatgggagaattctggctgttgaagggccacaaaatagtgtctcaaatggtgttgatccgaaggtacctcagaatggaagcgaaacgctgccagctttgttatatttgccgaggaatgggaagcatgtgaagatcaatggaaatctggttattaagtccattgttgcgagtgagaaagcctcttcccgtttgtctaactatggcgagaagggttctggaaaccaaggaaaggaggagactagcttagcaatccctggctatgtagctccgttagaagctggagaagtcatggattctgctaaaggaatgaatgaactgatggctctggctcctggagatggaagcatatacagggaggatgatgggatgctgccgcagtggtttagtgaagcaatgtcaggtaagaatgctgcataatgtcgcacgcacaccctatttaatttaaatgaacaatactgtatatgccttgttggtgtttgtaggacaatgtggcacttagtgcgatgaattgtttggagtataacacttactatctgctagagctagcgatcttaatagatgaatgtagtgcttattcagtgctggaagtagaagatatctgcatatattacatgttcttttgccgtggtaaagttgtaaacttattgtgggtttagtatgccactcgggtggatgattaccaatataccatgatacataggaggcgatcatagacttttgggtcagtggttcattgtttagtcaccattgtgaaaagctcaatgttgtagttttttccgttgcggtatgctattggagaaggtaccattgcagcatatataattaactgctcaatgcatatattttgttgactggaatgttatgttctgaattactgctaattctgtatattttatgatatttaatttactattgtacagtatactatttatgtacattagtttgacgagtaaattgcattgccggtacacgaacttgtaaaatgctcgttttggtgcttgaatttgtctggtgcatgcggaggaaggcaaaaaggacacaacatggctaatcttattaatttaggggctcattaggaaattatgtaaacatatatctgagaaggtttgctattagacatacacctcttcaataaaaatagaatggatatagtgatcgtagaaaaagataaaaaaaacaaacaatgatataagggttagaaatatatgaaattcatcactttcatgatgaaggataaagtagagaccacatttataaatattgcatgtcttatgtacactcactacacgtatgcacgtcacatcctaatcaacattagcttcgtaaaattaacattgccaagctattttggtcctcattcgcacgaactagacaagtttgtgtatcgaaacaagcatttcacaagtttatgtactaaattgcacccacctaacaagtttgtgtactaccaatgcaatttactcttagtttgaccttataaacttcctctggacaaaaagtcactgatcgaatgaattgattatatccttagctgcctctgtatagttgaattcaaccttacatgtataaccatcacaagtaggtatttcctttgtttgctgaaattcttccattacacatgtcctgtttatggacatatggcacaattgaataatatactggtttttctaaattgtgtagtgaggtagtacttagatttgtgcatatgtgaagcacttattctcttttttgttgatggattagtagagtgatgaaacatttgtgccttgtgatgtagctttgaccctaaccttttaattcctcggctgatagttgttataagtagtttgatgacttggtccttcatttactgaagttaaccctgtctattgattattttccaggtcccatgttgaactccgggatgtgcactgaagtattccaatttgatttatctccaacaacagctgatgcaaatggcattgtgcctgtctactctgggtcagtgactaacacgtcacaaaattatactgaaaatcttccttctggccctgttcagaaggtgaagaacagaaggatttcgtactcagaagccatccctttacgaggttcgacatccaatgacacggatcatttcaaagcaccccccaagaaccatagtcagagccatgctggtcgtaagccagtttcgtccgttgtagtctctgtcctggctgatccaagggaagcgagcgatagggatggtgaggggaggatctcctcaaattctctgtcccgcatcttcgttgtcgttcttatagatagtgtaaagtatgtaacatactcttgcgtccttcctttcaaaagccatagccctcacttgtaatgtaagcaagttttacaacgtaatctgtaacagaacggatctccaaatgagctgactttattgtgcgatgttgatagacatatagagccttttttttttctttttactggattaccagtttattgacaggaatgagtgttggttccttgtctctgtgcttgtgtttccatgcctttgtgatgcatggtcttgtttggaatgctgggatgtcgaaatttctctgaggttttcgcgttccaaggaggcataattcattgttgcatcaccgcatggctctctggttcttgtagattgctggcagttggcagtaaaaggtagtttctttttattactacaacataacttgcatgtactccttttccttttgttatctgtctttcaggtaggtgatttgcgtattttcttgaaacaagtggcattgttttgttctcatgccatgctactcttagcaggatgtcagggatatcattttcatgtcgatgtttatgatcactaccaattgtttgtttcacagatatgtcctcaccacttacttttgttggcttgtttctgttagtttttgcttgtacatatcgtagacctgttttcattgataggaagcaaaacctacagaaaattgttgcttcataagaggatttaagcattcgcagttttttgtaatcccgagtctgaataaagcaaaggtaacctttctacttccatcatggactcacttgaggtgtggttagagagtcttgaccaatgcaacccaggccctagagctgctgacattatccatcctgtcaagtcctgaatacacttttatctgctccttttcatcagaggccaaaagcctggtttagttcccaactttttcttcaaacttccaacttttccatcatatcaaaactttcctacacacaaactttcaatttttccgtcacatcgttccaatttcaatcaaacttccaattttaacgggtactaaacacacgtattacctacatattttctgtggcttctccaaaaagaggatcatgttgcttgatctgtgtgtagcgtgtgttgctcacttgtgtgtgctattaaagacactaaacaaccattgcggatagcattaagttgtgatttgacattccaactgatgattcattggcgccctcgttacctactggactactgtggatccttcctgtgatcatgtcctggtctttctgatcatgcacacctacttgtcttttgtaccggcttactccgtatgaatggattggtgagatccgttgttgattgggattccatcacctaattcgtacgtagaccactttgatctcgtcagtgagacctttgttgattttgtcagtgtttttgctggatggaacactctgttgtcggtcagattattggaagaaatagcagcgctcctggttcaggctgctgtcatagtgctgcctgaacttgcaacatttaggcccggatgcaaatcgtctgctggaccgcacctgcagtaggtgtcactgacatgtgggtcccacctacttcgggcccacttgtaagtggcacctactgcatatgcagtacagcacaggatctccgcactcttaggccccctttgatttgcaagatagagaaaacataggattggagaaaacacgtgattttaaattttggtttgcgtgatagagaaaacataggattggagaaaacgcgtgatttaaaatggtacccttctctaatcatatagaaatgaaacccatgcaaaaataatagaaggccccttaaatgccataggaaaaatgaagaaaaataataaagaaaaggtgagacctctaggtaattttccgattaaaatgaaatgtacaaatataataatatggaaagttttcttccttttccaagtttaatgtaagaaaaaatattttcactagaatttgaattctatgaaaatcttttgccaatccttagtagcttcagatcaagcaagttttgtttaactataacatttttagaacggaaggcttatcaattgaatgatcaagtaataaataataaatttgggaagcacccgtggtgacttcatgacaaccaaggttcaaatcctgatacacgagtcagggtgtgcatttgcaagtatatgagtgaggtatgcgtgtttgatgatatacacgtgcgtatatgtctaccgtacaataacgataaaaaagagagtaaaggtctgttcactttgatgccaggttgctaaaaaaaatagctatatttagtttgctgtcaaattttaataaatataaaagaaaacctaccaaaattttggtaactatactaaaattttggcattaaggttttttttacatcaaagtgaacatgccctatataacaaaatccttccgcgaaattcagttgaacagcatcgccatctctgcacaaaattcagcgaatcagcgagagaaggaccagttccaactccgaagtttacgcggtccacaaagaccaagtgcaccgaaatatgtccccccatgctgacttcgtgctcttcttttagggcccgtttagttccctaaaattttttctcaaaaacatcacatcgaatctttggacacgtgtatgaagcattaaatatagataaatagaaaaactaattgcacagttatagagaaaatcgcgaggcaaatcttttaagcctaagtagtccgtgattagccataagtgctacagtaacccacatgtgctaatgacggcttaattagtctcaaaagattcgtctcgtggtttccaggcgagttctgaaattagttttttcattcgtgtccgaaaatcccttccgacatccggtcaaacgtttgatgttacacccaaaatttttcttttccccaactaaacacaccctaatacttcgtctgcatcttgagttcaaagctgcctctgtgttagccctttgcttagctactaatcatcccacatatttcaaaccatttaaaatccaaatagtcctaataacctactgcattaacgtcactactagagatagtgagagaagataacaaagtgtgttctcgctgacgaaccaaggtgatttcttctatatatattttgcgtttttatatgattttttaagttcgttgctaggttgcatctgctatttttttgcccccaatttttgatggttctaccaatatccgaagcctcaaaaccctatctttgtcactctcctgcttgattctgcctacgcatccgaatcttggccgctttgtaagctgaatgtcgcctgggttttctcgagcggagtaactgggtttggatctttgttcttcttttggtcgccattttggagttgaatctcttcaccgcgtcggacttcttccctctcctggggattctttgtgccgcaagttcttggtgagccattgtttgagcatttcagggttttctcgtctgcgccttcctttcccccccatttttggtgctcaatcctgcttgaggtttttattttttatttcccctctatttagggttcttgatttccatccaattgttgtttgctgctctttttgaagcgtttcggtgaacagattgttgtcattagcacttcgtttgtaggttcactaagtttcttttttttcttggtttcattttgcaagttgttgctaactgcaagaatctgtaacttaccagaatgcagtgtcactcatccacaaatggtgatgcttgtttgctgcggacaaccggaagaagcagaattcggccgatatagtaccaaattgcaataagaaaatggtactgcatgattctagttttgtatctctgatatctgatagcaacaatatttgatcatagttttcgtattcgcagcatccatattcacttaaaagttccaagggagcaccgtttccaccgcgaccgattcttgtcttcctcattgcaatatttggattctatgtatgctacatctcctttaaccagataacactagagaatagatctgaggagaacagtggagaagtgcaggcagaaattcattgccgaaagcctcatcttcctcatgaggagctgcgttatgtgcactttccgaaacctgagagttatagcaggtaattttcctctagagtagaattattatctcttagtacgcccctgttatggatgtgcattttctgattcatgttgcttcaaattttccttcttccataggggagagtgttcctgcaatctggttcgatcctttgtgcttgtatctatgcaacggtcgggaagtggatggtttgagactttgctgaacagccaccctaacatcagctcaaatggtgaaatatttaacagggtggatagaagagagaatatctcatctatcttacagacccttgacaaattgtataatttggattggttcaccagtgcagcaaagaatgagtgcacggctgcatttggattgaagtggatgctaaatcaggtatatttcagcttttcttggtccatgtgaatattagagggttagctctctgttacattgaacttcagaaatcgcacacctttctctgaaacttaccatagtccatagttaccgacagtgtgcactagtcctgttcttgggcaatccagttcatatagtctattcgcttgctaaaattttagaggtatagctagaatttttaacagaactacagggtaatatgcttgcaattcccaatgatatgttctggctgctctttgtagttgtacaacacaaactggtcagctatgattattgatgttggcatttgtgtgttcaatctcattcatcaagcattattgcatgggtaaaattatgcctacaacttacaaagttatgcatggctttgactgccatcattgtgttctccaggggtttatggaccatcatgatgatatagctagttatttaaacaagaagggtgtttccgtgatatttctcttcaggagaaatacattgcgcaggcttatctctgttttggctaatgattacgacagagatgcgaagcagctgaatggaacccacaaatcccatgtacactcaaaagaagaggttatatccatgcaacagtttatgtcctctccttactattttcagttcatatttttcacattgaacatggtttcatactaggtgcacttttgatgaaatatgaccatagtatatttgaatgcatatgggaaatattgtatcaatattggaggaatgactatattgcatttggaaggagccattttctctacatataaaagggctcctcctttccgaacttgtacccttatattaggttatattatagaatatagacaactactggacttctggtatagatattttggtgaaacttaaatcctacatatttccattccaagagaaatgtaacatcactatcaatcatgttggcaaggaagaaaaaaaaaatgaaatgcttatatattttttctgagcaggctgagatattagcgaaattcaagccggtgctggatgtgtcaaatctgattccaaacatcagaaatgccgagaaatacatcagagattgcttggaccacttcaacaccacacggcacatgatcctctactacgaggatattgtccgcaacagaaatgtactaaaacatattcaaatgctgtaacgaaggatcaatgataaccctcgctttgctaaaatatcatctctatgaatgcaggcattgttccaggtacaagaattcctcggagttccggtgagaaagctggtcagcaggcaggtgaaaattcacactagtcctcttccaggccttgtcaggaactgggatgatgtgagcaacaaactgaatgggacacagtatgctcattttcttgacggtgcagattatgtcaggtgatctacatggatgtgagcgacaggattttttttttcatatggggttttagttgccatatgattgattcttttggtacaaatgagttggtaaaagaaagggataacgataaatagatcaagatgagagaccttgtgatcaaattgtacatgctttccactactcattaccttcagagctcaaattgcaaatatatgctcaaaattgctgacagttttgtgatggttattttgtgatcaaaggaatacactattttggttcacttggaagaatccgaattaacgaaatttgtagttttgttcacctatcaccatcattatattactcggtctataagccgtagctcaactaataactttgcaaatgaaaggctaaaccacaggagacagcaacagaaatgcagtctcccagttccatttttcaggtttcaacactccagtagcagtgtacactttcgaaatcaaataatgtttcctcgcaaaaaagaaaaagaattgaataatgcatcatgcatgattgccttctagcctaaaagagggaataaaaagcggggaatgtacccaatagttagtacacgaaaaaatggtcgcagatcaacaacggattaataactcccgtaaattcttgtacaagagcaaaaacaccactcaaaatcatgtttacaagttgttacagctacaacatcgttaagggcaccagctaatggtgtgggcatcttgacagtggcagatcattgacgccttcgcttaatcctctcaagggcgccaagctgctcattctcctgggcaccagagctttcctcctccctgttctctgcagctctcttgccgagctctccaaacaccgcagcgggaacactcttctccgcaatttggacatcgtcttcctcctcgtcgctctcatcgggcagctcaatgtcctcattgttagtagcagcagcctgttgttgcctgctgctgctctcagcctgtgcctgcactccagcactgacaaagttcatcatccggttagcaggagcagtagcagtgcttggagctggtggagccgtggaaggtcctggcgctagttgcctttctaggttagccatctcatcctcaggaacaccggctcgtttcagagtgtcaactgcctcatcgaggttcagcctctggtccctctgcatcaagtactctgggagtatgaaatgagtctgcacatgaaacgaaatacatcattttagtttactaactcacaagatgatcattgataataccaaactgcctataaggttggcccttgtgacatacctgactgcggctagcagccacagtacgcttgatgcgaagcatctccctgaatgtatcttcgttaccatgctgaatctcaaattcattccatttattccaaaattcaggatgagagtttggatcagcatagttggatgcgtggacataaatggcacgggcacgatcaatttctccaaggtttctttcaagttctgcaaatttcatgcacattgtcatgacatctctgtctgggagtccagattcaattgcttgctgcagcacaaaggaataaagttagaatcatttacagttgtgcatacctaaagtgtgactcaactaaaatctagaacatactatacagaaaaatagtatctggatttttcataagtatatgggttgttacagcgagtgcagaatgagttctttgattcatacgaacagttagcaaaaaaaaaaaaaaaggcaaggctgttggaatgtaataaaacccacattaattttgtcttaaaacagcaaaatgtaaaactggatctcaaaacaagcacacgatataaccagtattagtaagaaccaagataacacactcacctcatatatctgtcttgttcttggaacaccaaatagctccgcagcccgtgcaatatatatttcgtacatactcatcttttcgctgttaggaacagcccttacagcttcgtcgtatacattcattgcacgtttcgcaaggccatagtcttcctccagcttagcatactgcaaatacaataccttcttttcttgtggaggagcctgatcaaacaaaacaaaatgtaagtactgaagcaatataggaaaaacatcattttcaaaacagcatcgatgcaggaaaaaggaacacgaaataatcaaccaaaggtttggaatctaaacaagcaagcaagcaaatgcaaaatatcgcatgacatgatatcagcaagcagagacaaggttcttaaaggaagaagaaagcaggcgcaacaagaatcgccctgaacttattcgtatgaagcaaggacaaaatttctgattgccagttatacccaaaaagcatttggtaacatgttaactaaaacaagtcccaactccaactagattaaacatgattcaacttagcacattttatccggtgaacaagaacagtacttagggacacatgcattcagtgtttcaaaagttaaatgtagatatattcataactactttcatgattttacaaaattattgtgttgtggagatggtgtctctatccaaactgttactcttttgtgactacagcagcatgccacaaatattgcttacatgcaagcattgcatacaactatatgtaagaaacatgtgggtgaaattctagttacctgtttgacagcttcatcgaacagttctcttgcccgctctaacttgcttctctgataccttcttacaaactttgtgaggtaggtcacccaaatgtctttaacatggggatatttaaaaattttcacaccacgctcatacactttaaacgcatcttcgaaatacttgttttcctgtggaaagaggaaatgtcatgatattagcatatgcacgataaaatagtttactcgaattttggaaatgcggagttaacaaataatcctacctcaagaagatatgcataattgagaactatttggggagtggcaattcgtaaatccaatattctctcataaactgcacgagttgattccaatgttccaagactttcctccaggtccacatagaagctccacagtttcagggatttatgtactttcaattggacaggttcatccccctcagcagcagctgcacaggacatattgcattactgttagaaaatatgaacagtaaaacacacaacaaaaaataagatggtaaatatatatatatatatatacctcgcctcttaacctcaacagagggttctgcagtagcttgcctcatcagctcaatagccttgtcaaaattactgtgcctcagctccatctctgcccactcacaccaaatactggctaagtggtcaactgccttgtagttcacctgtgttgcttttttaaagatctcttcagcactatctagacgattatgtttctcatacatctttgcgaatgccacccatagagtatgtggttttccagctgccttcatagggtctacggttttcacagcttcaacatatgtggctacttgccttgtaggatccttctcaaaaagtttcaccctcctgcaaacataatcgtattgttagccaattccatcaagtatgagaatggaaaacacaaaagggaactgccaacatactagtacattgctaggctgagaaatgaaaacacctgccactagattgatacattccacagtatacatgttttgaattaaaatttaccacagccacttactgcactaaagaatccaaaacttgtcgctggaaagaaatatgtactacaaaaacagtaaattgcaactacaataaaacagtaaaaatacatagaccgtatacttacaaccatatgtaatagtccagtggggtcttgcattagtcatttaatatatcacctaaaatatgagaagggaccaaactttttgcagtaacagtacatttggtttgctggtttaacatgaattatccaaatcaaaattgttctactaggctggaatattgagatgctactaagttaagatgttgatgttgaaaaaataaacagcatgtacatgaagtgaactaaagagcaaattagtgtttactattgtcaaaacacatgaaaaagaataaatcaatgtgatcaatcaagtgagtctcacctgtgccattcctccacattatgcggattctgtcgcagcaggacactgctgaggagctctggccggcgatccaacagccgctcaaaccttgccagcctcaaatcagtatcatcctcatcattcagccagcaatctgcgaggaatttcttcgacagcttgtccatcccattcttcctgcccgcttcctcttccccctcactccccgcaccctcctcctcggctgcctccagctttgccgcaagcatactctgctcgaattgtgtgtacgcctcaaacaccacgctgaattcctgcaccgtcatcaccgaagcaaccccctcttcgaagacatccctcgccttctcatacaaggttcttctgacgtagtaatcggccagggaggtccacagcttgccaacctcatcggtgaacttgcgaatgccgccccgcagtatagcgtccaccttgagccccgcaacctcatcggcatgcttggtgaggatttcgcagagctcaagccagagctggtgctgggtcttacccttgacggagcggaagccgtcatcgttgagcacggacgcgaggcggtcggcggcctcctgccagcggtttgcggagatgaggaaatcgatgaagtcctcagcgtgggaggggtcgtactggaggtatcgtcggaagacgcggagcgaggtctcgacggggcaggccgggagcgaggcgaggcggaggtagagcggccagatgcggtcgtgctgcgtgacggggagcgcgcgcagcgcgcggtcgaaggcgcggcgcgcgcgcgtgagcaggcgctggtcgagcagcgaggtgaggtagagcacccagacgcggggcatcttgtgcatggtggcgagggcgcgctcgaaggtgttgttgagggaggcgtaggcgtggtgggagatggggtgcgggcgcgcgtggtcgaggcgctcgcggaggtaggcgtgccacagcttgtagctccccgggagcgccttgagcgcgcgctcgtagatgacggcgcgcttggcgaacggcgcggcggcgcgggcgacgaggtagcgccaccaccccttgagcttgaacggctcgcgcaggatctcctcctcgtacgccaggtcgtcctccgtcgggtacatctccggcgagatccccagcgcctccgccgccgccgcagacgccgccgccacggccaccggaccccccgcaggcgacggcatctctcgctagggtttagtgctccgccgcggcgaggaggatttgcgccggagagagagagagagatcgagtcgagacggagaggctggcttggcttggcttggccaggccggcgcgtcgttttgttgggccgatgagttggaacccgagtaggcaagggcttgagtggttttggtgggccttcagggattttgggctgaacttttttacggaggaattgggcttatttggtatttgagtaattgggccgagttttgtctgaaccagagcccaaccgtcagtcatctgcttctgctactctactcaaatatttctttccccgattttggtatacatttgtcaatttttttgttaaaaaaactacaattatactgtatttatatttgactacagatatatagatagtcctttttttcctgaacagaaactttaagttttttttcttagagaagaaactaaagataaaatattactatttaattatgtgattacgtgtaagagttatttgctgcaatgcaaatgttgaagtatagtcgtgctacggtttctttatatgccacagaccaggaaaaacttggcaagagaaaatagggtgcttttttggatagatgtcgaatcatgccgcacctgaattaggcagactgactagtgagtagtgactaccatcactgatacaacaaatcttggcgttggacattatccgtacgagttcttctcaacaatattctcccttggtccaaaaaaaccaatctagatggggatgaaataccacctagaacaacgaatctgatattccatccccacttaggttggattttttttagacggagggagtagctgaacaacgaaaatgttagcccctctatttttttgggataataggcagtgatcccagtatatgctgaataaaagaggggcaaaaaccacaatgttaatgagactagatcctaggtggttgcgcgcacgcgaaggaacggacgacctcctacgtgcagcgggagggagggaacggaaggaagaagaacggcttcgtttttaaaatagtagagatatcacgtacaaactgccagtataccactaaggcgacatctaaatacatttcagcatgctcccataaaacttcattgtcaaggacaagaggtttggtatacttcgaagttcgaaagaaaaccaacattgttacattaccggacttctgctaattaaggctcaatcttgcacaacaattcatctatggaaagaaaaaaggagccattagctcataactccagattatttaatcaataatatgaaaactatatgattgatgatgaccaacaaaatcaatggaaagcctctatcagattcagagagctcacatcattcgtgtgcttttcaccttgctcctgaccaatcctccattccaggagtctatcagaattcagagagctcacatcacttttgtgctttcaccttgctctcgaccaaacctccattccaggaggcgcacgtgcatctgcataatctgcatattgccgaaccaactgagcacgatttcaggtgagcttaacagaatctgttcttgaacaagaaaaccaagaaatgtcactgccaaacttgccaggtcctgatgaaggcaacagaggaggaaccctgccttttgcctgtccacacagagatacacacccaaggccgtgattagttgcatttttttttcaaacttctaacttttccatcccatcaaaactttcctacaatcataaacttctaacttttacgtcacatcgtttcaatttcaaccaaacttttaattttggtgtgaactaaacacatcccaaatcgtctctgcttcttgctctccacggagaagggagatcaccggcgcttccacgagttgctcctcgccggctcgccgctggtcgcctcggccgccgccgccgctgcagttcgcgagaagcacttggggtgctagtgtttgggcccaaatggaaacaactgcacgaggcccatgtagtccggcccaatatgtatagccagtataattcgatcctttatatttgtggtcggaggtggtgagattaagctgcaccgccattttagattagtacgttgtcagcatcggtagcgccttcacttttaatacttacccgtgtctccatcgcaaaatataataagttttgattagataagatacatcctaatattataaatctagatagatcgtttatccggattcgtggtattaggatatgttctatctaatcagaacttcttatatattttgggtagaggaagtacttgctctatccactccaaagaaaagcttagggcatgtttactttgataccattttcaaccttaccaaattttggtaaagttgtcaaaaaaaagtggctacatttagtttgctgctaaattttggtaactatacaagaaatcctatcaaaattttagcaatttgccaaaattttagtaactatgccaaaatttggtaagattttttttttcatcaaagtaaacaggcccttaattctagttatagaactggatgggtgcttatcaagttcatagatagaattaaattattattgtttttataataacaggtctactctctccatctcaaaataactcaatttgtgatagtaatgtaacataaactagattcattgttcgagtcacttgggaaggaggaagtatagctcaggaacgggagaaattcttggcgtgcggcagaggaaagctgtcattgccttcgtcgatgatgtgtgctgctaatgtccattgcacaacactgattaatttatcagctcattgacttcaatacattcaagtattcaatcacatcctaaattaatggatacaagggcacgtgtccagctgtcgttggttcaggagctgatggcctggtgctgatcgagacgctagctcagctgcaactgcaagaatgtaaaacaattaattagccaagctgactgtaatcactggttcagaaactgatcctgaagatctattcacatctcaaatactccctccgtcttgagtttttcttgcactgtttgactactcgtcttattaaaaaaattgaaattattatttactagcaaatatgtccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtggttttttaaaccgtttttattttctggcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccatttactttggaattttttcgccctgttttcaccacgtcgacggagtcggattcgtttttatttttcccctttttggctttttttgtataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaaatttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggacagttttctttttattttttaaactctttttaccgtgtcgatgtagtcggattcgtttcggtatttttttccttttttttgtcggacatatttgttttttttccgcccggttttttttcgccaggtttttttatcggacttttctttttttttcgctcggtttttttctcccgttttttgacggacgacagaagcacctagagaattttcttttctccaatccaatacagatcggatctcttccagggaaatcagattttttttctccagggaatcggactcttttttttcgctttttttattcattaaacggtttgtctctcggacttttttttccctttttaagggatcgggtgttttttttgccagggacgggtgtttttttcgcccggtttttttttcactttttttttgatcggactttttttttcgtccggtttttttatcggacaaacttggttttttctgcccggttttttttcacccggtttttttgacggacgatggaagcacctcttattttttaagtagtagtagatttattttatgacttactttattatccaaagtattttaagcacaactttttattttttttatatttgcataaattttttaaataagacgagtggtcaaacaatgcaaataaaatctcaaaatcccttatattatgggacggagagagtgtatgtagtactacttaattagtcagataattcagagctgctgctcgaggtcgtcgttgatgtcggtcaggctgatctgcccggccggagagaggtcgtacgtcaccggtgaaacacctgatgacctgaatggtgatgctgctgctgtccagcttctccaacttccgcatccgtgtcatctcgacccatatttgctgtgtgcagcgcattgccaaaaaagaaaaaaaaaacagagagagaccaattgacagatatgtgcagcctgagctgatttgagttctaaactaacaatattcagttcaattcaggggcggatccaacgtgggtgagtcctccctacacccacaagacccatggataccccggagcacctcattcaattttttcgccataaatgataaactaaaggtctctaaatggctggaggttaaagaaactgtgtaattaagccccccccc

SEQ ID NO: 71116 - DNA, 86058 bp, Oryza sativa
gcgcgctccgcaccctccaggcgccgcacgccgccgtggccgaggccgaccgccgggtggtgctctacttcacctccctccacgtcgtccgctccacgtatgaggactgccgcgccgtgcgcgccatcctgcgcggcctccgggcctccgtcgacgagcgggacctcgccatggacccccgctacctccaggagctcggcgcgctcctcccccgcgcgcgcggtgtcaccctccctcaggtcttcgtcggcggccgccacctcggcggcgccgaggaggtccgccgcctccacgagtccggcgagctccgacgcgtcgtagccggcgccggcgcaaccgccttcgccgcctgcagccggtgcggcggcgagcgctacgtgctctgcggcagctgcaacggcagccacaagcggtacagcctcaagggcggcggcggcttccgcacctgcgccggctgcaacgagaatggcctcgtccggtgcccggactgctccccgccggccgtctgatccagatccaaaggtcacaatctcatgactactagattttaatgtttttttagctcaaacttgagatatgaaatgagctgtgtgtgtagctgttactcctactacttgttattattgtagtggtgtttttgtgtgtgacagtgcccaattgaaacttccaagttcttagcatttgctaaccaacgtttctaatgtttgattaggatttagtaaaagagttgttgtttccttacttcttggctatagtaccaagtaccgcttttttaccctctcttagctcagccttgaatggcagattgtcagtctgaatcggtttgttctatactcttattttaacttttgagtaaatgattgataaatgccactagatgactagagtagcagttaagaaagatatataaatctactagtagatgcgtgaattctactgctgttaattctcacttcctctgcaatatttggcctgatttcaaaactgttcaccgctctgatcactgagctcgaatggctggtgcgatgttgcttgtttctttactgttgaagtttctagaaagctgctactcctgcttgccagtcgccatacacgccaacggttgctggcgatatctatggtgggctgctgctacgctgaaaaagcaagcgccttgctcagaagtcagaaagcttttctttcaaggctgctattcattcggaaaatggaaagggtgcggcccgggtttgaatgcaatccgatcggtgaagtgtccgttgcataggacaggtttcagaggctcagcgtactaacctccaaagtatcatcgaactgaaaacttatgtgaaggcttaacgagtcgccagccagccaaccctttttccataaccatgaggtagtagtaccttttcaggtttaagagcttcaaaacagccggtacgagcacctccaacaaccatttcaaatctagctctccaaatccaaatattaataatggcagtgtttagttcccttcaaacttctaaaaattcagtcacatcaaatgtttggacacataaatagagcattaaatgtgaacgaaaaaataattgcacagtttgcatgtaaattgcaagacgaatcttttgagcctaattacgccatgatttgacaatgtgatgctatagtaaatatttgctaatgacggattaattaggcttaataaattcgtctcgcagtgtataggcggaatctgtaatttgttttgttattagtccacgtttaatacttcaaatgtgtgtctatatacttaaaagaaatttggcacatgaactaaacacgaccaatatctctttgatcagcttgtaaaaaattaaagagccaaatttacttttcagtcattccaacatgactgaggatttcacatgtcaatctctatacttcttcctttctccatatctttcccctcctcacccccctcgggggtctaggcagaggtgttgacgacgatagtgtgtggaggcggtggagccagcgggaggaagttgggacgacgtaggccaaggtcgaccaacggtggggatgctacctccggtgacaacctacaacacgtagatctggacgtctatagtggagtaaggcaaggaagctggtctcgagacgacgatggcgacaacatgcttctcatcgacgccgaggggagacgaaggaaggaagagttgattggccacctcattctccgcgccagttgccggttggccctcccacattgctagcgctagggggcgggctccggcatggccgttgcctcatctcaaccaccacaccaccccggatttgcccaatggctgccatcgacgcttcctctcctctggcacaagagggaagaggggagtagccatgcgaagaggctgttggatcacaattttttttgctagacttatcaaaatttaacttagagaactgttcggagagaccgttgaatatgttctaaggtacaattcaaagtctcagattgatcctaagttcctaatcttctctttccttttcttccacttccatacatgctcggaaaccttaaataccagcgagcgtgtgactcaagatgcagcgatacaaaagtgctgttcttctcttctctctcaccggctcccaaaccccaatttgttgaagcgaccaagcgtcgaacatgatcaggcagcacattgaccacccatgtggtgcttttacttgccacattgccatctcgtgccctgtgcccgcaatgcacacttgcacagtgctagctgctagttagcgcaaccgtgctccgtgcaaagcgcgcaacgcgttgatggcggcgcacggcatggtaccgtgcatcagtcaccacaccagtcagagtcgcacaactcacgccagtggccggccgctcggcgtgttgcgcgtggaagtggaaccttgcggcggttacgcttggcgtcaagggctaccggagcttggagccgcgaggggcgcaagtcccccacggcacgtggtggtgggactcggtgatccccttccccctccggcttcccaagtcccatccatccacccagtcgcgcaccgcgcacacgcagcggtaacgtgcctccgcgagggccccgcgccttgacagccttgttgattgcggctccgctccgtgcgtgctccatcattgtggatcaagtggccgcttcacagcaagtgtagactagttgtagtaccctgctagtatgtcctaatcctgctgccctatatgatgcctctctttccatgactttcacgatccactgtttgtcggcgatgagggttagagtgaccacctagccgtcaccagcggtggccgctgctattgtccttcagagcttgaggtgaaggtgttttaaatgctggctcattagcgcttgaacctcatgaatgggccggcagcctctgcgtgtggaagcattattaagtgtaccgtgcatatgtgcatgcaacacgtcgtcctgccacgtatgtacgttcacgcacgcatgaatggctgcctttacggtttgctagcctgtggtaccagaaaggcaagaactttgaatcgagtaaatttctctgttctaaaaaaagagtagtaaatttctcaggctatcgtcaataactgaacaggaaaaggagcactgcagagccggccatttactctaggcaccctttgtcccttttcctgcccttacgcttgtaattttgccactgatcaccaccggtaatggtacaactggaacactgtaggagtaacaaaggacacatataaggacgcacggatgcagtaacttgccggaaggacgcctaggattattggaagtttggaggcaggcactcgcagatgggccacaggtgggagcagccccatttgcagcggccgtcgacgttgccgtgatcctggcatgtctccctgcacttgtgggtgtgggtgcatacgaggtagcggacgttgtccacgttccagcagtcctcaccctgaacagaccacacctcgcctgacatttaaaaaagaaacagattaagcagcagcgcattgaggatggaggtggcgctgatgggcaaggggtgatgctcattgctcactggaagcaacgatgagcagcacaagtgcacagcggagcacaaggcagtctttctccaagcgaaatgcagatgaattggtgaccaactcgaagggtaatgcagcaagccagcaacattgtagtgtgttcatgtatagaagttgtgactcgtaggccgagagaaaactgaaggctcagatcactggaggtcaagcgggttatccgagacaattataggaacaagaaaactgaatattgatgatatagagatcagttctagatttatactaatagttggtattaccaatgatttggctttaatccaaatatacactatcaatattcaaattaccaaattgatatgacatattttgacatcaaaccagaatgacccataaatttcacaacttttatatggctctacccaataagcaagggatacagtccaagcaaatcgggtgtattcggatgccacttttcccaacctctctcattcgttttccacgtacacgctttttaaattgtttaacggtgtggtatggtttcaaatttgagagaatgacatatgggttcctaggctaagaaattgtagtacgacatagttgcggcattgaaataaacacatatctaagaaagtgtagcttggtaatgtgaggcaactaaccaaacacctccttgctgtctcaccacaatgccactttacattggctatgtaagaagaagaagaagaaccaagttatacatagaaacacaattccctcactagatcgccacagtaacacaaaacatccattacaatcctaaaaagatcatatcaatagttgcaaagataaataccataattactttataggcataacaccatgattaacatgtttataggcacatctgatttattctagctgtcaggagatgagagcagtcctacataaatgcatagatatacatgctccacgcgcagttgttcttgcaactaccgatcaatctgaatgatctgaccttagtttctgctagtcctgagctgcgtcagcttggtggccatggccggcatcgtcgacgaggggtcctgcttgccgcacttcctctccctgctgccaactctcgggctgccactgccactgccgctgtccgttcctaacccgatggacagcttgctcagagccttccgtgcgtcggtgcagtacttcttgctcgcgtcgagcagcgacgacacgccccatccacggcttgcggcctgccattcctcgcggctcctcttctcgccacgcggccgcggcaagtctcggccgccgctgccggtcttgttctcctcctgcattgcgtcgcgtagggtgacgaacctgcggctctgtgaggacgaagggttgctggcgccggcgagaggggacggcgcgtactgcgccggcgggctcctgaacccgcaaacggcgggcttggcgctccaggggaagaacaccatgagcccgcaggctctcggtgacatctgctcgtcgcggccgttgatgttgatgcgcggcaaaagctgcacctggacggggtggtcgttgctttgcctggccgtcggctgctgcccgtcgtgatcgcggcgcgtggtgcgtcgccgccagtgtttcgggcctctgcccgaggacgaggacggcgtggcgagggaggcttccgctggtgcacggcgggaggaccggtcattgacgaagctcgtggcgcggccgaggaagatgtcctcgaagcgcttggacgtgatccggtcgaacgagccgacccgctgatcgggcgtggagaccctgtccagggcgtcggagaacgacgcatcgtcgtcgtcgctgctcgcggcggtcgagttgccgtagccgcaccagttgctgccggggcactgcttccagcgcccaggcggcggcttcggcggcggcatgatctcctgcgccatgtgcatgcacgcgctgctcctcttgggcaccccaggggagctctcccaggaaaacggcacctgcgtgcgcagcggggaggcttcgcggcggcaccgcacgctggccgcgtccgccgaagcgcacgaccggcgcggcgtggggagcggcgagtcgagcagctgcgggagcttctcgccgtcggcgccattgcaccgcagcccctccttgtcccgcctggtgacgatttccatgggcattgcgccgactgactgtgtcggcagcatgcatcgtctcgggcgttcaacgtgtggaggggacgacgtataagagtacacgcgaagactgtaggtagaggtgcttttcccgcgaaaagtggcagtagcggcggttggacagtaaccttcgtgtatggttgtgtgttcatctcacgtactgttcttttgcctctcgctagctcgttcccgtgatcaaggtgcatgctcgatggccttaatggtggaggttgccgaaaggtagcagaggaaatcaggctaaaacttgcacacattacataggctaaaagcttgtgatgtgaaacgtacgcgtgtctgcattggccttgccatgtgtatagggtggttggtggccgccttggggattcgtccgcggactcgggatgcactgttcaagtgtccagggcatgtttgttcggcgatggaatcccggtgatcgccgtggcttgaggggaaggtgagagagacgccacaacgggtttagctctgttccgctattcggcccattaacatttgcttatgggccacctatcttgtggcgtgggccagcaggttagtttggtgcacgacacgactccacgcaccgttccacctagcaactgacgtcgtagtcagtagatgggtcggggactctcggagagcggttcgagggggccgtcgtttgcgaggccgcaagtcgccgtcggcggccgtcgccatcgccgcaacataaaaaaagcgagcaaacccgttgctgcgcgctctgcgcttctgcccttttacgaccgaagaggtagccaacccacgcatcccccccctgacctgccccctccacagccgccgccgccgccgccgctacggctcacgagagtaccgaacgatctgctgccacccccaacccaagtgaccaaccgaaggcggagggtagcaacttcggtctgctcatcccaaggtactagactgtttagtcgattggaggatctcccatgcccgtatttgtgtcgattgctggtggtttgggacgagatctttgcattgggcggatctgttttgtgtatcgttgttgcttgtccgcgcaggtggtgggttcctactttcgtgttgcttccttggtcctgatctgttcgcgttggtgcggtttgggttgcagcgtagttcttagttctagcgtgaagctttgcggattggtgttgtctgtagatttgtgagatttacaaaggattggcgccggctgtgctggatcagtagattgtgaccgagcagaattgagcgggctgcaacggcgtactagagaaaagaggaaccgggacaactaaagattctggtatactggtattctctggatgctgatggattggaggaagacgatcgtagtattttttttttttttgatgtagaaaggcatcaacaccttagttactttaggatggatatagataccttgtggggaaacggtatggaagatactttagcacccccaattttctcatcttgctcataagttttgtaacttggatgtcaggtgatgataatgctagaatttagcttcagattatatcatctcatgcttctcgtgggctcatttcttctgaaccttttgtttgttatgaccaatatttaaatgataatcatcagcttgtagataattttcatactaaaagtttttagaaaatttctaagaaattcacaagctagtaatttattgaagttctgaaggatccagcttttgtgtcatgtcatcagttgtttcactgctatttgcaagaagacatttcatcatgtagtccaaaagataaagaatcgctttaatatgtattaccattacttgtcagtgttttagatgcacttccctaatgatatacaaatgattcatgtcacgacctgtctattttctattcggcatctcctcaatataaatctaatggaactgttcctgcagttaggcatggcatcaactgttgccatcaatttgattggtgctcaggctggcattatctcaaagttaaggaattgcgacatcacaagctacagtggcttaaaggcaagatcatctattagttttgagtcaaggtcatcattcctgggtcagaatgcatctcttcgatcatctatctctccaaggattgtaccaaaggcaaactctggatctcacatttctcctgaggcatcttacaaagtggcagttctcggtgctgctggtggcattggtcaaccgttgggcttgttaattaagatgtctcctctggtctctgcactacatctgtatgatattgcaaatgtcaaaggagttgctgctgatctgagccactgcaacacaccttctcaggttctggactttactgggccctcggaattagccaactgcttgaaaggtgtggatgttgttgtcatccctgctggagtcccaaggaagccaggaatgactcgtgatgatctttttaacatcaatgcgagcattgtcaagacacttgttgaggctgttgcagacaattgtccagaagcctttatccatatcattagcaacccagtaaactcaacagtgcccattgctgctgaggttctgaaacagaagggtgtctataaccccaagaagcttttcggagttaccaccctagatgttgtcagagctaacacatttatagctcagaagaagaacctgaagctcattgatgttgatgtcccagttgttggtggtcatgctgggattactatcctaccattgctgtcaaaaaccagaccatctgtcaccttcacaaatgaggaaactgaagagctgacaaggaggatacagaatgctgggacagaggtggtggaggcgaaagctggtgctggatctgctaccctgtcgatggcctatgcagctgccagatttgttgagtcatccctccgtgcattggctggtgatccagatgtttacgagtgcacatttgttcaatctgaattaactgagctgctgttctttgcatctagggttaagcttggtaagaatggtgttgagtccatcatttcttccgaccttgagggagtgactgaatatgaggccaaggcccttgagtcattgaagcctgagttgaaggccagcattgagaagggcatcgagttcgtccacaaacagcaggctgccgctacttcttgaagtgtggagaatgactatcggcatgagagaagataataaatgcagaaatggttctcaatagcttttagttttgaaggcggaatttttcgtgtctagttgttgcttgtttagtctcttctgatcacatgagggcgtggatgcccaaactgttgcctgttttcatgagctatttgacccttgtgcctgcatcttgatgagatacacaaactaaggaataaagtagtttttgattgttgcctgatttatgttattatatataccttctgggtagtgcaacatggcattgcgccattgcctttggcaaaatagcaacctcattgatatcatctctcactgtgtcactacttaccaatttcatgccaaaattttctgaacagctagggcgaggagctgctgctgcaatgccatggcacgtctgtttctactgaatccgctacaagcctacaactctggtaagaaaacaaggcaaaccatgttgaatttatttcggctgccatagtatgttcgttggattgaaatctcaactgtttgaaaagcacaaaaagtccatttcgctctacatgaaaagatcagttctatcactaaataatctacaggtgttggaagaaaaagaacggaataaacaattgtgcccacttcttcctcgatcaagaattcaggatcatccagctttagccttactcgccaagaaagcgtccagcttgtcgttctgcacccggccgaggaacctgatgcagatgggcggcgtgacgtcgtacctcgcgagcagcgcgtacggtatggagaagaggccgtcgccgcagatgagcccggacgccagcaccggcccgaacacctgcgatcccagcttgtcgttgcggttccacaggaacacgatcaggctgccgatgcacatgtcgatggacaccgccggcaccagcaggaacgacacggccatgccggtgacgctcgggatgtacggctcggcgcgccacttgccgtgcgcggccacctcccgcatcgcgcagacggccagcgccagcacgaagaaggtggcgctgatggcgaggcagtacttgggcagctcgaggccgccggcgccgagcacggcgatgccccggtagatcttggccagcggcgcctggtacgtcttgttggggttcatctcgtagaagtggtggaagacggtgaacacggccgggttgacgacgcaccccatcgccgtgccgatcacctggctcaccagcgtggcccgcggcgaggtgagcgtcaggtagctcgtcttgaagtccgacatgaagtcggaggcggtggagacgatggacgacacgatgccgcagatgacgaggctcccgacgatcccgccgttcttgatcccgatccacgacgcgaacatgaggatcaccagcttgttgtactgcgccgagaagttggtctccgcgacgcccgtgccgtaggcgttgcagaaggccaggacgggcgcgaacgcgtacgcggcggcgacgtggtagtacctcacctggccgtacatgagcgggatgacgacggtggagacggtggccaggacgacgtacccgctgatggcgaaggtgctcgggatgtgctccctgaggaacacctgcgtcctgcggcggtcgtcgaagctcatcaccggccgcggcatggcgtcgacgtcggagaaggacctgagcgtctccgccgctacctggtggtggcgcaccgtgtgtatcgtcctcagcgagatcgcgacgagctggaagatgccgtcgccgaggatcattgctatggcgcaaaacaccttctcgatcacaacaaagtgaagtctgactgattcttgatgcacatcatcgacgtcgtcttttttttttttttgtctaacaacaaatattcgatcattggtagtaccttgtatccactgaagctcttcaagttcgtctcctggagatcggcgtcgtaccagattcctcttttgctccggatgtacggccgcatgatcccccaggagatgatggacccgaagagcatcgagacgtttatcaggtgaggactgatcatcccgattcccacataagttccgttcaaactgatgtagaaactgcaacgcaacaaacaacgaaacacaagtcactcaagccgatgatcgattaatttctccagcccgaataaaaactttgcatgaattcagtgttcgaattcgtcggtttcctcggttcgttgcctagctcaggctcggctcagcttacccgcgattgaaggcgctgagcccaaacgttgggaaggaagtgaagccgcagtttggacctccggtgtagaaccactggaagatggaccagaacaagctcgccaacgacgaccggagaacgagcgagacttgcctcctgtgatcacaagtagacgtagatattaccgtaaatcatgtgacaacatggctataactcaccaagctagtgataatctgctcacttcgcttgtctagcgccgtgaggggtatggaagctgttgatgaggtgagccgtcgccgagccgcttgggaacgtcagccggtggcggatgatcattgtctacggacggatgaaccagtaaatcggcgaagaatcagggagctatgatctcttcttcttctttttttttttgtatttttaggtgcgttcgtggatcgtaccttcctcatggggacaatggcgaggagaccgacgaagctaacgaggaagaagaaggccatcatccgaccgaactccggctcactgacgctcgcgctggagtcgtccccggtgctcgtcttctccgccgtcttccgatccatggccagcagatacgatccaaacccacctaagaacaggccagccgccagcgacgtcggcgttacgacggcgagatcaatggaagaggcaatgcaggaagaggcaagagcgcggcgtcgtgtcgcgcgcggtggcgtaccgctgtatgtcatgctggcgcaggcgacgacgcaggtctggacgacggcgttctcctggcgggtgaaggggcggcccggcgagccgagctggtcgagcaggcgcgtccaggccttgaggaggaagaagccgaggaggccggcggagatgttgagcgacgggatgatccccgacgtgaacaccaggttcatcatcacgctgctcagggccacgcccagcgccacgctcgccaccacggcgcgcagcgtcacctgctccgtccacggcgggacgggctgcccctcgaacgcgcgctccgtcgacggcccatcccgcgggtcgccgaccgactccatcccggccacttttcctcctcctccttacgccgcgctttgcctcgccggagtatcgtcggtgcggatcgagctggcagccaatgcatctactgcgttcgatcgtgcctgcgcatgcatgcaagtgatggtcgatctggaggagggcaaggggaagaggagaacggaggaagaggaccgaacgagtgaacacgagaggcaggaaggctacatatgctttggctattcttggcagagcccaagaggcaagagatggtaatgcaaccgcgaaatgttagatttggaggtgtcactgctccttcgcaccctcttggctcttgccatgcatgaagccagaagcagaatctcgattagccggtaaaattcgagctccaatcattttttcgctgatttcaatcaatttttgataaatttcgaacgaagttcaacagttgaacagaccattcgaaatgatggctcgagatggtcgaaattcgtggagatcgtgacccttggctagaagttactcaaataccaacagcgcaacgttcttgccatgcaaataagtagttcaattaccagcggtgcaatgcgagggatgatagtcccaaaaatcagtgaatcgtcgtcatcttggttgttttgaggaatggtactcaggaaaagggaatcgtaactattgtgactttcatggatcctcagaccaaacaactctagacattaaaacaaaatgtttctataagcaatcatgcatgctcaggtggcgctcacacagatacaatgcaaataagtctaaaaaagcagattccatttcttgtgtagcttttttggagacatttctagtgtggctacgcattctaataagggtttgtttacaacagaagaaacagaaacaaaaagggataaaacagtagataagtaacagaattttctttgttgccaaggacatccctagtggtagacaaggctaggaaaacgtccattgctcatgcaatttattcttctcatacttctgtacaaaggacatctaaataattgttgtgttgtactgcaaagacattttgctccatctaattaaccaactgatccctcaagcttcaggttcataagtgcatccatctcatgtgcaaactcgtaaggaagattctcgaaaacagccctgcagaatccaccaatcatcgctgcaacagccttttcatggtctatccccctttgttggaaataaaatagctggtcctcccctatttttgaagtgcttgcctcatgctcaacacgactagaaatgcaacccacctgttatcacgcaagttggaacagaatgttagtgtaaatgtaatttcagccatattagataaagaaatagatgatacgcattttaggcataagtatagtactggaggctcattagttacacatctgtattcaaaactgcaaatacatgtaattgcagattatggaagtgcttgtgcataggacatgcgtgcacagagataactcatgtctagctcaagatcacaatgggccatcaagaataccatgagaaacattaactgctggaactaagcgagtagcctagaggtgatggtaagcaacttaaaggtacagtgatattgcagaaagaatgcatgacactattagacaaacgaggtcaacccagcggcttctatgaggaaggcagcgcaaaggaggcccgagcgcttgttaggaaggccgaaggcggctagggtgctgaagggcggaaagctaaaaggtcatctaaaggtgtatttgaatgggagcatgatgaaacctgaagcggtactaaagttgtgctggctatacgccatcagtgtcatataaatgttccagatgaataagtatgagatttttcctgcttttgaacatgaaaacgtgcatggcaggagattttctaaccataagataaattggactaaaccaatagtttgactcttatagtttttagccagcataaaagttaaattcagtaatatggaatcaacggcgaccatatttcttctaatatatggaacagtgtgtattcccaaaaagggtgtcattaccatttactttgcatgtcaatatattgaaacttaaatggagaagactgattgtaaccaaggactacgaagattaatatgaaaccctccaacttgcaaaattatcaaagcccctattaatttatacatgctctattgcttttgtaaaacagaaactgaaaaatgacatacagaacaaaggattaacaacctactcttaatagtttgcattataaaaatgcaattggcccttcatgccaggcaaatcaagaacagcagagcagttacctgaatagtcggataggtgttggcagcagcgttatccccaatcagcaaagaatcacactgtgaagaattataagcattttctgcgcctgagtttatctggaccaacccacggtagcaattccgtgacttcccagctgagatacctttggatataatccgactccgcgaattctttcccttgtggatcatttttgtccctgtgtctgcctgctggtaatccttcgtcagtgcaactgagtagaactctccaacagtatcatccccaagaagctccacacttgggtacttccatgtaattgctgaacctgtctcaacctgtgtccatgagatcttagagccccgccctttgcaccgtcctctcttagtaacaaagttgtaaatgccccccttcccctcctcatcaccagagtaccaattctgcaccgtagagtacttgatctctgcctgctcctcacacacaagctccacaaccgccgcatggagctggttggagtcataagctggagcagtacacccttccagatagctaaccgtgctcctctcatcagccacaattagagtcctctcaaattgcccggtctccttgtcgttgatcctaaagtatgtcgatatctccattgggcaaaccgtatccttgggcacatagcagaacgacccatcgctgaacacggccgaattgagggcagcatagtagttatctgccggcggcacgacgctgccaaggtagcgcttgacaaggtccgggtactcgcggatggcctcggaaatggagcaaaagatgacgcccttcttcatgagctcctcccggtgggtggtggcgatggaggtggagtcgatgacggcatcgacggcgacgttggcgaggcgcttctgctcgctgagcgggatcccgaggcgatcgaaggtgttgagaagctccgggtcgacctcgtcgaggctgttgagcttgggcttggtcttgggcgcggagtagtagcagatggactggagatccaccggctcgtacacgttgtcgctccaggtgggctgcaccatggtcaggaaccggcggtaggcggcgaggcggaagtcgagcatccacgccggctccgccttgagctccgagatgcggcggaccgtggcctcggagagccccttggggatggagaaggactcgaaatcagacacgaacccatacttgtactccctcttcagcaggttctgcagcgtctccgattccgtccccgcctgggacgacgacgacggcgatggcttctgcgggcccgtctgcacggccaccaccgagaggcgtccacggcgcgtgcacggcctccgccgggatccgtacgacgacgggcacgccgccccgagcttggcggtcgcggcggcgcagcagggcgagaagaggggcgtggacgacgcggcggctgcggccatggtgcggcggcgtggcgaggccgaggcgaaattagggatgcggatgggatggagagcgcaggaggggtgggttgttgttcggtggtgtggacccgtgctacgtgagcctcagccgcgcgtgaggccggcgcgggtgggcgcggtccacgggaagcccggcgcgatgggggcacggtcgtgtggcggccgagaggcgtggcgcggcagtggatgtggttcgcgccgcgtggcgggccatgcggaaaacgccgtggttttgtgcgatttctccccgtttcttggcctcgccactccgccaccgcaaaaaattccaccgcacacgcgacgacgaaaccgcctctggctgggggctttagaccttcaacggtgcccgttcacccgcgatccgacggtgggggagcccctcgccgtccagatctcagcctctcggatcggacggagcgtgaggtcgtcgggtcacccaacattttctccacacgcggcgactttctagcaaaaacgcagttcgtttaacgagagtcgctcacttctcgttcaggttcagcaatcgcaatctcgtctcatcgtcgccggccatggcggcgtcgtccttgctccggtcgctctcccgcatctcgcgccgcggctgcgtgggaggcgcggggccgagcccgttccaccacagccgcctcccgtactcgccgttctccaccgcggcggcggatgcggtggagaggagggggttcgcggggctggggccgacggcgaagggggagaaggcgcgggtggtggtgctggggaccgggtgggcggggtcgcggctgatgaaggacatcgacacgaccgggtacgaggtggtgtgcgtctccccgcgcaaccacatggtgttcacgccgctcctcgcctccacctgcgtcggcacgctcgagttccgctccgtcgccgagcctctcgcgcgcatccagcccgccgtgtccaagtcccccggctcctacttcctcctcgcccgctgcaccgccgtcgaccccgacgctcacacggtgagacccccatagcagctctgggttggtgtgtgcggccaaatggccactggttttacagacgtgcctgcgtggggaatgcctgtttccaacattcttggaggagtgatcaaaatgtgggaatgatcgaagctcgatcctttctatttttcctcgtgcagaatcgatacttttgacctttttgaataggggagaggagtgaatcggatttctgggctttgctggaggaatcttgactttactcatctgcatcgtgatccatccacagcatgtgctgcgtgtctcttaagtagttgattgagtagttggtgagctgccttttggtcacatcgaaggagaagaaagttagaccaataataatggggaaaatagctagagaacgctgctgaacttgcgtatattcacgaattcatctatggttcgtcagattctatgtgatactgtatttattgtttagtactccatccggcccaaaatgtagcaacctatctagtagagtactaggttgctatattttaggacgaaatagcttttgcctggaaaagaggcatggtacttcgtgaatattcaccatctagtgcatatttagggtgcagttttcatttaaactttacaaacccactggatggttaatacatgaatttcctataccaatttttctctgaaaagttgtttcacctatttattcatcgtcctttgacctttagattgattgcgagacagttactgaaggtgagaaagataccttgaaaccttggaaattcaaggtagcgtatgataagctggtctttgcgtgtggagctgaggcctcaacttttgggatacgtggtgttactgaccatgcaatatttctccgggaagttcaccatgctcaagaaattcgcagaaagctccttctgaacctgatgctatctgatgtacctggtatgccacagaaacacaaaacaactcaaatcaagatatttgtgttacttaggtaatttgtcacattgacaactatcacacactcacacttcactggcacaaaggaatcagtaattactcgttacttttacattttgtttgtctcttgatgaaatttgcaactacattaacctgggctcttattgctgtttcttgtttttctctgtttgattgagcagaatttagaatagaactattacattttaggtatacttgttttttacaaaataccttgtgtgctgaaatctaattttgtttatatcctccttattataaccaattggccaatgttatttgttaaaacaggaatatcggaggaagaaaagcgcagacttttgcattgcgttgttgttggaggtggtccaacaggtgtcgaatttagtggtgaacttagtgattttatcatcagagatgttaaacagcgttattcacatgttaaagattatatccatgttaccttgattgaggttagagctgttggcatctctccctctctctaaactttgaccacacttaacaaattttgtttcattttattatttcaggcaaatgagatattgtcatcttttgatgttcgcctcaggcaatatgctacaaatcaactaactaaggtatgtaatctctgtctaatctagtgttgtactgttgtgccattttaagccatcatgtaccaagactccaagacctaaaaatatgtgtggatcgtataagaaagctggcagtgaaatactaaaaataacttgtgatcatccaacagtcaggtgttaggcttgtgagaggcattgtgaaggatgtacaacccaacaaattaatcctggacaatggagaagaggttccttatggtttgctggtatggtctactggagttggtccttcatcattcgttaagtcgttgccatttccaaagtcaccaggtggaaggtattgtaaattggcttgaccgtatggagtttcatgtatatgcatcatatactgaatgggatttgattatatgcacctgcgcaccttctgtactttgaggaatagggatatatatatatatcttctacatgtagttcatttgtgaatcaggtttcaccatgcactataagaagcttctactatctataggcttttggtatccacccaattactggtgtaacatggctatctacatctttggtacctgtgatagatttactggttgcctggtcacaggattggggttgatgagtggttacgtgttccttctgcccgggatgtgttcgctattggggattgcagtggatttcttgaaagcacaggcaaggatgttctcccagctttagctcaggtacttatctgaacatcttcctacagtccgagtcaatcacaaagtatttggcaaactaatatttgggcttccttaatcttttctggagtaccaagaacactgggaggaataggaaccagaaaaaaaaaagacaaaagggccttacatcaacattaaacagattcttggccatgacaaacctcatctattgtataagggcctgttcactttgatgccaaaaaaaatcttaccaaattttggcatgatttcttatatagttaccaaaatttggcagcaaactaaatgtagccacttttttggcaactttaccaaaatttggtaaggttgaaaatggcatcaaagtgaacaggccctaatttctgttctttctcatacaaatactttctgttgtttgaagtagatgcactctctcatatgattacttaattcaattattttctttagaagaaacttccaaaacagtatcatccctcattttgtttaaagaaaaccaagtagttccgcaggtttgaggtaaaggaaaacatgcagggtgtggtataagaccctctttaagttcagaaaacgctttacttaggccaggctaagtagtaacttaaaaggctaaagggtttaacataaaccgaaacaagatctttcggtgaaacaattcccaatcctttcactatcttggattattgatatcggttagaaagaaatgggcatcttctcgtattagatatttatacattctactgcacttgtactctggaacaggttgcagaacgacaaggcaagtatctagctcacctgcttaaccatgtcatgaaagctggaggagggcatgcgaactgtgagatcgacgttgatctaggtcctgcctttgtgtataagcatctggggagcatggcaactgtcggaagatacaaagctctagtcgatctgaggcaaagcaaggctggttactgtttctgtctgtaaaaaaaacttgcattgttctaaacttctgacgagttaactgaaattgtccctttattgtcaggaatcgaaagggatatctcttgcaggatttgtgagctggttcatctggcgctcagcatacctgactcgtgttgttagctggaggaacaggttttatgtggctatcaactggctgaccacactgttatttggccgtgacattagccgtatttaggtgcctgtttgtagatatctgaacgatgaacagtacagtgcatcctttcccacttctttttttttgtcagatatgtgtaatttccacagaatttttttcttaaataacactatcaaaacaaaccaaggaagcgagttcaaactttaaatactgatgattagtatcgctatctggagaagtctaagaatcatggaacgtccgtgcaacttatcaccatcttttaaaatccgtgggttctggcctccatcgcgattttgtgcactgtccacttgttcaggcttcatttttacccagagctgacttaagaagtacagaaaacaataactagagtgattactatctgtgaagaccgcatgtgaacaatatggttacttgtttcatataatttataaaatccttataaacctttacaataataaaattatgacatcttgaagtagttaaacctcaaaaacagaatccaagcaaaatttgatgtatgatcactctatcttcatatttaaacttcaaaattaatactgtactgggtacacatctacacatagaaaacataatgtacggactacaaacggcgcctgaaaatcaacatggatttaccttctatttagaaatttattaggtcatgtacaacctatattgtatcacctagaacttgggttaaatcctggatgatcaactgctgcactacataagtacaatttcttaaggacggaacatcattactgtcatatgcaagagttcaagaacattgagcatacagcaaagccccaccctcatccaacagtaggtgagagtaagatggtgcaattgattgagcagtcaaacaggatctgatgcagctcccaatcaacaaagcaaagcatactaaagtagtacatccataacatgagcttgctgaagcagatcttcatcatcatcatcatagcagtcataactcatgagcctcgttgtccacattggtgagatccaaatcttttcaggttccaatatgctgcttcattgctagagttctggtgacatgtgagtaattgttcacccagtagagctgcagcagcttgcaatagcaccttcatttcgcgccaggaggtagccctgaagctcttcacagctttgcttagagattccactgtttcatccgtttaaatagttgtgacaactaagacaaaaagcaacaatgttgagatgaactgtgtttggttctataatatgtttagcacattctttgaacagtatacacagtgatcttgtgttttctaattgaacagactcaatgcattttcattttacatcttggggcagttctgcagaaaaatagcattgaatctgttcatgtaatactgcaaaagagtaaaatatttacatggaagttattgaggtaattctgcaagccaaaaaaaaaaacaattaactggcttatgtgtgagcttttggaagatatgtaggatagatgtactgaaaacccaaaaacacagagttgtctcccttccctgccaagagcacctaagcaccacccaaacccttccgagtttgtttccatatgccaatctactatccatgccagtcatagatgcagaaaaatacctgttactctcggctagagacaggcatacaaatctggaaaatcaaccagacctctttgtgacagctggtctgggagctttgtattttgtccgaaatggaaatcaatcagaagaaatctcttcaaattctcttctgccaagttccacatgaaataaatgttacatggtcataaaatagaagtgaccaaagacaaacatgatatatataactcacatgtcatataaagttcaatactatgaacttccttattactacgagctaagcaattttgttccaaataataaacccctttctatgcacacaatcagtacttaaatgtattaagctctttctatgttaaatccgttcctcaatatgtagttccaaaaaggggagtaatcccatccccacaaaaagtgtgctattccttaaaagcaagcaagtaatataaaggttatcacagttacacccaccactgctcaatgaaacagcttccatggatcataaaattcacggcgatggcaaagtttaccttgtctattgaaacaatcaatgcgtgagtattttcattggaggataaacaaggactaaagatcaggctatgtaccttctcccaagcaacaaaagacaattgtgtccatggatccattctctgggtattccttccaacttcaatatactacattattgacctgttagttttctatatgtctgaaggagcttattgacacaaataaaaacacaatgtttatgcctattatttgatgcacaagaataccattgtgttggatgcacatttcagcatccaatttattgtcatggaaatgcagttgaaccattcattacctttcgaatgcaaaaatgtcttgatcaataactttccataaattaaacaggtacaggctacatgagaactaaacagataaacatttcagtgcaacctacgggggaaaatgaaaagagaagaaaaaatgttacactacaacacaggagacatcacccgaagaaatgaaatgcaatagttgaaaatcagcgagcatggcatgcagagtttagatcaacaccacaacacagaatgttcagtttatccttcgcctcttgttccgttggaggcccccgccatcagcatccaaagaacccagggcactgctcctccctctcctcctcagggatcttgatgaccccgcgttacttggttctcctgcactctcagagataccagcatccccctgtatcactgcagcagtgcttgagttagatgcttggtctgcagaaggtgctgcaacaacatgagttctgtcaaatgttgactcgagatttggaggattcgatgatgaagccgatgcaccatattggcttggtccagttatccttctaaaatcactcatggcagatgcaaatctttccgtgtcttcatacccaagaagggtaagtccacgcaaccagtcaattccatctggtaataatgagctcggaccatttctggatggatccgatgcattgtttctgatcaaaccactgtcaggggaagtggatccgccatcgggagggttagggttgtctgcttctctcagcaaccgtcttgctctcatccttgacgccaatctacttaggcgactggtgtgctgagcgtgagcagtgtcaaccatttcctgcacagctgattcaggcggaccttcaaacctactcgcagtattcataatctgttggtccagaaggcgcctccatgatgacaataacccatgagcctcaccaagccttcttgagatcggtcgcaaatggtgaaactgctgcctgaagctttcgagccgatttccatgtggtcttggtgggatagtaggacctgtttgtttcccaccttccacagccttctcggcatccaaacatgaattccctctcccatagatcggagtaatattcgcctcagtcacctcgcctttgcagactgggcattccttgtgattggaataaacattgagccattggtacaagcaaggccagcagaagagatggccacaagaggtgaccaccggctcgctggccatatcgaagcatatattacactcaaatgtggcagcgctcctgccctgctcctccgattcctcggaggcgcctacttccgcgccatcggcagctaccttattatgttcaacagtatcattcatcggttcatgctgcagcactgggactgcggcagcatcacgcccagctgggtaagcttcagaactgagtggcggaaggtccgacctaaaccgcctcgcacggagccatctgcttccagtctgctcgagaagccgccagtaacgggctgcggtgtcagggaggaaagaggacgatgccgtcgacgaagacggccggtcctcccaacctagcagttcgctggcacgcaccagcggcggcggggggtggaggccaaactcgaggtcgtcagggagctccgagaccaccggagccggaggcggcgcatacggcggcaggtgcgtctcggaagcaggcgggtcgtcggggttgtacagggagtagacctcctgcagcggaggggaaaggtcggcgtgagagggggagtacgggggatgcgacagctcgggcggtggcggcggcgcgtcgacggaggctgcggaggaggacggggaggagggcatcggggtgctgagggcgaggtcggagccgaggtcggagcggcgcgggcgcggggcgcgtgggaggccaaggtagaggttcagatccatcctcctgctactccccgcggcctcatcggcgtccatccgacggcgacgagctccagcttcctccggacagcaccaggtcgccggcttcagctccccaccttaccatagtaggtcgtctcccccaagaggaaaaccctagctagagacagaggcactgcgcgggagagctgcgttataggttgggtagcagtaacacatctccgccggtgctcacgccggcagattagcaggcggcgccgccggtaagcggcggctgaggtgggaggaggagagggagaaccggagaagagaaggggagagagagtagcagcaatgtggtgccaaaaagaggtgccctttttattgggtttggttaccgcagcagagaagaataggtttgcggcttgcaagttgctgaaacgtgctagcgtcaggtgaacgtgggttaatttgggatttggaaagccattagccgtagaaagaaatactttttacctgtgttattatcttgcacgttataaacccatctctctcttaatagcctaaaagaagcaaatgaggtggacccagttgcagtggctcatgtgtcatgtgctgttgctgttgcctttcagcagtcagctcaaacaattttacagctaaaaaagctgaaaaggtaatagtcatgattacatacgctgagggaaacaaaacaaattcacgatgatgatttacatttaagaacaacaatcccgtgccaatataaagcttgctaagacaaaccatgcagaagaactgtaacatcgggttctcctgaaacaatgcatcatttctactttggcccgctttagttcgcacacaaaaattttacaccgcatcacatcgaatgtttgaacacatgtataaaatattaaatataggcttaaaaataactaattgcacagattgcgactaatttacgagacgaatcttttaagcctaattgctccatgatttaacaatgtgttgctacagtaaacatttactaatgatggattaattaggcttaataaattcgtcccgctgcttactggcagattctgtaattagtttttttattagtgcccgaatgccctatacgacaccctatataatatccgatgtggcacgccaaaactttacacccctcgatctaaacaccacctttgttgattgagacagagatgccatggtaaaatgctactcccttcgtttcaggttataagatattttgacttgccgcttcaaatttgatcaagtttatagaaaaaagtaatattttcgacctaagataaatttattataaatatatatttaattattaatttaataaactaatttggtaatgtgaatattattgtatttgtctataacgttagtcaaacttaaagtagtttgactttggtaaaccacaaaactgaacaacaaaacctaaaactggagggagtataccacaaaaaaaacataatggacaacaaaactctcacagtagccattagccaaagaagatgtcacggatgtagacaaattgaacagttgttgattgagccagagatgccatggtaaaatactagcaccatattggacgacaaaactttctcaaagtagtagaaggaaatgtcacgggtataggcaatctcatcatggtaggaaaacagcatctgaggtaagttgctctacatgttgtcatttgccccgatgcgtgcactcttctgctgaatagctccaccagaaagttggtgttcattgttgtgggctaacaatgtcaagaatctgcaaacacagaggaaacaaaaacgtgcaagtgtctggttaattaacttagagttaacaaggaatatcttgtggatagaagagcaaatgcaacggaaagagaaaccttattggtgaactgttgaaaaacttgtccttccatcaatttctctaattcctgaggatgaattaatgagggagtgggcatcataaaataaaggtggtagagagaggaaaaaaataaatgtaagtgagaaaagttatattcgtatcagtattcagcagactatagtaaaaggaattaattcatcgaacgtgcccatttgaagcttctcaactactggtaggaaaatgaagtcatgatggtggaataagaaacagaagtgttgtactataacagtgacaatgttcattactgcaaaccattgtcctcaataggtattggcatattatgtgcatgttatttgagcagccggacagaaattgcaaacatagttaacttgttaaataaacttgcagttatcacaagagtagagaattaccttttctggctctgcagagccatcaatcttaagtagcatttgctgaagcttacaatctttcagagcatctcggatctcattagattccgctggcatggatacaaaaatcaagcaatgagttaattgatgatgtttatttctttttgcgagacaagacgatgagtattactatgattaattaaataaggtagaaatgctagcaggttatgaaatttgtacagggagggatgtggaaccaatatacaaaattgactagcatgaagcccatattctgcttacagtactatccttactaactatttgtcaactcttacgaataaccactctccaaatgccacttacgattgtccttacatttttgccaccggagagaaattttcttaacaatttgcccctttcaccgatgtggcataccagcatggactgaggacgtgaatgtcctttttgcccctgccactccccttcatctcattgagatcatccacagcggtgcacgtatgcttctggcttcctgcttgcggggtcacctcctcattgagaccatccgcggccacaccagccacgctgtctcatcaagcctcgtcaatcatgtgtcagcggcaagaaggttgtgcactgcatctgcatcatcttcttcggcaggccagataaccgcgaggccctcaaactcactgggaggatggcggagcaccccggtgcaggtcgtcatgcggttcattgatggcaaggccggcaagtgaggagcacgttgaggtacaaggagaaggtacatccgcaaggttgaaggttgtcatcgacagccacaaggagaaggtacatccgcaatcaatagcagccaaagaacatccatgcacgcacctaagtgttactgctacctaatggcttgtcactacacagcagtgcagaagatggacgagaaacagcggcggaggtgagctcaaatctgaaaaggaaagggagagaggggggaacacaagggaagggccatgggtaaaatggactttttgtgtctcttgtccacattggctgtcctcactagcatgcttaataggtgaaagtggcaaatgattaagaaaccttctctctggtggcaaatccgtagagaaatgtaagaatggcaaacggagagtagccatttataaaagtggcaaatagttaaattccccattactaaatgtgcatgccaatattttactcctatactgtaggtctgtaggattgggattaggttcagataattatgaaattgaagtcgatattcttgggttgaaatgctggactatactaacatggagacatttgtttcagctaacaaataaagccagaaatcaagtaaaagcaaaggattcctttttaaaaaacacaaatcatggtatgaaatagtcaaacataggcaatacctaaagatcttaatccattcttgtcaacaagccagcttggatcctcaacttcaagagattttgcagagtgcaatgtgtttggatattgtgtgggacaagtcgtgtccgatactacagacaaaaaattgagcttaacataaattttcttggccttcaagattcacaatgaataatattatagcccttataataaattctagagaaactaatttaaattattgattaaaaagcatagcatatggttacttcttcttctttttttgcgaggatagcatatggttacattgtttacaactgaaggtagtcatgatctataaagttttgagttcaatcaattattagtgaaaaccaaatagaagaaatggagagttaacaacagagataagtatggtgcatttttacataaagacggggtttgatccttgtcattaggacaatttgttgcttcttccagtgacctagagttccttgctgaaaacaatagaaggcacaactgtaaattccagtagattattttagaaacatgttagtaggacagaacaattgacaatttaatgaatgactatatgataagataattcaggcccttatatatgggcaagtacatgccctgcaggacttttaggtgtacacagtcaaatgctcatttacagtatattgatgtaattttatgtaggacccctctattttaatgatcatggtttcaactcaatttccatatatagcaggactatatagctgttgcaaacaactgtattgagtcaccaaaagctagagcacttacaaatttcctcctgaagagatgacttgctaacttcttccagaggtattgtcttctggcaaaatttatctgttggcaaaacgatatttagcacaaatactggctatcaagataataaatatattcctctaaaaaagggagatgaagatatttggtggccatttttgtttgcataaaggcaatgcataaatgatagttataatttgtgctgtgtttagtactgttcagcctttccctaatctcaaaccaagtacaatagtaaaattgccaaaatttcaaaacaaaaggtcccccgcagacttggacacttggagtgtgataagcagtttatcacttgctatatttttttaagacgtttggtttattgagctatgtttaaaaatgcggctggcaaagaacgctggccaaagagagaaaaggcagtacagggaagcttgttgatttaaaatacacaactaagaagcaacagagggaacacggcagtttgctacagccccctcgcgctacttgagctactttcagatcgcagcactagagctatatttagaaactaccaaaggatagcactgagtacctttgtgatttttaaagcatgccaccgagcaactgcaagggataatgaaaccgtttgtaaggcccaactgcattacacaatagagaaaaagaagccagagaaattgaacggaccatgctcttaattggtctacaatatgacatgtgctcttttgccacatatgtgtgtataacatgtagccctggccccagttgtcatacaccggactgtggcaaatgagccaatgccattcaactttagggcaaaagagcaattttaccaaacaaatctacaggacacatagaagatgtccaaccgtgattgcatcgctgaacaggtatgttagttcagtagtccatttagtttcagggaatcttgaaaaacagtttgtttagataatcatatttggcaatcctaaggttacatccttgaaacaattgtgcaagagaagtcataaagtatgatatgtaattctcttgcgtattcaagaaaaaataagcaaagtattacagattattgaatgatggacgtttgcctctgaatactaattcaatacagcttagtaccaaaaccaacactgacaccagatatcaggagaaaggtttacatgtcttgttttgctgctgcctttttttttttttactcatgcaaaaccactccagcagcaagctaccgagtcaaacccaaaatatatcaagctaattctgatgtaggctcatattctaaaaagaagctaatgcttccaaccattaatcatcaatctactctattgacctagcaaacccgtactctcttttcaagcagtaagcagtgaagtaatcgatgtgaacacagcaagtaggacattgcactaaaaccgtaacaagtgttcttcaattcaattgttatgctagctagtaggccattactgagcaccatgatcgaagcgatttcccaaattttaaggacagtggtatgcgacgacgctacccatggaagctgtaagcacagaagggtggagatatccggtggctggacttactatggcgtgcggcaagcggagcacttgtacttggacggcgcctccttgcacacgtcgcagctcccaccagccatctccagccacctcccctagcccctagggattcctccaggcgcgacctgcacccccagacccgtctcaggtgtcctgtggctgctgcgggagcggcgaaaggagaggaaagggggaggggacgcgctgaccttttaggtgctttcagctcgtgcggctaggctcgctccacggcgcgcgacgggcgccctcggccggcggcgagcggaagagggcggcggcgccgcggcggcaaaggtaacgggatatgcgagtggaggaatgggtgtggccgggtggctccgttctatgcctgggccagtttagtgggctggtccagcccgcgtggccgcccgcggtggctgttgcggaataagttcactttgggtccctttatttgtcgccctgtccgatttcgtcccttgaccgcaaaactggatacgacccatcccccaacttataaaaaccaggtaaacaaggtctctcggcggttttgatagcggttttggctgacgtgatgcctacgtggctaatttgactcggtctttatttgacgtgacactgaggcacttacgtggcaattcgatccggaaaaataataaagcatgtgggacctacatgtcattttcacacataaagtaataaaaaatagtgggacccgcatgggccccacatgttatactcacccctcatcttcttcctccctctccatctccatctcccctccatctctctcctttcctctctccagcggcctctaggcgccacggctcacggggtgacggggaggtccggcggtggcggccggcgacgtgacagccgccggcggcggcgagctccacctctcggcgcagccgtgcagccgagaggtgagtaggtgatctgtgagcaattagcaattaccagttactgacgaaaggtgagtaggtaaaggcattattagcaaaaactgcatctatcggaacaaagttcattccggtggtcaaaactcaaaaccccagcgagctgaggtgtaagagcgacgtcgccggccgtcggatcgcgggagggggggctacgtgctggcgcaggattagatccatgaatccatccgtgccgcctacgccatcagacagccacgcgcgcgcagggtcagaaacgcgcgcggctgcacggctgcacgagaggtggagctcgttgccgccgccggctgtcgcgtcgccagccgccaccgctggacctccccatgaccccgtgagccgtggcgcctggaggccgctggagagaggagaggagagagaggggagatggtgagggaggaagaagatgagggggtgagtataacatgtgggtcccactattttttattactttatgtgtgaaaatgacatgtgggtcccatggctttattatttttccggatcgaattgccacataaacgccacgtcagtgccacgtcagatgaagaccgagtcaaattagccacgtaagcgccacgtcagccaaaactattatcaaaaccgccgaggaacctcgtttgcctggttttcgtaagtttggggacggttcgtatccagttttgcggtcaagggacgaaaatcggactgggtgacaaatagagggacccaaagtgaacttagtccggctgttgctggatcgtccaggcttgcaaggccctggcccatctatataattctaagagttcctttttttttcgaggaaaataggagatgttttctgatttccaacaggaaatggatgatttatttgaaatttcagcgtttgaaacaatgttttaactatgtattgagttgatgactgcttttgctcttcttgggtgtggaatataggatttcgcactaatctgtgacattttccccgcgtctggaatacgcaattcggtatcactttactgtattcttagtttctttgtgtttatcagtgatcactggtccataatactccctccgttttacaatataaatcattctagcattttccacattcatattgatgttaatgaatctagacacatatatctatctagattcattaacatcaatatgaatataggaaatgttaaaatgatttacactgtgaaacagaggaagtagctcgcaacgaaattggagaaataatgtgaggattattcgaagtaccatcacgaaaatgagccatttcctggttcagttcgtatatttttttcacacgatgaatgattcactcgtgctcaaaccactccaatactaggattacaaccaatccacacacacaccaacaaacaaaacaaagctatgcaacatgccgacgaccatggacaaatcttatatccgataccggaccagcgggtccttgaactgaagccgcccattatacaccctccacgcaaggtcctcgagtaaaaacgagtgaaatctccacccatccccatcatcgccggctccatccacctcgtcgtcgccgccctcttctccggcatccgtgaccgggaccaatggcgagatgacactgtccaaggggagagtgatcagcacggtgactgacaagcggtcagcctcggcgccgtgccctgctccgggtgcagaagaaacggggcgagccatccctctcactttcttcagctttccattgctccacacctagcacgcgtgccataaaaaacaagaggcattaaggcaaattcaagcaagttgttactgctttgatgctgctcaaagagtaaaggaaacaacagacatgacatgatggtcactttgtggtttctcttcaaaagccgagatctttgactcttttttaaggtcctttggtggattccaaaccgagctgtgaggcagtgatgcaccggttgatgcagacatggggcctaaatgggtccaaattgagtggtgacgcacagcctatactttagaatttgatgccttcgcaaaataaaaatggatgctttttagtacatgtctatgcttcttagagacagactctgccactcacgaacaatcaacacatcttttttctgtggtgaacgaccagcaaattcgtagctgtaaaacctgtaattaattttacacgtttgccatttgtttttttaatgcaaattacaaactgaatcaataatatgagtgtctacatgtcaatcatttatgtgttatctgtgcaaaaattaatgctctaatgtccttccgtttgcaaactagtcaaaatgagacatttgcacgcaagtacctgagcaatgttgccgatggtgacaaggagtgcgccgtcgcgcgcgcctacggccgtccactcgccgccgtcgtccatcacccagctcgccggcgccgcctccttcccggacgcttcccactggcaatggatgcccacgacgtacgggtacgccttcgccttcccggcggccggaggcgccgcctcgccagcggcaaccttggagacccacatcaagcacctcgccttcctcctcccttccgcgaacggcgcctccccgaagcccacctcgggacacccggacatcatcgccaccacctgcatgcccacgtcccgcatccgccgcgcgtactccgccgccgcagccgggagcgcgcccatctccccctcgtcgtcgacgtcgaacaccagggcggggtcctcggcgccgtccgcttcctgctgatcctcctccgtgaatccgagcgtgaggaggttcgacgcgcggcgcgcggacgcgtcgacgagggagagctcggcgagcgcggaggacggcagctgggaagggacgccgtgtccctcgaggtggaagtaccccacgtcggcggcggcgtcgagacgaagggtgccgctagagccaagcgaaacgagaggcggcagcgacggcggggccctggagcgagaggagagcggggagcgtagaatcggcgccggagaggataggagcaggcgctggaggatcgtcgagagcgcggcgtccgtgcccccacccgcggcgccggaggacgggagcgcgtggtggtggttcgacggcgtcggcgggggagggcctgggaacacgctccctcctcctcctcctccgttggcgccggacatggatgacgctgcggcggtggaggaggaggcggccatggagacggcggccggagcggtggactcggactcgaccgacgtggaggagaaacaagtttttggtaggaaactgggaatcgtggctggtgggaggcgttggcgccttggcggcgtggcgtgggagaggaggcgatttattcgggtctagttggtctgtcagtgtgggcccatcttacgcgagagtggtgggccaccttaggagattgagccgacctggaccggcgaagcaggggatgggccggaacagggctttattcctgacctcaactactcccacaaatccctcttctcagttctgcttagttagcttgctttttgtgaatttgcaaataaaaatcctccaaattttcagttgtaccttgtttttctctcaaaatgtagcagctcgtactttttacttctacgagacaatttgtattcttttcggtggttcattatctctgcactagcatgaagaaatggaaacggaatagcctcaattagcttctgtgcttgagaatttttcacatttatagcccataaactaggaaaatgttgaaccggataagtgaaggaaaaggaccaatagtccaataccactccacagcgactgacaggtatatctatctcgaccattggattgttgcttcttccacatagcccggcagccggccatgcgtgtcgttcttgtagctttcatactgcgaaacaccttctgcaaaatgaaaaaaatatgtcctaaatacacgagcaacgacgtctgagaaattgtcaagtaattcaagaaagcaaccgtttgccttagcagtttaagagctgaccccagtgattagttaggagtagctttctatcgctgaacacaaaatcaaaacgcttcgtgtctccattggacggagagaccagcacgagacgtgaaaattcgccatccttcagagatcttgccacgtcgtgggacttgtcggatacgcacacgtacgtgcgattaatctggcacgacgatctcttttctcctgtcgtttcaatatattattatacggtcgaatggatcgacagggacaaatggcattgtagacggtgacacaaaatgcagggaaagaacaacatgtttggcgaatcatgcagagccgagctctcttttactagtactagtacatttcaaggacttttgcggctgcgatgcttaaattatgggaagggtgtccattctattatcgtcttttagtgccctgttagaatcttgcatagtcagtatcatgtactagcatttgctattttattgcccgtgtgtatgctgtagtctcggctgttaaagagaactgtttgctttgtcttcatgcacgggcgatatttgagaaatttgtagttgcagtcctttagagttgatatatattggcctttgataaaaagaagtgcagggacaaattcgtttttatgggagaccttcccccggaaacaagcttgtctgcagcgatgtgacgctccagtttcatgcgttttggtgttaggttggacaacatctccatcagtgacagacattatacaagtagaatttctttacattaattcatcattttccagcgatatctttatggttttgtaagccattattacctactagtatcttaaataatcaagaagagaatgatctcttctaccggaggaaaaaagggagaaaaatatatgcctcgcgtgcttagtcgttggatcatggattcagaggtctagattaaaccagcaaccgtgggctactccaagaagaatggttagcatggaaaattgttccctcaactatggtttgagtttcattcacgtcccccaacagctcaactgtaaaccagttatataacatcccctaattactaacacaagtgcaaatcaagtctctcgacgctttagacaacggtttcatcttacgcagcatcatgtgactcgttgaccaaacgttcatctgacgtggctggaaacggtacgtgacttgatgagatgtggttcaggctagggccatgggtaatcaggctggggctcctatctctagcatcgccccttagaccaccaatatggtggtgtggagcgacgaacgaggatattattgctacggttgctatcttgccttgccgccaccctcgagcgtcgactgaatctcttccacccacgctacaatccgtgataagttgctcgaatctctcttccacccagagctatgccaatgtgttcactaactatggccattgcctggctcctctcgatggacgcttgtcacccgttttccactgctacaaaattatcggggatacaatgttctattgatggcaaatttagtcacacagaggaagggtagacgaagaagaagggaggagaaggatggcatggttgccatcgtttggtgacttcttggccagcaatcatccgtctaccgctcgtcacattctccactccaacgccgagctatgacctcaaatcctctttctccactgcccttgagtcccccttctctagtacgaggagaggagagttggacacccgcagcgccagctgtccttgttctcgttcgcaatagatggtgggcaggcaacggttgggacacctaagaggcgagagtgaggagtcggggtgactggccgggtcgagagagaaaagaagatagtagaaagaaagtatgaaatgaaatgtggaccctataatttttttattaactttttgttggttggattgtcacgtcagacgaacattaagttaatgtgccacatatatgtcacgtaggatgagtttgtcgtccacaccgctgagggactcgatttgctctggttttgatatttggggatgctctgattgcacatgcgaacgttaaaggaaactcagaccccggtgtgagggacctacggtggacctttcgctggttagcattgctccataagtaggtccaaaattctggaaaggtgtcctaaaggaaaatgtatactttgactcccatgattcatgtcctccaactacaaaaccgggtatatcgactactccaactccaattatcaaaaccagttttggaggtggttttggctgacatggcgcctatgtggcggtcttgaccgagtttttgtcctacgtggtgcttacgtggcattagaataaaaaaaataaaaaaaatatgtaagacccatatgttattcacacaaaaaaatattgtgggacccgctgtcatgtgggtcccacatgtcatccactctctccttcccttcttcctccccctctctctctccccccggcctttctcttggccggaatggcggcggtggcggtcgagacgacagcggtggcggtggggacgaggatggcagcagccaaggagtgcaacgctgtggcgatggggaggaagaagggaaggagagggaggatgacatgtgggtcctacaatacttttttttgaatgacatatgggtcccacatattttttatttttgtttttattctaatgccacgtaagcgccatgtaggacaaagacttggtcaagaccgccacgtcagccaaaaccaccgagggacattgtttgcaccggttttgatagatggaggagtcgatatacccggttttgtggttgatggacatgaatcatactcgggcaatagttgagggagtcaaagtatacttttttctgtcctaaaagaccatttgcagcaactagcaaggcccaaacgattacatgttgagctagcaggccaacttctactgtaccatatggagtaggaagagtatgaatgtgggccatcaggcccagaaagaagagattttttactgtccagcagaatttttggtaccgcgcggtactgcaatcgtaaccgtccattcagccagatcaaacgacccacaatcgtcggtaccgcgaggtacgggaatccggtgcggggtacctccccctttgttcgcgtgtatggaactggtggaagggcagaattggattttcgcgtggttagtcaattttcgtagagacggtacaagtccccgacccgataatctgtctcttcccgatccccttccgtcgtccctggcggcggcgcagccaatctcgccggacttcgcttcctccctcactgcaaccagccgtcgccaacttgcccattcccaacttgcccttcctgtagccagtctaggtccggccgccgccgacttctgggagtcgatctatccctggatgacgacgacctcaatgcgcaaacaagaagaggtgaccatggcgacaagctcagcgtggcgaatatggcctcgacagctcatccgccgacaccatcgcaagcctttgttcgtggaatcgccatcgctgtggtatgcattggatcgcgagcactagcaaccctggaaggaggggacagaaagaagaaaaaaacgaagctagatattgagatgtctgaaaggcgtttggccatggatcgcacaagcaagaagaaattgggcaagcaaagaaaagagatcgaagaatttcagaagtttgtttatgggatcactagttgtaatagtgtcccttttattcaagatagttgacaatttgttcaatgaccgccgatgttgattttgtttaagatgaaacagtaagcttaaggtctacaacgaaagaacagtttacacatcagaccaagaaactacaaactttcagaaaatctacttcttttttactactattacattcatactttcagcaaaatcaagtaggttcattacatatatcaaaagacaaggaactaggtccagaacttggcacacaacataaatcaaactcagcctctcccatcaacatagcatattcttccaatgaatatagcagcaaagcaatgtttcgtatttctttcctgctggacattgctttgctggtcgtcgtcatccagggatagatcgactcccagaagtcggcggcggccggacctggaccggctacaagaagggcaagttgggaatgggcaggttggtgacggttggttgcagtgagggaggaagtgaagtccggcgagattggctacgccgccgccagggacgacggaaggggatcgggaagagacagattatcaggtcggggacttgtaccgtctctatgaaaattgactaaccacgcgaaaatccaattctgcccttccactagttccatacacgcgaacaaagggggaggtaccccgcaccaaaaattcaaaaattctactggacagtaaaaaacctccagaaagaaatttctccaccaaggccgtcagggcccataccagcaatacaattctccgatcagtggaaaacatgagtataaaaatacaaaattcggccgaatcggccagcatgcttcgtttgccatgctattaattagtcaatccttaactcagttttaaactcagcccaggtgagttcgaattaccctatcataatttataattttaccagaaaaaatacccgtgagttacaacgggtaaacgctattttaatcatattattgttggtcggtttaactaaagtaaaattcactgcgggaatttgcatgatcgaactgtaattagaagtccaatcatctcaaattagtatgcaagtttttaaaagagatttcttatatgtctccttctccttctccttctgtatttataaaagcgaatgaactcaaaaaccgattcaaacacggatttgtatttccaaatgcaaataatgaacttaaaaactaactcaaatatggatgacgtaccaaagtaacagcaaaaacatattcaatttttataatagcagagatatgccctcgttttccatagtacgattcctaaattggtaaaatgtatgtttttttaccaaaattttctataagaaattatattaaaaattcatatcaatccatttaaaaaaattttaggtaacgtttaattaattatgtgtttaataacttgaagttagcatagctcaactgattagattacatttggttaaaccagttcacccggttcaaattctagatttgaaacgagtgttcgtatttacggttaattattcttttaagggtatgttatgcctgtgtgttcatagtggtacagaaaatgcactgtggctaacccacttctggttaagctaaacacacctgctgaaccatcgagcaatcgtgggcggcacgcacggctgttactctgcacaagacaaaaccagggaaaaaaaatctctccgatccggatactagctgtttccctaagatgcgaagcggttgataagttgattcattccattttccaagcatgactacgacggaagagcagatattcacgtgtgaccaaacctacacactaaaaagaaaactaccaagccacatcacacttaagaaatgtttgcacatttcctcacaagagaaggctccagctcaacggaaaaaaaaagcatgcctccccccaaatcccaatcagtaaagggtttgcttcagcaaaagaacaaaaggaattatttcaacaatactatatacaaacgaacaatcctaatgaatgatagattacattatcgcaccatgttagagacgttttgctggcggcgatatgatgcacactacctagaacataatacgtctctaaacaaaacgggaacatgccaaggtccaaagaaccacacataccttcagattacttatagaagtaaaatcgaatccatgtaatgaaatcatcaagaaaggcactgctacagtgctatttaacctgaattatattcatcctctgccaaagcagcgactgatcgatgggtggcacgtccaatccctgatcctgtcaacacccaactcaaacgcgggcgtccttctccttccctcccggtgaagctgacgcagtgacactccaggttgcgcgcgcgcatgcgggcggctgggaagggaagccccgtctaatcaggaccagtgtcgtacgtggtccttccagcccgcatgacggagaggccatgtcgtttacgaaccaccatcggatgggtacaaacggaaccctcctcgtcccggctgcgccctgcccgtcccttggttagccggcacttgttgaagatctcatttgcgagctcatccagccatcctgatgaacttcacgcagaagaaacttggctcaacagcccgaagcgtatgttacactcgatcaactaagaatagagagatgtttctctgtaatcctgctgctaaatttttttgttagatccccacccatagagtactaattatagtattagagcagcagcattgcagtttgtacttgctaagttgctggtacaacactacaacttgctggctgtcctggtcataggtcaaaaaccgtactttgctcacagtgtccaaaactgcacctgttcacaattgatcagcttctctgaaccgaggaatggaagttgaaattaaagcggtgtctctccaatcatctcccggcggggccatggatgaaacagtaaaccagcgaaagaaaagcatcggtctatcagatcggaataggaaaaggaaattcagattcctcacattaccacttgcacttgggctaccagactcggacggccaatggcgttttcttttctgctcccggtcgctctctaatttgcccccaaattaaccaacgccggttgcgtcccaggacagcacaagtagagccaatcggtcaacaaatcatcttacaagacaaggaaaatgcaatagtaggagtccattagcaaagtgccggtgccatggacatcgctgtaatggcgaacacgattttcggacgatgcaaattatcttctggccggtaggcagagcaaagaaaaacagctataaaggggccaaaaaccaaggttcctggagatcacaggactacaggaaccgatacaaaaacagtgttttccttcaggaaagctacaagaatagtgctagtgagagcggcgacagaattgtcattactacttcgtattaggtggttggcaatctggtagaccattagaattgacagtagtttagctccaaattattgcgtcaaagttctcgacgggttgccgtaggtccgaggagaggtgcactctgcttgtcatttcaaagttacgaaacagcaaattcgtcaggttttgagtgccttcaaatagcaactcgtcgatcagaaacggctggacaagaagtcatattcagctggctagcacggccttgctggtggccttatttcctatttgatcgatttcgtgagttaataattcaagattcagtacgttccaggacgaaaaataccggagatgacgaagaaaagtaaagtacgtgacacccgagaccaccggaggtgtatccttttctctctggcattttgggctattggcgtaactggaattgaagtgtcaccccacaagtacagcgacgccgttgagccgaaaaggatattgcaaccgaactgcgagatgtataattgatccagattatagaacaattgatcttgtttgactgaatcaacatacattagtattactttttagttactggctagctcggtcagcctggtcaatggactgcagagctcttaggcctggtttaggccctgtttagtttcaaagttttctttttctaaatttccaactttccatcacatcaaaccttttatacacacacaacttttctatcacatcgtaacaatttcaaccaaacttccaaacttcctaggctgtgtgtttagttcagcgcaaagtttgggttttggttgaaattggagatgatatgactgaaaagttgtgtgtgtatgacgggttgatgtgatggaaaaaaactgaagtttggatccaaactttggatctaaacacagccctaactttttcttcaaactttcaactttttcatcacatcaaaactttcctacacacataaatttctaacttttttcttcaaacttccaattttagtcaaacttttaattttggcgtggaactaaacacaccttgatttttttgactttggcgtgaaaacgtaaccttcttctgtagtcataacgtataatcgagcgatgacaatgtggagatggtatacatttgcagaagcaaactccgtatcttaggctaaggaacatatacatgtttactgaagaaacttggtcaaatgggaataactaatgcagtggaatgcaacagagtaagagacagcccaggaaatcagatttagttgctacaagtagcagtaacaaataactcgcttaacaacagatggcccatggtcctgtcgatgcatgagaggagaacaggagaagcgacagagcgacaccaacatagcggaatcaccaacatttctggcattctattgtcgctttgtacgcccggacaatgcttaccctgaaagtttcttgaccgaaaagctagccaggtaaccctttcataaaaatataagaaaatttcgttttcaaaagaagaagaaaggttgaatggtgatctaggccttgactccactgtcaccaggatcatattcatttatttctgaaaccaacccaaatcatattcaatgctataatatatagttcctccgttttaaatacacgatgccatcggcttttagacataccgtttgaccattaattttattaaaaaagggagaatagctactttagtctctaaagtttctatgtatgatcaatttagtccctaaccttttaaatggtctaaaaaaatccttaacctttgtcataaggtctagaatagtccttaggtccaccaaaatcatcatatggatatgccatgtcatcattcatataaaatatatgatgaattgtctaatttactcttatgtatatcatagaaaaataaatataagggtgaattagacataaccataggaaaaaaatacttatcttttcccccttttgaggtatatttttgctcttacatataccatatatttttttaaccttttctttttgtttttttattttcatatgcgtaaggataaattggacaaatcatatagattttgcataggaaggtgacatggcatatccatgtggcgattttggtgggaccaaggactatattagcctacatgacaaatttaaaggacttatttggagaatatgaaagattaagaactaaaatgacccaggagcgaaactttagggaccatattagctattatcccattaaaaaatattgaaatttgcaaaaaaacataagtcatgcttataattaatataattaataataaaacgaatcaaaacaaaacatacaatattttttaataaagcgaatagtcacacttcatgtaaaaatttgacaacattatatatatttacaaacagtgtttcttcaggtctagaagtctcaaaccggcagttggctcgacgtgtggtaccaatagtcacaaagctgcaagaactccacgtctcgcatcattctaccaaaaataaacccaaaggaggaatcaaggcctcaagggccaactgcttccctcgcaaaagaaaaaaaagggggccaactgcctcatgtgaaaacgtcaccatgtaatcgtgtaatgtgtatgcatgtttgttaattctctgctccctcccagccaatctgtacccataagccaccacgttgaccataatgatttagtaccatatacgataatacgagtagataaaccgctatatggggtcgcgcggagcaaatctgctcgtcgccgaaatcaagtatagtaagcataattaagtttcctaaccagcccaaaattttactaaatccgttctggagagaacacctaatcctcaccaaagcttaacagtattgtgccgcagatatacacagtacttaataatggctcccatgagtggcgtgctgtaccacgtttctgcatgcctcgtattggccaagtctgcgaggctttgaattggtaaggaataaaaccctccctgtttccgatccacccgtccaattaaatcatgcttagtggccgattcaacgcctgatcacggaggagaagggagggggaagcatcacgcgaaattttaagtgtgagatggcttcccctcaccaaatccccagcctccctctatagctttgctatgctgactacttcctcgccatctccataaagcttagcttgcccctctcgctcgcgtctctgtctctcacgcacgcgcaccgtgcagagcgaagaggagagggggctagctccgggtgccgtcgccatggccaaccggcgcaagttctcgcaggcggggggcggcggcggcggcggggtgttcgacccgttcggcacgaaacaggccgtgtcgtcgctgcggaagggcgggcggctgccggtgtacgtggctggcgtcttcttcgtcatcttcgtcatcatcatgtacggcgaggacatccggtcgctcacgctggacccgatcgcgcgcgcggggacaacgccggcgcggatcgtggagccggtagtgacggaggagcgccacgtcgcccgggtcaaccctcctcggcgcgaggtctcgtccgcggagaaggccgccgcgttgccgctcgacgtcgacgagaggccgaagctggcgacgccgacgccgacggaggcggcgaaggaggtcccgaaggtcgagaagatcaggaagccgaagaaacccaagacgacgaagaagaagccgaggaagccgcggccggcgaagaagacggtggcggcggcagccgggggcctgctcggcgtgccggagacgtgcgacctgtccaagggcgagtgggtgttcgacaacaccagctaccctctgtaccgggaggagcagtgcgagttcctcacgtcgcaggtgacgtgcatgaggaacggccgccgcgacgacacctaccagaagtggcggtggcagcccaaagactgctccatgcccaggtacgcaaccacgacgagccaccaatcacaatctgtaatttgcaccgggcgggaaagcatgcgccgtttcttctgaaatggaaacgctccagccagctggacacgcaagtataaacggcaagttttgaatttgtacgaattgattcaggttcgacgcgaagctgttcatggagaggctccgagggaagcggttcatgttcgtgggggactcgctgaaccggaaccagtgggagtccatggtgtgcctggtgcagtcggcgatgtcgccggggaagaaatacgtcacctgggaggaccagcgggtcgtcttccacgccgtggtgcgtactccgcccgtctccatccatccatccatcccgtctttaagattcgtaccgagctgctcgcatgatgaacgtgcatacatacccatccccatctgtctagtctagccaagccagccaacggcgggccgggtccacgcgcgcgcgcacggctgctgcgactagaccagggagcagttggtgtgtggtggtggcggcggctagctagaaccggtgaaccaacttgtgctcgatcagccgccgggtcggtttctgatagtgtgttgtcgtggcctgttgtgttctgaattgtcgggacgcgtgtgtacgtgcgtgcaggagtacaacgcgacggtggagttctactgggcgccgttcctggtggagtccaactccgacgaccccaagatccacagcatccagcaccggatcatcaaggcggacgcgatcgcggcgcacgcacagaactggcgcggcgtcgactacctcgtcttcaacacctacatctggtggatgaacaccctcaacatgaagatcatgtacgctaaatttacgttgcacgatatatcgatcgatcacaacgccgtgccgtgcaaccaacggcgatcgatcgtgggatgacagtgactgataggggtgatcttgcaggagaccgggcgggcagagctgggaggagcatgacgaggtcgtgaggatcgaggcgtatcggaaggtgctgacgacgtgggcgagctgggtgaacgacaacatcgacccggcgcgcacgtccgtcttcttcatgagcatctcccctcttcacatcaggtacgtaaaccagcctacctaccttgttacaattcgcattttttgtattctaccgtacgatcgatctcaagtatttggagtatagctggcacgtacgaacgcacgattgagcaatcaattaagctagtgtgtcagtatatctcaagtctcgacggtagtacggtagagtgggaaacgccaaaatcttggaacttttgcatgcaaaaacccaaagtaaaggtacgcacgcttgctgttggcgtcgcactgccaaagaaaaagaacgagacggcatgcaccgcatatggtgcgtgcgtgtgcgtcctgcagagaattttacacggattggtggtggagtgggcgccccgtctcggccggctacgcgcgaccgagtcggttcccgtgggcgaaacgaacagtacgaatcgaagcgggcccaggccaatagaaagagacgagtcacccggccgcctcgagccagattgtagttgtgcgcgcgcgtggaaatgtcagagaccctacatatgtgtcttgacttgtggtggtaattataaagattaaaccgtgcaaacgattcgtgttaattagtgtcaggcgactagcacaccgtgagcaccggacgcaacacatggattattcgtcattggcgttggccatgagaccgtcccttaattacttcaacgtggccgcggtcctgctataacatgctaccgcgacaactgtagcaaaccaactcccattaatttacttatagggtttgacatttcagttagtggcgtatcatctgtagactaaagtagagagagtgagtatctaacacgctcacacgggatgccttgccatgccggccagcaaatgactcctgccagtacaccatagcacggctaaccgacacacagctccgttgctgaaaagcttaaaattatctgcaaaccccaatggtgaccacacttgagcagtttgcacaaccacaccactgttgaaaactacgcttttatatgtatcacttggagcggcatcttcttagctaagctgtggcttctttccagttctcacttagcacgcactttctgcgcccaagaatgtgcgtcacataactgacccggtctgcaaatgtccaatcaaatgaggttactatcgggcgcccctattattgtttctgcttgttgtggccatctcgcatttcccaaaattttaatactcctactcccctactgcgccatgggtatatatgcatagttgtgtgtacctgttcgctcacatgggtaggagaattatttgcacatgagtccgagatggaagcttctccgcacgatctttttttcccatttggccgccgtttgcgagccgtggatgagtgaatcccacgatgacgacgacgatcccagacctgcaggacgggcaccgtagttcgtgatgacatattgaaaaatactagtatcatcgttgtgagggctcatcatcttgtgaccggaattctaggatctcggagtacagaacgcattgaaccacggagcaagtagataaattatctaatctgacacatatataggggttgaagattagtagaggggaattcaaatctggttggctgaacctagctactacacgtcgcttgtggttgacgatttgcttttcttcttgtgcaattcagcttgagagttcctcaaccccgtgttctactggtggagaattcaaacttacaagactgaacaaaaagaaatggtggtttgcaattgatatgtgtgatgaaacataaataaggcctggtagatcgatgcccatacgtgtattattgcgtactttacgatgaagggacagatgctgctttgttagtatcggatcgaacagaaggttgtgctggttactgttgcggatcgatgtcaattaggcttgataaggattggcatggcccgcggatgacgccttacgaaagctctccctctataaaaacttttaggacagtcccaacccataacactagatatggtttcaactctacatcatcaagaaactagtactagacactactcttctaatgcaaacaccactattccgtacttcaatttaatgctacttatctcacatgatgtcttggatgttgtgtaaaaatcatgtctcatacaagatatggtttccttctctttcctcatttattcacttgccacattattttttgttctacgtggcaacttatttaattatatggacaccatactagttattgggttgaaaatccctaatattaggaacagtcttatcctgaaactgataggtgcttagggtcccgtgaagcaaaccactttgatttgtctgcgaattttgaagtcaatgattcccttttgtatactacctccgtcccacaataagtacaatcatgagttttcgcgcccaactttaatcgcccgtcttatttaaaattttttataattagcatttttgttgttataagatgataaaacatgaatagtactttactcgtgacttatatctttagtttttttaaaaaaaaatttaaataaaacgaatggtcaaagttgggcgcggaaaaccatgactgcatttattttgggacggatggtgtaggaaagaggatgcgagaatatggttaactagtaaccggacaaaattgccgaggttcatgtcacatctggtaaacaaacaaatcaccggggttttatcgtcagttaattactagtagtattactgctttccttcttggattaggaagaaggccgaaaaaacatttgccgtgtccagctgtgtgatctcgaaagttgttgactattccgagtagggattgcgtctacaactgaggaacctacgcttttggcttctttgggttcggaggcatgtcacgtcaacagatacagttaaaagtttggtcaaccaaagcacaattactccgtactaccgatatcatgtactccctctgtcccataatataagtaattttgagtttttgcttacaacgtttgaccactcgtcttatttaaaattttttaaaattattatttattttatttgtgacttattttaatatctacagtactttaagtacaacttttcgttttttatatttgcaaaaaaaatttgaataagacgagttgtcaaatttatcgtgggacggagtgaggactacgatccccatgcttatgctactatgcataggtctgctaaataatttgcccatgatttcaccgttatcaaactgacaaaacttacatcctggtcgttaattcggtttctgaaaaatctgttttcgtggctctgcagcccggaggtgtgggggaacccgggcgggatccggtgcgccaaggagacgatgccgctgctcaactggcacgggccgatctggctgggcacggactgggacatgttccacgcggcggccaacgtgtcccgcacggcggcgacgcgggtgcccatcaccttcgtcgacgtgaccaccatgtcggagcggcgcaaggacgggcacacctccgtgcacaccatccggcagggcaaggtgctgacgccggagcagcaggccgaccctggcacctacgccgactgcatccactggtgcctccccggcgtccctgacatctggaacctcatcctctacaccaggataatgtccaggccgcagctggtatagcaaattccaagaatttacggagaccggattactcataggcagagctggttggttatacacaatcatcgtactgaaaagagatttttcttcttcttttcttcacattcttttctggccgtttcacctgctgtcagaagatgtctttcatttgttctttttcttcaggggttaggttaagtgggaagagatcgatacagtatatggttatatatatggctaatgggatggccatgcttgcgtacgttacgtgcctgcgtgcacagatgcgctgtaaggttcctgaccaaactgtacattggggaagaaaaggattaaagcgaaagagatgaacagatatggtttacagagaaacggacggcttcatgcgtccagctgcagatcgagtagtggtggcctcgtggggatacctactgcctacccatgagtccatgacagaaaactctgctcgatctgttcttttctccgggtattttttttccctacttacacacgggaaacagatcgaaaaggcactttcagttgatcatttcgatgtaaagcctgaaaatcatctacctgaaagttgagtgacaaaaagaagcaccacctgtcaacagttgaggagggggactacagctccactacgagccgtccatgcagctgaggcatgcaagcctgctgcttcttagtttcctgcatttttctgtatgcgtttcgttgcggtagcaaagctcgcgtatcctctttgtcgtggcaagatgctgctgctgcgacaggtaggacactggacacgccacacgtcgacgaggccgttccatgtatgcgaggagcaaagttgctgggagataaagcacggggcgtgctttgtcttctctgtagaaataaagggactgtctatatccgttggcagaaaattttacctcttatcttttaaattttaggccacttttatcttttaaattttgtaccatcggatatgctttaagatttgtgcagagacattaaccctagctctcctcccgttcccctcgcatcgctcatttcgccgccaccatcacgcatttctccgctatgcctgatcccctgccgccaccgccccatcgtgccgccgactgcctccccaagccgtcaacgacgagatgccccgccaccaacatcagcccaccgccctcttccaacaccacagctccagcgtcgctgccagcgcctcaccgcccgcccgatccaccgcccaccgtcgggctgtcgtctcccccggccatctctatagagccggcgaactcctccccttcctcctccccctcccaccccaccccgggacactaacctgtagggtcctctaccggagtctaaagtgtcgccagcgtcagagaagaagaggaggtcgccggagttggaggagaaggccaggagcatgaatattgaagctaatccagtgtcccaaaatctgcaagatttggatatgtaatttctgtcgaaagaaggttagcaattccgagaaataaaagttgttacgtgtaacgaacctcgccgtaccacctagtgtggagttaaaatgaaatgaaggaagatattatatgtttaatttactttattttaaattgattttatagtttgtattaagaggatgcgcacataataaaaaaaagataagttatagctaaaatattttaatgcccgggtttctgggcatctagatctcgtatactcccgcccccgcatgccactctgctagtacgtgcacgaggaagaaaccgatcgagctgatgaggtcgcgtcgtactaccagctcagcagatcagcctcatttattgtgtaagatcaggcgcgatatggtgctcggcgatcagcaaggttggagtagctatggcctatgagcacaggtcactcgacgatgcgtgaatgcgtgatgcgtcctgtgcaccaaactgaacagatatatagtcagattaacgaatttaacgatttggccggcccttttccatttccagtcctatgttcatatagctgtggagtccttgtgcaacgaatgatatcagatgcgacaagtgtaggagcgtgtgtctatgcagtcgaatgtccagaaaattgtccattttgccaacatgcaggtttcagaattgggaccattaaatggaccattagttctactaggcccggcccatgcaggtttaagaattgcaacagtggggaagccacagcttcagtcatcagtcttataaaaagaacaagggattactgaagactcaaggccccagagttacataccattcaggcattcaccgactggcacatttaactgctagtgagagagtgtaaggcataatcatgttcctaaaatacacaacaaactatactactctactagtagtatatttctgtgaggaaaatacactaccattacttaaacttgatcgattttcgtttcccaacgattttaagtactacatttgctttgcatggacctaaggaaagccataggaagcatgggccggcctgatccatactaattcttctaggcccggcccactatttcttccccggggcccgagctcgtttataacctagagaacgccccctgaagctgctcgccgccgccggccgccttataaatctatcctcctcaaagatccctatctcttcaggttcaggctccaagcaagcaagtactccttcatcttactcctagatttcatccatcctttgcgttgatccttctccaagatagattcaatagtagagttcccgtctcagtctagccgtattgttttgttttcgctgtaaattttcgttcgatttgtcgtgtactgcttgtggcggcaactttatcaagaagggccatgaattaacttttggttaatcatggactaattaggctaaaaaaattcgtctcacgattttcatgcaaactgttaattatttttttatctatatttaatgttcattcgtctcacgatttccatacaaattgttaattactttttttctatattatgttctatgtatatgtctaaagattcgatgtgacgtttttttagaactcgcgaaaagaaaatttttgggtcacatcggatgtttgaccggatgttggaagggtttttcggacacgaatgaaaaaaataatttcataactcgcttggaaaccacgagacgaatcttctgagcctaattaatctgacattagcacttgtgggttacggtagcatttatggctaatcatggactaactaggctcaaaagattcatctcgcgattttcccctaactgtgcaattagttttttcatttatctatatttaatattttatgcatgtgttcagagatttgatatgatgtttttgggaaaaattttggggactaaacgaagccagttggaattttggggactaaacgaagccagttggggtagttggggtgcagacaggtgtttcgtgtgtccacgtctcgaaacaatcatgcagaaacatcgttcgctgggttgcagcacaagctcgcacagcaatcgtatccttatgtattgcgtccgttcgaccgttccgtttcgcgaagaaagtacctattaacatcatgagaaactgaacgctaaagcgccctttgagggcaagttcaacgctctattgcaatgacatcagtgcatcactttcctcttggtgacagtgaattcaaaacagaaactgcaagtggcatccgttgctgtgagctaagttaacgaaaccatgtaggagtagtaataaactaactgatgcacatattaactatactattaatgaacttactaactgatgtacagattaactaagaaattaatcagtttcccaccgcctgaacctccggaccagcagcccaggcaccggcgggtgcaatgcaatggaatgtgcacgtacgggcgcacggcgcagtttacatgcgacgaccgagcgagccctgtgcgtgcatatgatcagacagcatcgctcccggcgacgtccggtttggtggtggccgcggccgggagaagcgagctcctgcacagagggcagctcggccgcgagcggagccacgcgtccacgcactccgggtggaacccgtgcccgcacagcggcagcgccttcaccttctcgccctcttcgaactccccgaggcatatcgagcactgcgcggcgccgccgtcgtcgccatcacctgcagccgacgccacggcccggtacagcgccacgggcatgctcgctatcgtcgcgtcgtcgaggccggtcaccgatgaggctgaacctggcgcggtcgccgcagcgtgcgacgaggagaagccggagctggtggtggcgggcatcggcgtcgtgtcgcggccgtagcggtggcagtggcacgcccagcggaggtagagggagacggcgacgaagcagacgaggacgaagaggagcgccacgaggagcggcaccgcgcggccgcgcaccgcgaagttgccgtcgtcgacgtcgccgtagcgccaccggagccccaacgcctgggacgacgcgtcctgcgctgccgccatgctgtgcaacgtactcctacgcggctgagccaaagtccaaacgcagcagccgcacgcacacgtcacgtattcacgtagtgtcggtttgtgtcgttcgtcgcgcctcggcggaacaaaatttaaggcgcgcgcgcgtgcggttcgctgcacgctgcgacgctgcgttacgtggctaacgcgggctcggcgatccctgtccccagccggtgctcaaaatgcgcggtgtgccggtgagtgtgtgatatggtggttcctagcttgtttcccttttacgtttgacgaaggctagtcgttcatgggccaagaaatgaggcagcgactgttggctcgacgctgttcatgtagagtgggacacgacagttaccacagagattcccaggaatgtttcacgtaccgattggttgttctcaatatgcagatttgtggaaaaacagaggcctcctgcggttactttgaatttctggaagcatcttaatcggtgttattattcttcgctgagttttgtgtggctgtcgttggttcgtgctgacatgcatggtactgcttgctgagctactgtcacatgtcgggattatgctagcagctgaaagaaccatctaggcagagtagtagtcctatttgattggtttgtgcgggtcagtttcatcgttatgacgggtttgtctagatacacaaatgaccaattcagattgtagccaaaataaatcttatcaagttttaataatgctaaaattttagcaagatgacaatattactaaaattttggtagtatttcttatgtgttaaccaaatttagcaaactaaacgtagatatttttttaacaatataaaaaaaaaggtatggttgaaaatggcatcaaagtgaagaggtccaaaatttggtgatatattcacttctccagttgtccgtgtagaccatattggactcttgaaagtttgcacaggagccacgtcttcacagactccactagctagttctgtgaacatacgtgcaccactgcatgaagtgaactcgttcccattttctcccacagtcacaggagcaccacgatcggcatggcactgacctaataacaacaccctaacccccatgggccaggcccaatctgaggcgatgggcattgcaaatagagccgaaatagatgtaagtggatatacccgtaaaccaatttatagatcaaattagtaggtaaccgtgagttaatttataggttatccaataattttatttataaatagattcacgggttgacctatttacatcctaagctgcatcgatccctccaatgccccaccatcacgcttctaccagttgggtaaaaaaaaaacacaacaggctgaacagcttacgtgttgggcctagtttagggtcaatatacagaatccattatatgccattgagtttgtctcatttctatgattagctattgactttgtcacgttctacaatataccatcgacttttgcttaacttctacgatttaccatcaccatccggtcagtctccgttagtaatatactacattttttttcaaataaccaaaataactttaggacacaaatatccaaaattagaataaaaactctaaaatcgttatttttgcatacctttttagaggcatacgggtgatcgacccaattgcatggaaaaaatgaccacatgcaaaaatccttttttatagtgccacctaggctcgcacaataaaatttaaatagtttttatgacttgtgaacaaaatttttatagcaaacgtttcacaaaataagatttgtttgggcttttttttaagataaagaaaactttcagactccaaggggttcgtttggaacaaataaattaatttagatgaaattttaaagataggatttctatagaaataattcctatgtggtcatttgaaatgaaactaggaatggctctcctaaacccctttaaaattctttaggattacctcaaaccatagaaattttggtggatttttgacataaattcgaaccttctggaaaaaaaattcctttgtgtctatctcttttctgattcctatatttatcctgtgtttcatccaaaaggtctttttcgcaggtttttttgtgtgtttttctattataggatttaagatgggctcaaaggcacttcaatcctactagtgttttttttctaccaccccgtgttttaaaaatcctgcgttttaaagtagttctaagggcccctttgatttgtaagaaaagtataagaaatttggaagattttaatcctatgggaaaaaaattcctatggaaaccatatcgtatcatatcatatactttgaaattcctatggaataaataatcctatagagattttggaggaaagttagtaagaggttcaatttcttggaaaaattcttttgagcctatctctctaatctgattcttacgtttttccagcggtccaatcaaatggtcattcctgtgttttttttatgtatttttcaattttctgttttacgcttgtattcctatcataatgctgtgtttttcctatttttttttattttttcattgctgggatttaaaggtgcctaaaatatttcaaatccttgcatgagtgtgatgtgacatgccgagggatgtgtgtgcgtgtgcaggtataatataaaagaaaatgtcaacattgtagccggacccgcggagacagcgtcgagccactcgagcggcatggaagggcaaaccgtacgctggagcaaggaggctatctagacaagtctggcagctatagcaagctagccggtcctgatgaatcgaggaataccagcctactgcctttgcctagaaataattttaactccctaaaacatcaaatcggccgctgcgtgacatagcatcagtcctgccaaaatctttgcctctgatcacacgggtggacgtcgccatcctcgttaatgaagccctttattcccgcacagcccaatccctgcagcctgcaggcatgatgcaaggcgtaccagcggacagcagatacacagggggatgcaaaggccggattcagctagcgctcgtattttaactcgggccgagtttagaacctgtttgattggtgaaataaaaatttttagtagtcacatcgaatgtttgaccggatgttggaaggggttttcagaaatgattgaaaaaactaatttcataactcgcctggaaaccgtgagacgaatcttttgagcctaattaaaccatcattagcacatgtgggttactgtagcacttatgactaatcatggtctaattaggctcaaaagattcgtctcgcgatttacatgcaaactgtgtaattagtttttcattttatctatatttaatgctacgtatatatgtctaaagattcgatgtgatttttttttggaaaaagtttttagggaactaaataagaccttagttccaaattttttcttcaaacttccaacttttccatcacatcaaaactttcctacacacataaacttccaacttttccgtcacatcgttccaattttaaccaaatttctaattttgacgtgaactaagcacacccaaaatttcggtatgcttgggtgtgcttagttcacgccaaaattggaagtttggttgaaattgcaacaatgtgacggaaaagttgaaagtttatgtgtgtaggaaagtttttatgtgatcgaaaagttgaaagtttgaaaaaaattaattattgtagctacagagttatatacaatcgtagtttggtactcgtagtacgatattggaaggttttctcgataggtcgatcagcaagaaattatacctttacagtcagtactatctgcgtctggttcgtggtcgtccgcaatgacaccgtcgtcggcttgccgcgctaggacgagcgcaggtgtgttgggagtctaatttacaaaattccaatgatttagaatgatcacttctatttaatgtcaaatttattaatctactgtcatgaggatgaagtcattgtaatcggtcattttaatttacttgctgccgttcttccttttctcttcttcctaatctttcggttgccttcttctcttggttcttgctgacgtaggagaagtagagtgcgtcaacatctcttttgataattttttgatcacctcacgattagcgtcggtcgattggacgacttagcttttagggttttaacattgagagagtttgagagtccccgcgaattaaatttcaaaatataccgtttatttaatttttttaaggaatatttgggatgaaaattttttttttgcgaaaatataccgtcgatctcgcacaatcattgcgcgaaaataacggatgcgtgacgtcgcaggcggtatcgcgtgggctatgtgcgagaccgcgcggtcttacgaaatgaaagagcgaggtcttgctgaaacagtctgcgacagtattaaccggctccatttaattagtgatcaagtacataattaactattagctaataataattagtgattaattatcgtgcacggtgcggtctcgtactttcaatgcgcaataccgtctgcaatgtcacatccacgtcattttcgcgcaacggttgtgcgagatcgtgcgagatcgacgttatattatcgcaaaaaagtttacattcgaaatattttgaaaaaaaaaatagatgaacaatatatttttcaaatttaattcgcttccctgctacctctcctccgctttatttattttgtagggatactggtagaactcaggtgattaatcttctgttacctaggttcgattctgttttacactaatcatacaaaataaaactttatcttatatttttttcttaatatataggaaaggcaacgatggttctatcttttttttaattatttttatcggcagtagtgaacccataaatcaaggcaccggcgtgacaagcacacgatcaagcagcaacgtcgtcgtctcgcggccgcccgaccggccggcgccgtggcctggtgcgcgcgacgcgattgcattgcatgtgcacaaccgtacatgtgcggcaccggcccgtgcagcacgaatgcaggatgcaccactgcacacggctaagctaagctgcgggggcaggtagggggccagattttccatgtcgctactccgtgccagtgccactgcagcgtcgtcagcgactctcaggcgcgcgcggccacatcatatcatatcatatcatatcacgtctcgtctcgctctcggtgcaggcggtcctaggcgcgcgcgcgcgcgctcgtacgtacacaggccggaatgtcacatggcaatctcttcacggcgacgcgacgcggtcggtccgtacgacgacgttgcgcgcgtccgggttctcgctggcgagctgggcctgacagaactgactgttcaatgtgttcatagactattctttgtcacggaagagagccgtgcctccgagacgaccatagcaagttcggtgtggagtaggagtactagaactaaaagatcatcaggtgttccaaattggaaattgagattttcccaaaacgaaattaagatgaggtccggagtataataacgcatggcaaagcccctatagctagactcactaaacatgctcattgccgtcagctttgtgacatcttaaacacacaatcacccacccggccaggagtttttcccatttaatggagaagcttgaagcaatgaaattgttggcgtcaaaagtctaaaatacatgcagtcgtcaaagaacctggattaatttgcaatgagcagatttttttttaaaaaatactaaccggttttcaggcaaatcgactaagaaactactactactctagacatgaaggaaaaaaataaaaaagataggtatttctagtcgcccctaacccgaaatatacataggggcacctaggatcagtggcctggtattaaatatattttagaatagattttgagtgcctccaaatttgttaaagttcagttattttattcatccgttggatgataatacaatggttgccaacacctcctaattacacttatttaaacaaagtcacttctttagatacatggttgaaaaatatgttactctaaccagaaaaaaaatataaaattacatgaaataaacttatagctaataaaaagttataaaatttacgtgcattttttttaacttagattaaatataaagtaaaaaaaatcatatataacgacaaatttgtagttagatatatgcattgtggaattatagatgactgaaaatgtataactccttaaccgtatgaaatctatcaaatccctaattaaaatagaattgcacatcatgttccaatccaattaacgtaaattgatggagagaaaaatatcacgtactctccatttatcatatataagcatttctactctatccgttctaaaatataaacaacactatcaccttctggcagttctagctacttcctaccttaccagtgtattttgaggtaaattacaaacacccccttaattagccgcctccgttgcctacttgcctccgccctgcagtgatctgtcatgcatggcttgtctctgcctcccatcctctatctcctcctctttgcctagcctccatttgtttaagctgatcgaggcgaccgcgcgatgtaacacggcaaggcatgcacgtacacgcgcggacgagaagctctgactcgttgcaggctagaatgctacagtacagtagatagctggtacgtgttaagaccgagtttagttccaaactttttcttcaaacttttaatttttttatcacatctaaactttcttacacacataaactttcaacttttctatcatatctttccaatttcaaccaaacttctaattttaacgtgaactaaacacacacttaatcttccagaggcccggaaggtaggagtagctatatagcctattgttgcaagcagagccaatatatatagaaggaaatatatacctggtacgtacgtactcgtcgatatggaagctaagctaagctacaccgcgaagcggctgggcactgttcatgcatggccatcgaccgaatagaatagaaagtacacgtacttgtagccactgtgtcacagcgacttccatttccaagaactgtactcgcgcacgctcggttggaagcttgtaggcgtacggtatcgggcgccttcgattcaacgatttcctcaaagtgctataacatccttccaatgatgatgatcagagatttggatgactcgagtcttgtgcaaccatgcatgcgcatatatgcatgtgtcgttaagttataagctcgacagtgaaatcccatcttgtttggaagccgaaggttttccaaaattcgttgaactttcttaggataattatggaagtgataattcagtgtgttcaactctttcgcgtttattatattaaaaaatagttttttttaaaaaaaatatgtgtttcaaatcccgctaactctatttgaattaatttctctcaacgtatatatgtgtggttacctattatcctagtgatcacagagccagaaattctaaaatttataagtagggaggtgtttgctgcggtcatatataacttgtctcatactcctatttgcttaaactataataagctagcatttgcttaagcaaaaataatttgagtacgatggtaattcccgatagaaatgaatggagggatcgtccaaagtaatgcttccaagagtagaccacgctaataagtcccataagcgctcatggagcttatatgacccaatgactgaaatatttttttcaatgacagcatcggctacgtacagggcttcaaatatccaccaaacacaagtctgtacaaggtaaaacaactggagtagacagaagactagaggtgaagctagctagaaacgaataaagagccattattctatgctgtctctttgccaccatctccggggatgtgttacctcccgggtggtcatgtgtacaaaggggtgaatgtgacacaggtaccaatcatgtgatcatgtatttcacaaaggcactcaataaaaagggattgtacggcttccgaagaccctagctggctaggcttcttttcaccaaaaatatagcgggctttcgatcactggtactgtatgagtgctagtaaaaattaaagtcgagatctctagagactagagctatcccatccatgtacgtacctcttcatgaattaaagcatgtattgtgaactaacaatgtcaacattattcatgaccgaatctgtttatttcatctctcgctgtatagtacaaattaggactttaattttgcaaagttgtagatatatgtattaattaattgtttaaatgttgtgatatttttcttaaaaaatataaccattcagttgatatttaagaacaaaaaacatgaatctaaacgagtgcacgtgcacttgagtaggtacggagcacaatttttctgcccactgcactgatcatcagaaataactaggccaattacgaaaacattgcctacgtttttttattaatagaagaagccttgcgttgatcctttttcaaacgtaattaaactcatcaatttaaattaattaaactcatcaatttaaaatcaattcaaaccctggtcttaggtgggttgactgtaaccctattttcttcttaattgattggcagagttcctatcccttttctataagaattcaaagcatcaaactatgagactagagggggaaaatacaataacagtgcatgatgtatttcttaagaggggaccgtctattgtccaatataaaaattcaatcaaattaaaagagtagccagcttacatcggactcatgtaagatcgtaatctaatatatatttcctggtcctattacataacccatgatatcttcattgtacatttttgtcacgctctcgtcaccaatgaagtcgctaaaggccccttctctcttccccacctcttcagcaatactcccatgtgccccccttttcttctttgtcggtgattcgtcttgtcgcacttttcctgtctgtagtggcttatgcgacacactccctctactacatacctaaacatacttggtctttctcaccttctagtggaatctaccactgcctcatccagttcaattcattgcttggaataatataacgacgccctttaatttctctgctcacctttaggttttagccatctagatcatccctacaagctctagacacacacttcatgctgtgtctcttcgattggcgtttttaatttgttggtgtcaagtcttagagtatgaatctcaacaccaattctcttatttttcctctttattaaccgatttggttcagtgatatcactgaaccaccaaatcacttacaagattgaccaaatcacttacaagattggccatgacgatggttaatccaaataacatattggcccgggttccaacttctaccctcttagggtaagttatgagcacgagaattacagaatctaggaacaaagtaaatatcaaaccgtacttgacaaagctttatcgatcaaatataagaagctttatctgataaaacttcttgtccagttataatttgtactatacatggttaaaaaagatcacgcggagtaacagaaccatgcatctatgtgcttatactctcccatgcgattgtacgcgcgcagtatatatatgcataccgcgcgtctcctcccagcaagcggaaatagctccaggggctgaaacaaacccagcacatttgtgtttgtacgcgcagctagctagccacgagcgcggatccatctcctagctagcgcaccatctatggatccataccacgactaaaacatgcatgacccacgcggcttccccatccacccgcagccgtaccacctccaccccacggccggcggcctcggcgagggcaggatgcggggcggcgggcggcggcgccccggcgccaagctctccaccgacccgcagagcgtggcggcgcgggagcggcggcaccggatcagcgaccgcttccgcgtgctccgcagcctcgtgccgggcggcagcaagatggacacggtgtccatgctggagcaggccatccactacgtcaagttcctcaaggcgcaggtcaccctgcaccaggccgcgctcgtgcagcacgaggagggctgccagcacgccgacgtcgccgcggcgttctccgccgccgacgccgatctggcccttgagctgaaccatcgccacggcggcgccggcgatgatgacgccgggatgacgacgctggagatggcgccgatgcaagaggcggtgggctacggcgacggcccggctcatcagatgatgcagcaagcgctcgatccagcggggcagctgatgatgggcggcgctcatcagctgcctcctttgccttgctgtgtcttcgtccaggagactgacccctcgtgctactcggtgtgcaatgtccacggtgaggagtctggtgcgcaaggatcttattagctagctagtgagacagtggcttgcttaggtagttaatttccttaagtatgctcgaatattggctctacccactagctgtctagctctacttagcttacctaggtcgtcaaccaatatattaccggttggtcatggtcccttaaattagctagactcttgatttctgtaagaatgcatatatgcatgcatggggttctgttggagcaatgcataacagagctttgttttacatgcatgcgtgcatgcttcctagatatcattctgaaatctgaacttgtttgctcgatcgcttaattgctatctcaccatttcggttagtctgatgtttatcgttcagctccattctgtgttaatttcttttcctttccatttgcggcatgtatgatagtacgtatattcttctcactacgtcctaaaatataagggattttaggtggatgagacgtatcctaatacgaatctggacatgctccctatctagattcatagaattaggatacattatatctaaccaaaatcccttatatttaggaacaaagggagtacattactactcgctcccccggtcacaaaaagatggtttgaacttttaaaatcaacaaggatggtagctcacgtattcacgcgggcaagtatatcataagcccgtatttgaaaaacttataaggatcagaagtacattttcttcataaatttatttgctggctttgctcaaatatttttcattaggtatttgttatcttcatactacgtaatatttaattcatctctataagtaattattattttcttcttcatcatttaaaaatgaggtagacttagtttgtttagaaaacatgtctaatagttcaaattaaaaataaggtgcttttttctttttagattgaatgttttgggatttttttaacaaatcttaaaaaatattatttttaataatggaccatcaagctagccctccttttaattggttcatattaatgtaatttgttatacatatatttacatatggatcagtaaagatagattagatatatgtatcctgatcttgcttacaggagacgtgcacaggtacgcccgacattaggaagagatgagttttatttcctttgagatagattcattggtttcaccaacttgagttatctatatttacaaacataataatgacccaaagttctatacttattaaatatatattttctaattaaaattgtttattattgcatattgttctatttaaaatatatgtgttgctaaatagattgttaaaatatctatacgattttccctataaatgtgttttatttcttttacttactaaatatagttagtttgggtcttcaactataatttttttggtaaatattctaatgttctaatgatgtattatgtattttctacataatatagcatgaagaggaggagagaaaggatatatggcgtacgtacgtgcacacagtacgtgcaccagtgcacgtacacgatacggatttaaagtgggtccaccgtatttaaaataaaatctatggtttaccttttaagaattattagatattccttaaatttattaaaacaccatgtggcgacttaggagcgtttgtaggatttacacgtggcggcttgagagcgtttgtaggaaatttaatagacttttaatatataataatagataagatataacttcgacatatagtgttatactattatgaaagcttagataatactagctaacttagctactcccgtcacaaataactgacgttttggatgtgacaaataaaattgtcgacaatgcattagttttggtacttcctccgttttatattataagacatatgtgtttacattcattaacatctatataaatatgggcaatgctagaaagttttataatatgaaacggaaggagtactaattactactatctctattctagaataatttcatttttaacttgcttttttctcgtttgtcccaaaataagttcattctttaaataataattgcataagtgtttgtaaaagtatgaaaataaatatattaggaacaaattaacaaatgaataatttcattggtatttgataaagtaaaagtactctgatcttttatattgatatgtgtgagataagtgaaaaataaacttattttgagataaagagtgtactatttaacttataacaggaaactattttgatccctcgaggggactcccctcgttatttgcatatcactcaaatgattatgacaaaaattgaaaaaagaattgagaagttgtattaacatgcgatatatcacttcacaaatatacaagttcaaaaatcaacttctacatcttgcaacggaaaaaaaattaaactacaacaagttaatatgtattcacagttaaatttgtttttttcgttgcgaaatgtagaagttaaatttgaacttgcatgtttgtggagtgttatatcacatgttagtacatcttctcaatttttttataactattagagtgacacgcaaacaacgaggggatgtcacctcgagggatcaaaatccactcccaacttataacaaagtgttacacattaacttagggtataattaaccgaatgcagtagtataagttacaacaaaattctactacctccgtcccaaaataagtgcagccataaatatctgtgtttagcgctttgaccatccgtcttatttgaaaaatttatgaaaaatattaaaaaaattagtcacacataaggtactattcatgttttatcatctaataataataaaaatactaatcataatctttttttaaataaaacaaacggtcaaacgttgaacataaatagtactaaaactgcacttattttgggacggaaggagtacgttccaaatggaccactagcgggcaccctcaacgccttcctcttatcactatctctaaaaggattttcattataaaatggcaatacaaagcgaccacatgctagctaggtgacattgacacattgttggacttggacgtaagtgcccttaaactcatcagttgcaaagatacacagtttatactgactaaggtatatttcttccggattttctatttcagatatataaaaaatcttatatttttaaaaatatatcacttccattaaattgttattaaaatactgtaaaattcatagttgctatttcctaagaccatatgcagtggcgagttgactcgtgtaggccacgtaaaatggttcgagtcgacgactccctcatctccacaaatgctaacccgtcatcatgttgggctatcctaattaataaaaaaaaatcccaaacatgaaagcaacgtgaccataatatttaggggcatttgcaagccaaccactgtttttgatattttgtaaaaatgccacacgagtggtagtttatggcagtttttacaagtattcaaatgacagttttacaacaataatttaaacagcggtaaatttataattgctcctaatatgtacttctgcatgcatcaactcatattatgcttcggtttttttgcattatgcaagattcttgtgttctccggtgaggaagactcgattcataagttgccagctcgttgtatatttatatgaggcctcacagcacgagctcagttttgttatggctccgcttggtccatgcagtcaaatcgatagagctagacgtttagttttatctatttaataataagagatgatcatagtcgatttagataaaagaaaatttaaaggctattgataacaatccggctcaggtggggttggctgaggcccaataacttaagattgctcggacctcaacagttcataggcacacacactcggggaaaggcccaatctccctaaaagacactggtggagaaggagtttttactcccggttcgtaaccccctgtaaccgggactatgaatccgggactaaagatcgctatctttagtcccgaatgaaaaaaccgagagtaaaaatccatttttagtcctggttggtgtttctttagtcccggttggtaacagatcggttgctactttattctattcttttcttcattgtttttaatatattgattcactctatctcatcccaaaatcccaaatcaatcatccccgaatagtctccaaattctcaaatcaatatctctaaatacatcacaaaatcttaaaaaaattacatcacaacttctacaaaattcatcacaaatacatcacatattcatatcacacacaaatcgtctcagacccgaattgtaacgctccgcttttcgtgaggcgttaaaaactaattcggcaaaatcctaattgcgaaaattttcgttctttgtgtgagagtctaagtcgtgccaagatctcatctcaaatcacattgttccctctcatcgaaatcaaaatcctccacctcaaattcctcttccgattcaagtctccaaatcaaattccgaaattcagtcgcatcctttgaatcctcgctaaacactcgctcccaattccgaaaaataccaaaccctatcttgagctttccttgattcctccctgaaccctcgagttcgaatatcgaatttgaatccaaatccaaactccaattctctccaaatcagccttctctgtgaaagtctattttacctccctctggctcagtgggccgactcttcttccccagcccatctcctctcagcccgcttcacctcctccccgcacgtgcgctgcatgcgccgagagagagagagaggcatcgcctctcttcttcctctctctttcctcgctctctctctctgcttcctttctccctctcctcagcgccgatttcccgccgccgccgttcgaaatccggctgcacccccgcgtcgcgcgcgctcgctcgagaggtggccgaccggccgaacgccgccgccatcagcccttgcgccgccgacgccacgagctgccgccttgcccccgctccatgacaaaccgaccgccgccgtcatcgccgacgtcatccatggcccctgccactccacgccgcatcgtccaagaatgggagaagcagctgcttcccctctcctcaatatggcaaaggaccaacccccctttttccccccttctttttttccctttccccgaccaccgccggcgtcaccacctctgcgccgcttgaccgctcgcgccacccgcctcatctccttgaccgccccaaggtcggttctctcaaactgacatcgccacctataaaacccacaccccctcccatacctctcgcttcctctcctccatcacaccactgccgcctcgccgttcgtcgtcgttctcgccctcctctgccgtcgtgcgtgtcggggaacttgcgagcacgaggagtcgacgaggagctccgcgccgcccccatcctcgcgcctctccatctgttcttccccggccgcgccctctcggtgccgcgccgccccgccgtcgcgtccgcctcgccgcgactccatccgcgccgccgactccatttctctcgtcggtgagctccccaccgaaccccttttcccctgtcgcacgccgcgccgcgcccgccgccgtgtgtcacatctcgccgcgcgcccttgctctgtcccgggcgtcgctcgccgtcgccggcctctatcggcgtcgcccgtgccctctcaaccggtggaatgagctcgcgacctcgcgtagatgctccagctccaacgaatcgaacccccgttgccccagtgaagttttccctctttgctcgccgccgacgatcgctgtcgaaatccgccgtcgtcggctcctctcgcgtcgattcctctcgccgccacgctcccggggatccccttgacctccccctggctgccccaaggccgccggccttctcctttgtctccgcgccgtgtcgccgcttccgccgccgcctaacgccgccgtgcgtgcgccgccggtgaccatcgggtcccgcgtccccgcgtgcgcatcgcggtcgcgtactggttcggcttagcccgagcccgcgcgcccttcgctcttctcgcgcgtggccacgtcggcgtgccggcgagattggtcgccgccgccagccgccgtcgtttttcccccggctaatccgctccattgaatcgattccccttggcctcctctctcttccggtgctacccccccaatccacctcgccgctgttcgccggttcacgtcgctcgtcgccggccatcggattagcctgcccggcctcctctcccttccccatccgacgtggcatccatgtggatgccacctcagccgcctggccccgcggagaccggtcaaaggtctcccggtccaccgatccaacgcgccgccttgcgtgcaccccgctcgcgtgagccgtgtcgccgccttgtgggtcccaccttgcgcccggcacggtggaccgcgtccaccggcttgcgtcgcgtgggccgcgcctcgttcggccttgggccgcctccctcccgcgcgccggcccgctcgcctcggccgcgcccgcgcatctcttcgggccgcgtcccttcgctcggcccaagtccaattaacatccctccatccttttctttttcagggatttaataaatcatttttcctttgtcccataaatcaattccttattccaaaatcccataaaccatttcctttggtcccgcgtgacaatgactgtcaataatattcttgagaatattataaatttcataaaccatttctcctattccagaaactccaattaaacttctaaaaattcatatcacccaattcgcaactccgattgactccgttccacttccagtattttcataaaattgagatctatttaatggcactactaattagtctaaataggatctttcttttggtctcttgtttaggttttcgattgttgcgtatagttgcggttatcggtttttcgtcgatcgcgggttttcccgaagattcgtgaagcttcgtgaagaccttgagcaaggcaagtcaccctttgatcaattgcccctataattgaaaagtcattattattttatttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacatgggaaataggtttgtgaagccttcaaaacccgacatgtggtgtcggtgtgtttgaaaacaaaatgaattttgaaaactcgcgatgcgggggttgtgcctatgtggcactgtcccgtattcgcatataaggaccgattcctgtgggaaactcatcgaacataatcaaagtgcaaccacaaggtgaaatgggacaccctggctaagtaactagtcggttcaggaaaacctcgcatgccaatagttgggaacgccggggcggggtcggttggagccaaaccgggttcctggtaatgcaagaacgagaagcttgctgaattaccgatcgaggtggttggagtttgaattgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcgtgtgggtaaagtgtaccccctctgcagaggttaactaactgttcgaacagccgtgcccacggtcatgggtggatgtgaggtggttcccgttgcgtagatttgtttgcctgtgctttgtgaaaagttgttgtggtgtgggaatcgtaaccagaatcagcctatgtggcagatggacgatctgagtggtcagaaacgaatctgtgtgattcgggatgtctgcgggcatcatagattaggcttcccgagtggaagcagattgttgtgctgctgggcagctggactctgggagtcaccgtgggtaccagcactatgtcctgggactggtaccgagatcgcggtttcgtaggaagcggttcacgttgttttccctacgacacgctcctgtcaggtgccgttgtacggcggtatcagattagggtgtgacacgaatcacagattctcaacaaaaaaaaaagaaagaagacgaacggcccgttgcctcgccagccaccgccgcaccgcccgccgcgtcgccgtgaagcatctaggctcccggtgttaattttggtaattaatgacaagcgctaattgtggactaaccgttgtctttgagctatacattttaagttaggtccacatcatatgtgcgcatggatgattatcgatggattaaaattgacggcgcaaagcaaagggaaagaagacggtaaaactagcgctttaatttagaattgatcgtggtgtagggcgatcaaatttgctagtttatttttagtttcgccgtactattaagaggggtaatgacctagcaaagagatgattacaattgccacattaggtcattgcattttcatttgtgctctctttttcatcacacacacattcacttgcaaattcactgggttcggcctgaccaggggcggtcagaccggccacatagtggcggtctgaccgacgtgccctggccggtctgaccggcggcatttgcgcggtcagaccggccccctggaggccgggatggtgctgctcgggatggccgatacagagccgacggagccgtattcggtcagaccgagccgatgacggtctgaccaagccgaggccggtctgaccggccaccccatgccggtctgaccagccaggccgttggggccctctgacagggctacaacagctagttttctagccgttgcagagtagcacggtctgaccggccacatacctccgatcagaccggcagagcacagagttaggggatttcgcccccaacgactagttttggtgggtgggagtataaatactcccccaccagcagcaagggggctctctaggcacccaattcaattgcatacactccttgcacctttctcacactcacttgagctttgtgttcatccatctagtgtgttagagggttgtttagccaagagtcaagtgcatttgcttccattgtagagctagtgtggcacttgatcatctccacaccgggtcattgcttgttactcctggaggttgccgtctcctagacggcttgtggaggagttgcccggtgacctctccgagaagattgtggaggaggcccggcgccggtttgtgagtggtttggagttcaccaccttcggagtgaagtaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttactttcctagagatataattgagccactatcaccctaggtttgcaaaacataaattagttgcttagttagagttcaccctcaccaagcctagcaacttaggttagatttgattaggtgttatttattctttaaatcgcctattcagcccccctctagtcgacatctcgatcctgcaagtggtatcagagcttggtctctcttgattgggcttcaccgcctagagagaagatgtcgaacgaggtgaaccatgtagggaaggcttccatgtttaatggcacaaactactccacttggaaaattaaaatgtctactcacctcaaagctatgagcttccatatttggagtattgtggatgtaggctttgatatcaccggcacacccttgacggagagtgatcaccgtaacctccaactcaatgcccaagccatgaatgccttgttcaactctttgagccaagaggagttcgatagagtgagcaaccttgagaccgcatatgagatttggaacaagttggcggagatccatgagggtacaagtgagtacaaggatgccaagcttcatttcctcaagatccaatatgagacattctccatgttgcctcatgagagtgtgaatgacatgtatgggaggctcaatgtcattgtgaatgatctcaaggggcttggggcaaactacaccgatcttgaggttgcccaaaagatgcttagagccctaccggagaagtatgagacccttgtcaccatgctcatcaactccgacatgtcaagaatgacacccgcaagcctcttggggaagatcaacaccaatgacatgtacaagttgaagaaggagatggaggaagcctcaccctccaagaagtgcgttgctctccaagccaaagttgaagacaagagcaagagcaaggtgaatgaagtcaatgaggacttgtaggaagagatgatccttcttgctagaaagttcaatgatctcttgggaaggagaaaggagagaggaaggggctccaactcaaataggagaagaaatagaagacccaacaagactctctccaacttgaggtgttttgagtgtggtgagaagggacactttgcttccaagtgcccttccaaggatgatgatggagacaagtcatccaagaagaagactggaggctacaagctcatgaagaagcttaagaaggaagggaagaagattgaggctttcatcggggaatgggactcaaatgaggagagctccgtctcatccgggtccgaggaagaaggtggtgatgatgcaagctccaagaagaagaagatggccgttgttcccatcaaggaggctccatcactcttcgctccactttgtctcatggcaaagggctcctctaaggtaacatcccttagtgatagtgagagtgatgatgattgtgatgatgtttcctatgatgagcttgtgagtatgtttgaggagctccatgcttatagtgagaaggagattgtcaagttcaaggccctaaagaaggatcatgtttctttggaggtcttgtatgaggagttaaagacctctcatgagagactcaccatttctcatgagaagcttaaggaagctcatgacaacctcctttccactactcaacatggagctcacattgatgttggcatatcttgtgatttgcttgatgatagtgctacttgccatattgctcatattgcatcatctagcatttctacctcttgggatgatcttatggatatgcctagccctagctctagctctagctcttgtgtttctatttgtgatgcctcacttattgttgagaacaatgagcttaaggagcaagtggctaagctcaacaagagtttggagagatgcttcaagggtaagaacactcttgacaagattttgagtgagcaacggtgcatccttaacaaggagggacttggattcactccaaagaagggtaagaaaccttctcaccatgccactcgttttgtcaagagcaatggtaagtattgctccaagtgttgtgaggttgggcatttggtgagtgattgccccggtggtaagcctcctaagacatgcatgttcgattctcattatatgcttaggaaggcttatgatggtagtattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgcttgatagtggatacactcaacacatgaccggtgatagggctatgttcaccacatttgaagtaggagagaatgaacaagagaaagtgacatttggagacaatagcaaaggaaaggtaattgggttaggtaaaattgttatctccaatgatttgtcaaatgaaaatgtctctcttgttaaatctctaaattttaatttgctttcggttgctcaaatttgtgatcttggcttgtcatgtgccttcttcccacaagaagttattgtttctagccttcttgacaagtcttgtgtgttcaaaggttttagatatggaaatctttatttggttgatttcaattctagtgaagcaaatttgaaaacttgtttagttgcaaaaacttcattgggttggctttggcataggaggctagctcatgttggcatgaatcaattgagcaaactttcaaaacgtgatctagttgtgggcttgaaagatctgaagtttgagaaagataagctttgtagtgcttgtcaagccggcaagcaagttgcaggttctcattctactaagagtatcatgtccacatctagaccattggagctcttgcatatgaatttgtttggcccaacaacctataagagcattggtggtaatagtcattgtcttgtgattgttgatgattattctcgctatacttgggtgttctttttgcatgataagtctattgttgccgagtttttcaaaaagtttgcaaaaagggcccaaaatgaatttagttgcactcttgtgaaaattagaagtgacaatggttccgaatttaagaataccaatatcgaggactattgtgatgatcttcatatcaaacacgaactttccgctacctactcacctcaacaaaatggtgtagtggaaaggaaaaatcgtacattgattgagatggcaagaactatgctagatgaatatggtgtttccgattctttttgggcggaagccataaacaccgcttgccatgcaaccaatagactttatttgcatcgtctcttgaaaaagactttctatgagctaattgttgggaggaagccaaatgtcgcctattttcgagtttttggttgcaagtgttatatttaccgaaatggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgttgtaggtgatgaaggcttgatgagagctatgaagaacatgtctattagagatgtcaagtctattgaagtggaagacaagccatccacctccactcaagatgagccatctacttccgcttcgccaagtcaagctcaagttgaagtggaggaggagaaggcacaagatccacctatgcctccaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtggatatttaggaacaaagtggattggtggtgagaaacaaggcaaggttggtggcgcaaggtttcacacaagttgaaggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggtttggaggatgcgaagcccatcaagacacctatggcaaccaacggacatctcgaccttgatgagggaggtaaaccggtagatttaaagctttatcgttccatgattggtagcttgctttaccttaccgcatctaggccggatatcatgtttagtgtttgcatgtgtgcacggtttcaagccgctcctaaggagtgtcacttagtggccgtgaaaaggatttaaagcattcctatactattggcttgtggtacccaaaaggtgctaaatttaagcttgttggctattccgattcagattatgccggttgcaaagtggatagaaagagcacatccggtagttgccaaatgcttggtagatcccttgtgtcatggtcatccaagaaacaaaactccgtagccctctctaccgccgaggcggaatatgtttcggcgggtagttgttgtgcccaattgctttggatgaaacaaaccttgttggactatggcatatccttcaccaaaaccccactcctatgtgacaatgatagtgccataaaaatagccaataacccggtccaacattctagaaccaagcatattgacattcgccatcacttcctaagagaccatgttgccaagtgtgacatagtcattagccacataagaaccgaggaccaactagccgacatctttaccaagcctcttgatgaaacccgcttttgtaagttgaggaatgagttaaatgtcatagatttctctaatgtggtttgagatggtgcactatggttgcttcttttgcattttgtatatttgctcctatttgctcttatgctttggacttattgccatttggttcttcattgtgaaaatggagcatgtcacattaagggggagttttggactcttgcatgtgctctacttccttttatatgtgagcaaatcaactaaaagtgctagtagtgtttttcaaaatgcccaagtcaacataagtcaaaacttttgcaaaatcaatgaaatttgaaaactatttcttggaaaatgtttcaaaagggtccctatatgttttccaagcctcacattgctagaaaaatgatttttgaacgaaaaatgccattttggctctcttttgaagaatctagattcttgtttttggccaaaatgagattaaaccccataatgagtttgagaaggaatctgagaaaagattcaaaacaaagttggtagagaggagtatttgaaatgttttaggtattcaaatcatattcaaaaaccaaatatttcaaaagttgtttgaaaatcaaattcgtccaaaaacccctatagaccataaaaggccacctcctagcactcaagtgagttttgttgcaaatcttcataaatttcaaatattatgaatggttggcaatatttcaactcacacatttcaaaattgctccaaaaatcaaaattttattgatatttattgagtgggggcagccaactgtgcaagggctgtgcacagtcggctggggggccaggcggtctgaccggcgctatatgcgcggtctgaccggcctggtggcagcggtctgaccggccactagggctcggtctgaccggctgcaacccggcggtctgaccggacgcgtaaagctggtctgaccggcctaggatggtgggcccaggactttatcctttcttcctcatcctccttctacccgacccctcctcatcccatctcatctcttctcttctccaactcgaaaaaactcctcctctctcctctcccaaaccctagccacctccctccaccaaatccatccggttcaaccgtcaaaatcactccggttacaccgtaagtgaatctcctcctcttcctctctctattccatggattgatttgagttcttattgagtttgtgatccatggcatggaacactaggtgaaggaagaggtgttcttcgatttgcaccaatagagggtggtttcttggtgtgattcaactccttcaaccggtacatcactctccctcttgtgctttgctctcaaattggtctatctaaatctctagggttaagggtagtttcccccattgcttcaatctctatgaaatagacctacaccttgatgttcatgttccaatcttgtggaactttgtcctagcaatttttagaatcatttgtgtggattgtggaaggattcggttgtgctactgtcagcggcggtctgaccggcctatggccgtcggtctgaccggccgtgagacaccggtctgatcggccaatggccgtcggtctgaccggccgttggccatcggtctgaccggccttggctctcggtctgaccgcccctgacaggcagcacccccattcctccctcttcactatgtggcttctaaaattgttgcttatccatcctttgctccttgtttttcagccatgcctccccgcactcgccatggtcgtcgtgagcccacgcccgatcccgtcagtgagaatgaggaatcaagcggagatgagtatgttcaaagtgatgatgacaatatggaaaatgttgagggtgatgagatggaagtaagtgatgatggtgatgacaatgggagtggaaatggtgaagatgatgaggcaagtgatgatgggagtcctctcgattcctccatccaatttgtgcttaatttgaggaatgctcaacaatacactatcctccgtcatcatgatcaattccggaggcctaacgattgtaatgatccaagatttcatacacggttccaaaagtccgtgtatgcacaagtgtatgccaacaaagccttcgccgagcacaagtggatttcttggaggcacattggtgagacaccggagtttgagaatttgcaagagatgttccggaccgttgggattgatagaattgtcaccatgaagcaaccttttgatgaagatctcatccggcaattctatgccaccgtatgggtgtccggcgattgtgatgcaatgaagtggatgtcggggaccctccgatgctctatcaaccgccatgaattcaaggagctcttgcacattcgcttcaacaacggggatgaccttcatgatgagcacacccacaaccccttccccattgatcacttttctcagttttatgaagaagggagaaggcacacatatggcaaggtggcgggtttgagggctctcccaagtgtgatcaaccgcatagtaagggccaccatcctcccaagaggcggcaacaatgatgacatacgcggagttgcttggcatgttattgatgccattatggatggtcgtcggtttgatgttatcaaccttatgatgaaggagattgccatctcaaaggggactcttggacaaggaatctattatgctccctacataatgaggttgattcaaagcaagttgggacaaattggtcacaatttaaaagaacataaggagtacaagcctcgtctcaaactctcctcccctagagctcctcgtgtgcgccaaccaacattcgatcaaggtgcaagctcaagtgcagcccccctcctcctcaagggtatgatccaagtgtttttttttccatccacaatatgcctactttggaatgcaacccaatgacttcttcaacccggtccttggggctattaataccctaagtgaaagcattcaacgcttatccaccgggcatgaagcattgcatgaggatgttcgtggcttgcgcaccgatgtttgcaacttgaatacttcggtgggaagattgcatactagggtgggtgtattggattctcgagtccaaaccttggagagtacccaagcttttgtctatcatcgccaccgtgatgcttctcatccttccacttcggcgcgtcctccttctcctccacaagagtgaagacctttttggtgcttgatgccaaaagggggagaatagtgtgttttatgttttgtgggttgggactagtagtagtgaggttagtcacctcatatttaataggctaaggaggattgggctatatttggtatgggtatgggctattactctatattgtgtgttcctttttcgttttgttgttctctatgtcatttggacccttcgtggtcttgtaatagcctatatttatttgtgagccctttatgtggtcttaatgtgaacttctgctatgatggatggttggtgtgacattgatatatttgtgaccatcttatgcccatggatgaatatttctttaagttcacattgagatattgctcttgtgtttgtgatatgttgaaatgtgaaattgaattgtgcattggctccatatttgctatttgtgattgttatgcatatgtttagggggagcttttgcttgtcaatacaatatatgtccatgtgctatatgtctgattatatatatttgtggtgtttgtcatcaattaccaaaaagggggagattgaagcatttaggcccccggtgttaattttggtaattaatgacaagcgctaattgtggactaaccgttgtctttgagctatacattttaagttaggtccacatcatatgtgcgcatggatgattatcgatggattaaaattgacggcgcaaagcaaagagaaagaagacggtaaaactagcgctttaatttagaattgatcgaggtgtaaggcgatcaaatttgctagtttatttttagtttcgccgtactattaagaggggtaatgacctagcaaagagatgattacaattgccacattaggtcattgcattttcatttgtgctctctttttcatcacacatacattcacttgcaaattcactgggttcggcctgaccaggggcggtcagaccggccacatagtggcggtctgaccggcgtgccctggccggtctgaccggccgcaagaaggcggtctgaccggagcataaggccggtctgaccggcggcatttgcgcggtcagaccggccccctggaggccgggatggtgctgctcgggatggccgatacagagccgacggagccatatttggtcagaccgagccgaggccggtctgaccggccaccccatgccggtctgaccggccaggcagatggggccctctgacagggctacaacagctagttttctagccgttgcagagtagcacggtctgaccggccacatacctccggtcagaccggcagagcacagagttgggggatttcgcccccaacggctagttttggtgggtgggagtataaatacttccccaccagcagcaagggggctctcttggcacccaattcaattgcatacactccttgcacctttctcacactcacttgagctttgtgttcatccatctagtgtgttagagggttgtttagccaagagtcaagtgcatttgcttctattgtagagctagtgtggcacttgatcatctcaacaccgggtcattgcttgttactcctggaggttgccgcttcctagacggcttgtggaggagttgcctggtgacctctctgagaagattgtggaggaggcccggcgccggtttgtgagtggtttggagttcaccaccttcggagtgaaggaagaactaccccgagtgatcctggcttgggtagtcctctccgtgggccggctcccgccttgcccaccccttgacgaagggggcgtgcggtggctttgtggttgagcggtggactagcaacttaggttagatttgattaggtgttatttattctttaaatcgcctattcacccccctctagtcgacatctcgatc

SEQ ID NO: 71117 - DNA, 7437 bp, Oryza sativa
ttagcattcaaagaaagagctgataacacatttcaagacaatacttaacaggtcgaacctaaccgatgccgtgttaagcgtgaaaagaaacataagatctaagcaaatagatgaaaactcattcaagatggtagatacaccgcataatctaggctgacatcgacatctaaacctatcggccgttttcgatgatagaggctggccgatggggttagatgacgagatcaatctagattatgcggtatatatgataattcagcgattcacgtagacaggattagagtgtcatagcgatgtaagcactaatcccaacaacgcaaactgtcataacaagctttaccttttcgtcgaagatcgaacctgatgtagcccaacttgaaagcaaaaactcgtcgaaacaataaaaatagaaaagggtggtgatgcaccaaagtattattgaactgtcgtcccttgattacatggtgtcaggtcatattaatacccgaagtacataatgtgtccttgccggacacgcctcttgtctctaatataatttaaaatacgaatgagtcccctaggtgggctcttaccaaacatatctctaaggaaactgaaaaaatatcctaattaatagatacaattgcccctttttaggactccaatccttgtgtggcaatggctatgaagtgctttggctaaccctgatgaccaacgtgggaccatcattttcgagactggttgcatcggcttgattccgcggatttggcgctagccaatatgcgcagccaatattgcctgtagccgatcatgtggcagctgatgctgttcttagccaatgcgtattctaccttctcaaatggaatctcgccaaatcggctttgactctagctttgaatccggctcatggcattaccaaatttggtcgttaacacatgccccccaactattggaatagccatgcccgcagttattgggcggtcaaccagctcattgtgattagtcccacaataataatttgacttatagaactggagttgtttaggtggttttggttgggcgtgttgcaccgtggatttagcgttagatagtgatgatttaatactgcttaattatatattgtttttactatttcaaaatatgatttataaatgctgcttttaccgcaaatatccaatgctatttttatggtggttggtactcagtcttgctttatttcctccccacccccttcgaagcagagattggttcgggtggtgagttctttgaggaccgagcttgttctgggcgtcgaggattgcctgtgttttatggagtgttggtaattcttacgatcacagataaaatccgcaagcacacggatataccgatgtagcacttcccctacggagtattccaaagggtatcaaatcaagggaacatgtgtggtcagttcttcttccggttcatccaaggacaccaagcaaaggataggctaggatagagaggattcactggtaagaaacagtgtctagggaaagcttaagtttaatcctaaagcaatacttcaggcactggtaactcactgttcccagatgtcgctctattacgtacccgaacagggaggacttaagtgatctcgagggctgtcaccacctctacacctacctcaaacgtacaatgggatacgcagcaattactggataacaattacctaaacaccacgtctaagcaattaatatctacttcagtgtttataactcaccaaagcaatcactatatttcagttgattatagtgaacaataatcccgtatgctatttaggttaattcttataagataaatctaagttactcaagaagaatattatattgaaatcagagtaatgaacagaatacaagaaatgagagaagattagtgacaactccagaattcttccgacttcttctactctactctcttcctattctagtatacaatatagtacaatagagcctcttataattcagctcaagcttggaagtgtgtgtgagagtgaaggagtgaagctccttatatagaggtaggtatgatggttacacaatgcgaattgtcggaaatgccccgcaaccatcatcaggagatgatcaggactgtccacgccaaaccccagcctgaatggctgagattttggttcggccgaaccaaggggttcgggcaaacctgtgctgggcccacctggcctggccttcggcccatctcctccccttgtcctcctttatccatttctcggagttttgggctaagtctttgatattttgatgaagttcacaacccatccttgtatagataaattttcccctcactttagtctagatttccctccaacttcggggtttgacacctgcatacaaatatacaccaacacttgtggaatatgtgacattaagcacctatcactatgttggatgttttattgtctgaactttatgcagatgttggtggtatagaatcggtgtttaacagccgccaacatggaggaagcttcacgttggtcgtgaagattaagtctagtttatttgtttttccgctgcgtatgttagttttattttgttatttttgtaagacgtggatctgtctatcaaattgttgtttgtgtactctggctggtcctggacggagatttaatacacattctacttaaaattcgggttaacgaatttctgggcgtgacaagttggtattagagccggccttgatcgtaggataagccaagtggaaacactaagagccctatgattttctcatctgctctttccttttgtgaggtcgagtggtccagtgagtctagtaaggatagagtgagtcagtgagtagtcggagtttgcataaaagtgtaggtgaagtgtggtcagtcgtctgcatggttcatgaaatagagatcagtaagtgtcttttctttaaaaaatattacaaatataatgttttaatgttattcaccggaatgaaaaagaccaaaaagcaacaaaacataatttttagatatattggagtgtattgggtgcgtctgtgtcgaaaaatcagtttgtgacacgcgcggcgaacttttgacaattagtgccaatattggcttatattaccacacgtgggtgcaatttttctcaccggaatgaaaaagttcaaaaaccaccaaaacatgatttttggacacattggagtatattggatacgtctgtgtcgaaaaatcactctgtgactcatgcggtgaacttttgtcaattaatgccaggcctatattggcacacgtgggtgcgatgtttttcaccagaatgaaaaagattaaaaagcatcaaaacatgatttttcgacatactgtagagtattgggtgcgtccatctcgaaaagtcactgcgtgactcgcgtggcgaacatttatcaattaatgccaatattggcatgtattgccacacatgggtgcgttgtttttcataggaatgaaaaagttcaaaaagcaccaaaacataatttttgaacatattggagtgtattggatgagtccgtgtcgaaaaatcactccgtgactcacgcggcaaagttttgtcaattaattccaatattagtctatattggcacacgtgggtgcgatgtttttcactagaatgaaaaagttcaaaaagcaccaaaaaatgatttttggacataatggagtgtattgggtgcgtccgtgtcgaaaaatcactctgatactcgtgcagcgaacttttgtcaattaatgccaatattggcctatattagcacacgtgggtgcgatttatttcaccggaatgaaaagttcggaaagcaccaaaacatggtttttggacatactgtagattattgggtgcgtccatgtcgaaaaattactacgtaactcgcgcggtgacaatattggcctatattggtacacgtgtgtgcgagaaaaacttcaaaaatcaccaaaacatgatttttggacatattggagtatgttgggtgagtctgtgtcgaaaaatcactccgtgattcgcgcggcttatttttctcaattaatgcaaatattggcacacgtgggtgcgatgtttttcaccgaaatgaaaaagttcaaaaatcaccaaaacttgatttttggacatattggagtatgttgggtgaatccgtgtcgaaaactcacaccgtgactcgcgcggtgaacttttgtcaattaatgccaatattggcctatattggcacacgtgggtgcgatgtttttcacttgaatgaaaaagttcaaaatgcaccaaaacataatttttgaacatattggagtgtattgggtgcgtccgtgtcgaaaaatcactccgtgcctcgcgcggtgaacttttgtcatttaatgccaatattggcctatattggcacaagtgggtgcgatatttttcaccggaatgaaaaagttgaaaaagcacccaaaaaaatgatttttggacaaactggagtgtattcggtgcatccgtgtcgaaaaatcactccgtgactcgcgcatcgaacttttgtcaattaatgccaatattggcctatattagcacacgtgggtgcgatgtatttcaccggaatgaaaaagtttagaaagcaccgaaacatgtttttggacatactgtagagaattggatgagtccgtgtcgaaaaaacactccgtaactcgcgcagccagcttttgtcatttaatgccaaagttggcatatattgccacacgtgggtgtgatgtttttcactagaatgaaagagtccaaaaagcaccgaaacatgatttttggacatatagaagtgtattgggtgcgtccgtgtcgaaaaatcactccgtgactcgcgcagccagcttttgtcaattaatgccaaagttggcttatattggcccacgtgggtgcgatgtttttcaccggaatgaaaaatttcaaaaagcaccaaaacatgatttttggacatactggagtgtattgggtgcgtccgtgtcaaaaaataactccgtgacttgcgtagcaaacttttgtcaattaattccaatattggcctatgttggcgcacgtaggtgcgatgtttttcaccggaatgaaaaacctcaaaaatcaccaaaacatgatttttggacatattggagtctgttgggtgagtctgtgtcgaaaaatcactccgtgactggcgcagcgaacttttatcaattaatgccaatattggcccatattggcacacgtgggtgcgatgtttttcaccggaatgaaaagcttcagaaagcaccgaaacatggttttggacatactgtagagtattggatccgtccgtgtcaaaaaatcactccgtgactttcgcggtgaatttttgtcaattaatgcaaatattggcctatattggcatacgtgggtgcgatgtttttcacgagaataaaaaacatcaaaaagcaccaaaacatgattttaggacctattggagtgtgttgggtgcatctgtgtcgaaaaatcaccccgtgtctcgcgcggcgagcttttgtccattgatgccaaagttggccaatattggcccacgtgggtgcaatgtttttcaccagaatgaaagagttcaaaagcaccaaaacatgattttttgatatattggagtgtattgggtgcgtccatatggaaaattcactccgtgactcgcgcggcgagcttttgtcaatcaatgccaaagttggcctatattggagtggatatgtttttcaccggaatgaaaaagttcaaaaagcaccaaaacatgatttttggatatattggagtggatatggtgcgtctgtgttgaaaaatcactccgtaactcgcgcgatgaacttttgtaaattaatgcgaatattggcctatattgtcacacgtgggtgcgatgtttttcaccggaaccaaaaagctcagaatgcaccaaaacatggtttttgaacatactgtagagtattgggagcgtccgtattcaaaaatcactccgtgactcgcacggggaacctttgtcaattaatgctaatattggcccatattggcacacgtgggtgcgatgtttttcaccggaatgaaaaacttcaaaaagcaccaaaacatgatttttggacatattatagtatcttgggagagaccatgtcgaaaaattacttcgtgacttgcgtggggaattttgtcaattaatgccaatattgtcctgtattggcacacgtgggtgcgatgtctttcaccggaatgaaaaagttaagaaagcaccaaaacatgttttttggacattctgtagagtattgggtgagtccgtgtcaaaaaatcactccgtgaatcacgcagcgaacttttgtcaattaatgccaatattggcccatattggcacacgtgggtgcgatgtttttcaccggaatgaaaaacttcagaaggcaccaaaacatggtttttggacatactatagagtattgtatgcatccgtgttgaaaaatcactctgtgactttcgcggtgaatttttgtcaattaatgccaatattggcctatattggcacacgtgggtgcgatgtttttcaccggaataaaaaacatcaaaaagcaccaaaacatgattctaggacttattggagtgtattgggtgcatccatgtcgaaaattcaccccgtgtctcacgcggcgagcttttatccattgatgccaatgttggccaatattggcccacgtgggtgcgatgttttttacccgaatgaaagagttcacaagcatgaaaaaatgatttttggatatattggagtgtattgggtgcgtccgtgtggaaaaaatcactccgtgactcgcgcggggagcttttcttaattaatgccaaagttggcctatattggcacacgtgggtgcgatgttttttaccgaaataaaaaacttcaaaaagcatcaaaacatgatttttgcatattggagtgtattgggtgcgttcgtggcaaaaaataacttcgtgattccgcggcgaagttttgtcaattaatgccaatattggcctatattggcacacgtaggtgcgatgtttttcaccggaatgaaaaacttcagaaagcaccaaaacatgatttttggacttattgaagtatgttgggtgagttcgtgtcaaaaaatcactccgtgactcgcgtgacgaacttttgtcaattaataccaatattggcctatattggcacacgtgggtgcgatgtttttcaccgcaatggaaaagttcagaaagcacacaaacatgtttttggacatactgtagagagttgggtgcgttcgtgtcgaaaaatcattccgtgactcgcgcgacgaacttttgcaaattaatgccaatatagatatatattggcacacgtgggtgtaatgtttttcaccagaatgaaaacttcaaaaagcaccaaaacttgattttttgacatattggagtctgtttggtgagtctgtgtcgaaaaatcactctgtgactcgcgcgcgaagttttg

SEQ ID NO: 71118 - DNA, 2334 bp, Oryza sativa
taacgcaatacttcaggcactggcaacccgctgttcccagatgtcgctctactacgtacccggacagggaggacttaagtgatctcgagggctgttaccacctctacaccaacctcaaacgtactgtgggatatgcaacaattactggataataattacctaaacaccacgtctaagcaattaatatctactttagtgtttataactcaccaaagcaatcactatattttagttgattattgtgaacaataataccgtatgctacttaggaactaaccaagagataattctcgcaaaataaatcaaaattactcaagaagaatattacgttgaattcagagtaataaacattttagttgattattgtgaacaataataccgtatgctacttaggaactaaccaagagataattctcacaaaataaatcaaaattactcaagaagaatataacattgaattcatagtaataaacagaataaaagaagtaggagaagattaccgacaactctggaattctcccgacttcttctactctactctcttcctattccattatacaatatagtacaatagagcctcttataattcagctcaaacttggaagtgtgtgtgtgaagtgagagagtgaagcctttatatagaggtaggtattacggttgtactatgcgaattgtcggaaatgctccgcaaccaccatcacgagatgatcaagaccgcccatgccaaaacctgggatcaacggtgatcaccagggttcggccgaacctaggctgggccctcctggcctggccttcggtcggtagactcctaggaccttcctctgtctctttctcgaatttttgggttgatttactgatgtttcgatgaagttcacaacctctccttgtatggatacataattctcctcactttagtccgattttccttccaacttagggtttatcatcttcatacaaatatacaccaacacttgtagaatatgtgagattaagcacctatcactatgttgaatgttttattatctgaattttatgcagatgttggcggtatagaatcaacatttaacagccgccaagaaaaacccccacacttagccctttgctcgtccctgagtaaaggttagtgtagaatgaatttcttcaagatataaatcaagcatataaatcattcaaaaccatacctgcacctgtgaactttatcagtggctatcttaccatcttgagtaattgataaatggaatgatctcgatttcagtccttcttgcttctctgtcagactcatgggatttttataaattttcgcaaactagctcttttcctcatattgactttctttcttgtctctcaaggatgtatattttctttttggatcctcaccaaggcaaaatgtgccagaattcattcctattctaaggctgatatttgtagcttggtagggataaactgtgacatacctgcatcatatatattgcaaagccaaaaatacggactcaagaagatcatcagttatacttctagatcaagggtctttatttgtggtggaaaatgaaaaagtaaaatattttgtggaatgatggaataaagaaatgaatctccctttttcttatactttctctcccctttggttttctcggcatgaatatagaaggggcattactatatgttctttccaactttgctcaatgttttgggagcaaactttatttccttctcttttctatttttttcatagccatgcctttccttcccctttttttttattttggcaagaatttttccaagagaagaaagcatagtctaatgtaggagtttatttgaatggaatttttttttgtggaaagccatcttctagtgtagaagcttagcttaattatatattgtggaaaaatggaaatggaaatgacccctcgatcatgagagtatgaaagatatctaacacgagtcatataaatttgacaaagctcaatataatgtcaagcaatcatttgcataataaggttgatcattaatgtacttgcatatggccttgtgtcacgcccggaatttctatccaaaatttcaaacgcttacatgtgtgtgaatccctcgtccaggaatcagccgaggcacacaataacaaattgataatagagtaccattattactctaattaattaacgaataaaatgtcattacagaggtagatagttcctttcaatcaataaagatttaagcagcggaaaataagattaatggcgcagacggctccactccacaggcagcttgaccagggctacacctaatcctccacaccatcaacatcattgtagaactcttcctttgatgaatgattgc

SEQ ID NO: 71119 - DNA, 2820 bp, Oryza sativa
accttgatgtatacaggtaatatataaactattaacatagtactctcttattatatcttcccttgggataaaataaatacgataccttggaatattcccgggtgaaatgctacaatggtatatccatgcgcttgcggatcacatatgtaaccataatataccaaggttatttctagtgctattgctgggaattatatttccagtagtgtcgctaataaataccatcagttatgtacttgtccacgtccaaagtttggttcacctttaataatttgaggatttttgtttataaagcccatagtagatggtttttgatttgaagtctgggcactagtactttgacgattggggcattgtcgagcaaaatgtccagtcttcccacaaacaaagcatggtgaatcttctattctcatgcctggtctttgaattggtggcataccaggtctagtattaggtaaagatggctgaaaagagtaagtcttccgaatctgaaatggatttttagtaggtacttgtcattgcagatttatccttcttttccgaaatccttcaatcatcttttgatcattttctagtctaactactttgttgactagactttgaaagttttcatgatcctggccgatcatcggtcctcgtagttcatcacgcagtccttcaataagtctttcaatgttttccttctcatcttgaatatctgaagcagcatatcgggcaagttgtgtaaatttatttaagtattcttggactgtcatgaatcctttcctcaatctccgaaattcattctttttcattctaattattgcattaggtatgaaagtatttttaaaagctgtacggaattctttccaggtaataatatgggcagggtcgtctattgatgcttgataagcttcccaccattcattggctagtccttctaatcgatgggtttcaaaggttaccttctcttgttcatcagttctgaccaaggctaatttcttttctattgcccgtagccaatcttcggcatccataggttcttctgtttttgaaaaagttggtggtctgaccctcataaattcagcatggttaccttgtcctttattcccttgattttgagcaatggcttctaataattgagtttgttttgccattacttctactaaagtagtaggatctggctggggaatttctcctccttcaggattgccatcattcggattcatttggaatttctgctgtcttttcaaaggggagtcaacatccttaattatacatagaaaatattatacatgatgcatacaaaagtagcaaaagagaaaacaaaagaaaaagccaaaagaaaacaagaaagaggtaatttcacacaagtggttagtgaggagtactaactaacttatactaatgcgtttatttatctataagacccctagttatacacattctatctataacttctagtcatcaagccaccctcccgtgccttctgcaggattaggaaataaagacgtaggtgcaaactgtgaaaaaccagcattatatgttgtagctatatccattgtattggtggtagggcatgagtagggaatcccatcgtcatggtcttcacaagtcttaggatgaacagtgatatgttcctgtgtttcaaaaatccgttcttcaggatcttcttcttcttgagtctcaacccaaacaggaggaacattcaaatcattaatatgaaacattcgggtccctcttgttgtttctggttcttggctagcttcacttatgtccatagctgagggtgttgcttcggcttcagcttcatcatcagagtggataggatacaacggtgatggtgatggtggaaggccttgtaaaactccttcacccatatcttgaggattgggcccctgtggctcatccccatgtactggtgataaatgtccaccatcatcctcatcatcgtcatcgctatctagtccgggtacttgatgaagacaaaatgatgctccagcgacacaaatatggagtatggagttttgtttctccttctcatcatatagattttgtagcactcggtatttgtatcttatatcggcttccttgcgttcagcttcctctagacgttggcgctgcatgtccatatgctcaagggcttgctcatacatatcgtctgcagcttccatccacagagacatgcatgctttcattggttgctcattgtagtctatattctggatagtgcaataatcctcgccaggttcccgcataggatgataacaatagcgagaatgttggagtttgtcttgatagatatgattcaggcgtagaaaagcctccctagatgcatcatataaggctgctcgtattgtatcccgcctatgacgagtcctgaaatagtacatgtctgtttctccccttggtggattgatctttatagtcatgtcatactcccagcgatctcccttttggtaaggatgtgaatagaattccggtacttcagctatttttagctttaacattaacttgatcaactggtcagcacaatcattgttatgtatagggatcgttgtctcaaaacgctcatgcctttctgccattgacctgaaatacacaaatgaaatatatagtgtgtgttcgcaagttaaatctaccccccttaaaacaataagcttgaaataaattcaaacttaactgggttagtaatccttaaggttcatcctatagtcaaacatatgctctgataccagttctgtcgggtcccaaaactaatgacttggatccgaccatgattaatgtatcaagccctggattagtaaataattcatacatataatacagctggttcttcat

SEQ ID NO: 71120 - DNA, 718 bp, Oryza sativa
caaattaatgccaatatagatatatattggcacacgtgggtgtaatgtttttcaccagaatgaaaacttcaaaaagcaccaaaacttgattttttgacatattggagtctgtttggtgagtctgtgtcgaaaaatcactctgtgactcgcgcgcgaagttttgtcaattaatgccaatattggcccgtattggtacatgtgggtgcgatgtttttcaccggaatgaaaaacttcaaaaagcaccaaaacatgatttttggacttattggagtatgttgggtgagttcgtgtcgaaaaatcactccgtgactcgcgcgacgaactttttgtcaaataatgccaatattggcatatattaacacacgtggctgcgatgtttttcaccggaatgaaaaagttcagaaagcacacaaacatgtttttggacatactgtagagaattgggtgcgtctgtgtcgaaaaatcactctgtgactcgcgtggcaaacttttgtcaattaatgccaatattggcctatactggcacacgtgggtgcgatgttttttaccggaatgaaaaacttcaaaaaggaccaaaacatgatttttgcatattggagtgtattgggtgcgttcttggcaaaaaataacttcgtgtttcgcgtggcgaagtttgtcaattaatgccaatattggccaatattgccacaagtgggtgcgatgtttttcaccggaataa

SEQ ID NO: 71121 - DNA, 528 bp, Oryza sativa
acacacgaaacagatgggacaatgatgacgccctgctatttatgagacactatggaaaactgaggatgtgcttgatggagaagctatcatatcccacaggtgcccttgattcctggagctggctaatccacagccagcggatccctaatcaacataatttacattattctctttaacaaaacacaaagacactctaatgatactccatatatactactactactactacccatagtactgatgcaataactacaaagagaggctcatgggtaatgcttgtgtttgaagccaaagaaaaaaacttaagctcacgatgctccttgaaaaggattacatcaatgtctagatgttcctcaacggaatgcttctgtactcatgtacttagatgtcatggctcgccataaagcatggctccaaacccgcacacgaagaaaaaaggtgtttccttagcggatgtagtcggtgtggtgacgacggacaatagtgctgatgggagtacttctagccatttgtagtactgtgacatga

SEQ ID NO: 71122 - DNA, 54997 bp, Oryza sativa
gctctagtctccgaccttgtcggctgcggccatagccaccacccacgggacgcgtcgccgccactccgggtcagcacgcggcagcgctgtcgtgagcgcgagtgcgggaggaggcaccggcggcggcggtggcggcgacaacacgagctcggcggctccgcctctcccctctcccttccggcccttacacaccgccgcctcctctcatgtcacccatcacatccgtttcctccctcacctgctctcctctcctctcctctctccacttggcgaggccgccgccaccgcttcagcttcctccgccgctgccgccgctctggcgcccgcccgctgccgctccagcctcccatgctccccgcggccggccgaaggagagaggagaaaaagaaagaaagagagaagggaggaagaagaaagggagatagaggatcccacgcatatttttatttctaatgccacctaagcgccacatcaacgccacgtggaaaagaagaccgagtcaatactgccacgtaggcgccacgtcagcgaaaccgccctccaaaaccgcccagggagtcaaattgcaccggttttaagagtttaggggtcgagatatccggttttgtggtttagggtcatggattagatttcgatcacttttgagggtcatgaagtgaacttattccaattcggattcggcctctcgagcaaatgctattatgtgggccttgtgttgatatgggccggtatctcggcccattaagagcctgtaataaaagtacgaaatgttcttcaaaatgtactgctgtacttttgaatttagtttctctatatactcgtgtaagtcgatcgctctcgttttaatactgatttaattctcgtcccgtttcccctttttttttgcgacaaaaaaaagtctgaaatgtgccgatgtgcttgtgctccacgtgaacagaaccgtgtagtttattttatccttaagagtgtcacttttaaatgtgacaattaactctttgacattggacccacatatcatggaggggaggggccaccgcgcaccgctctcccccttgttgccgcgccgccaccggcctcctcctctccagccaaatcaaaaagagggaggtgaggggagagagtggggcagccgccgcccctggcctcctcccctccaaccagatttgggaaggaagggggagtggggcgctgccaccgacgctccatatgctgccttgctgccaccaacctcccctccttgactccaccagactgtcacccgcgaaagtcgccgccgccggatccaccacacgcttgactcgccgtcaccagatctgccacccgcttgattcgttgccgctggatccgtcggtgaagacggaggaggggggtgtgcaccagtgaggaaggaggaggggtgcacgccggtgggcatctgcagggaaggagaaggagaggggtagggaaggagtgcgtaccgatagggatggagagggagtaaagagttaggtgcggtggagagagctgatcttttaatatggcagtcctcttcaaccgccagtggaaatcgctaaagtgagccgccagcaaaaagatacactttcgttggccagcgaagatccatttttgctggcggtctatagccccattgtcgctggtagttttcacgtatggccgccggagaaaataataaggtgacgccataaaagatcgattttgtagtagcatacgctcctaaagtgttcgactttggcacacgtgaaaaaaatcattaaacatttgttttatacaaaacgccctctacttaattagaaaatatcattaaacaaaagagtgtgtttcattttggaccgtgtaatagacgactaaagttggaaatagaagttgtttaaacttacgaaataattgtatgataacacaatgattatattttctggcccaataagggtgcgattgtttcggctggggcggtggacggtttagtcgcacgcaaaacgagaaatgcgattagtatatgattaattaattattaatatataacttttttatgaataaatttgttggatttttttaacaacttctttatagaaagttttcgcacgaaatataccatttggcagtttgaaaagcgtgctaacagaaaacgaggagaatctaatcctataggctcaaaacgagagcctgtaagaaaaggatagaaccctacacgaaaagtgttcttcaaaatagcttttgaatttgattttttctatcgacgtgtaatgcgtcgcgtacgtctcaaaagtcagactgattttacttgtcgcaaaaagtaattcttatcatgtttcaaggctgtgtgtttagatctaaagtgaatccaaacttcagtccttttccatcacatcaatctgtcatacacacataactttttagtcacatcatctttaatttcaaccaaaatctaaactttgcaccgaaaacacagccttcctctctctctctctctttttctcttgtcgcgtcaaaaagaagtcagaaatgtgcagctgtgctcgtgctccgcgtgaacagaatcgtatggtaggttaatgtctccgtcagcatcatgggatccatgcgatgaaatcggaataaaaaatacgctgctagtaaaatcggttttattttattaggtatgtttaattcatttaaactacgttcagtgtttgggtgttacttttataataattggctgtagctctgatgagcaaaagccgagatgttttatttcattatctaaaaaaagtaaaatctgtttatttcacagagcaattcatcatcgcaaaacttgatcaaatttcagcaaaatatatatgaaatagcagtccaggttaacattttgaaatgccaaaggtaaataaaacgcttctaattaagcattcgatttgggcggcgcgttgcgctccatgaacgccttcatctccttgacgagctcgccggagtcggcgagctccgggaagacgtagaaggagtggatcgccgccgggtactccaccacctgcaccgccttcccattccgccgcagcatcccggcgtaccgccgctgccagtcctgcagcgtgtcgtaccctccgaccaccaccatcgccggcgggaactcctccgccagctcggcgttctcgccggtgacgtgcgccgccgggtggtcgcggtcggcgccctccggcaggaacgccctccagcaccagtccgcgcgcgccatgctcaccaccggccccacgccgtccagcctcagctccgcctccgtccgctcctcgccgccgaagaacggctgcagcaggacgacgccggcgaggcggacgcggcggctcgaggaggtggtggcggcggcccatcggtgcgcgacgtggtgggcgatgttgccgccggcgctgtcgccgacgaggaagcagcgggtgaggtcgacggggacggccgctactacgtcggcggggaggccgacggtggcgaggtggcggagcacgtccacgccgtcgtcgtaggcggcggggtagcggtgctcgggggcgaggcggtagttgacggagacgacgacggcgcggagctcgcggcagagccggcggcacaaggcgtcgtactggctggaggcggcggtgaggagcgcgaagccgccgccgtggaagtagacgacgacggggagcggcggggattccacggcgctgctgctcgcgggggagaacacgcgcgcccacagcccgcgggacgcgtcgacggtgacatcgccggagcggacgccgtgggcgtccgggcgcgccgcggcggcgctctggcggtctgcgagggagaagaggaagcggttgacggtgccgtcgccgcgctgcacgatgtcgacggcggtgacgagggcgaagagctggagccgcaccgtccacggcaacgccggcggctcgggccgccggagctcgtcgccggccgtttcttgctccttctcgtgccccatttcgccggtttctgtgcgagtcatttcagtgtccagaggacactatatataggtgaaccgattaattttttttggaaataaagggggtgtttagtaaagtttcggcgtgtctcatcaggtattatatacggtgtgccataaatgttcggcactaataaaaatactaattacagaatccgccggtaaaccatgagatgaatttattaagcctatttaatctgttattagtaaatatttactgtagcacaacattgtcaaatcatggaacaattaggcttaaaagattcatctcacaaattagtcacaatctatacaattagttattttttagtctatatctaatacctcatgtaggtgtttaaacgttcggtgggatttggggtgggatccacacaggaccaaaattatcccttgatttttacgtgaatattccaatttgatagtagaaatttgaaataccgtgtaactactcgtactacctagaatttaagtccccagcgccgaatttagcctaaattggcattcatgagtcatgaccatatcgtcgaaccaatgaactctagctgcgttcaaatttgacaaattggcacttgatacctctcataatctcatgtacaggtattttaatgcaattccatacgaccatatatagctccgttgcttctgtttgttttgagtataattagtacgtcttcaatttaagttttatagttgaacacattggtactacgtacgtacaacccaatagcttcaatgcgatatgattttgatccaatctcattattgtgtactgctcaactgatgagcacatagccacacgtttgtagcgatttttctttgtttgattgaaggatataattaattaatccagtagccttttgcaatgatgtgtatctgattatctgatacgtacatttgtggttgtggttaacgtctcaagtctctcgcaacgaccatgcttacgttgatggcgatgcatggctgcctattggggactcttgaggaatatcttcttattgttattgtatatatactcacatagttataaaaaagtttaaaaggatgtattaacatgtaatatatcactttataaatatataatttaaaatttaacttgtacatctcgcaactaaaaacaaactaacaaactatagttggatctttttttgctgagatgagctaaagcatcattttttttccttcacttttttcttcataaaaaacaaactaaagatgttactccgataatttccaacgagacatagtccccattggttggcaagagcttagcggcaaaaataattaatgaaatttttttatatatccattacttatcgacttaaaagctaaataaaaaaaaactacattgagaaaactttgaaattaaatttaaaattttatagcgataggtcaaatgatgaggccctcgtcactaagcagtgggctgcttggacgtgatgcattcttccacgaacgccctgatttcaccaacgagcttccggtgatcgtcggcgaggaactccgggaagaagtagaaggagtggatggcctccgggaactccaccacccgcgccgccttccccttccgccgcagcatggcggcgtaccgccggtcccagtcctgcagcgggtcgagccccccgacgaccaccatcgccggcgggaacgcctcgtgcagttcggcgtcgtcgtcgtcgtctccggtgacgacgtgcgccgccgggtggttccggtcggccccctccggcaggaacgccttccacgacaggtccgaccgccgcgtgttcagcaccggcgccacgccgtcgagcgcgcgctcggattccgtccgctcctcgccgctgaagcacggctgtatgagtatcacgccggcgaggtggacgacggggttatcggtcgtcgtcgtcgtcgtcgtcgccgtggccgtccatcgctgggccacgtggtgcgcgatgttgccgccggcgctgtctccgacgacgaagcaggtggagacgtcgaccgggccgacgtggtcggggaggccggtggcgccgaggtagcggaggacggcctccccgtcgtcgtacgcggcgggagcccggtgctcgggggcgaggcggtagtcgacggacacgacgacggcgcagagcgtgcggcagagcgcgtcgtaggcgcgggaggccgcggagaacagcgtgaagccgccgccgtggaagtagacgacgacggggcgcggcgacggcgacggcgagtagaaaacgcgcgcccagaggccgcgcgaagcgtcgacggtgatgtccgtcgagctgacgccggcggcgtccggccgcgggtcggccggcgcccggcggtcgaacagggagaagaggaaacggttgacgctgccgtctcggcgctgcgtcgcgtcaatggcggcctcgaaaacgcagagcctgagcctcaccggccacggcagtgccacccggcggcgccgcccgtgcgcgcccgccatttcttggctactccgacggttctaccttttcgtttgggagactgataaaaaaatgcaggttcagaaacaaaattcagagaagttcaggaattttatctttcagtgtgcagccacaaaattcagaggttcagaaagtgttgtttcagtgttcaagcagccacaaaattcagtggttcaggaagcgtgtctttcagtgagtgttcaggcaggcacaaaattcagagaagtttaggaattccttggtctgaaaacaactttcaaagtgatatgaaattgatattacgattgaggcctggatagaggtgacatggagttatggagatcgccaattctccgtacttgaagataacgcagacgctatctttgcggtctcacgccgtaggattgttgtgagaagggtgcaagcaacacatacgacatgtgactatatgaggtcgcaatttgtttgtacgcttatcagttatcacatctctcttccttttcgcaaggcaaattcaggtgattcttgacttaagtattgaaaacttaatcttttttgctgattcagtaagttcagtgcgtactatagcttagtttactgaacatttagaagcgtctgacatgggattttgaagtttaacaggagcaatatcctgaaaaatcccagatagtattaggctgattttgaattacactaggcctacactgtttgatgaaaaacagagtgtgagtaaggatgggtaagaacaaggattttctacgcctaaatgccatagcacccatcatttacatacgacttaaatacttatagaaaaaatttagtaacattaattacgatgatataaatctatacagaaacatgcaagattatatttgatctacaactagataaaccaaaataataatcgatatcgtacaacgcagataaaatttattatttttgtttttcatgtgtatatcgaatttagacttacatgtttgtagtatcttatattatcgtagtccatcttatcaaattttatgaaatttttatataactatttaaactacatgcatacacctgagtgtagaaaatacattcccgaatgcgtaactattggaggtatgtactcttacgagtcgtcgactcatacataatttctataccaaatgccttttttttattttttatttttgccaaacacggtacaaacatactaatttgtcaaaaaaaaaacaaactctaaaaatgaacctggacacacatatatccagattaatagttaggattggtttatttggacggagggggtaaacacttacatacgtacccacacttactccttactatctccaaggactgcaccggtgtaaacccactctctatccgtatgaacatctccaaagactgatccaacatctttcagtataaagcgggtatgacacctaccattaaaaaaagggtaaaaatagttagctgcaaatacgaacaccctagtaagtctatgacatgttggggtgagcatgttttcaacacatgaaacttagccaagtgatcttacactcgcttcgtatgaaatgccaaaatttcatcgcggtggcaatgcatgatcatacaactttcatcttaattcatacaactttcacatgacacttagctgtgacctcaatttttcatttttgaattaaaaaccgttcaaattcaaatttaaaactttcatatgaaaacttaaaaccttcatactcaaattatacagttttcaacataaaatcatacgaaacttttaactgcggccttaaactttcaccttgaatcacagaaatcccaattcaaaatctcaagtatatgaagtgtacgacgcgtgtacggtacgaagcagatcaaactctcgaatctcaattcaggcggtggcgcgcgccgccctgttgctctggacgaacaccttgatgtcctgcaagaccttgccggcgtcggcgagctccgggaagccgtagaagccatggaaggcgtcggggaactccgccacctccaccgccttccccttccgccgcagcacgtcgacgtaccgccgctgccagtcctgcagcgggtcgaaccctccgatcaccaccatcgccggcgggaacgcctccgccagctcggcgttctcgtcggtgacgtgcgccgccgggtggtcgcggtcggcgcccaccggcaggaacgccttccacgagaagtccgaccgccggaggttcaccaccggcgccacgccgtcgagcgccagctcggagggcgtcctctcctcgccgccgaagtacggctgcacggggatcatcccagcgaggcggaggttcttggccgtgggctgccacgtggccgcccagcggttggccacttggtgcacgatgttgccgccggcgctctccccggcgaggaagcagctggcgaggtcgacggggacgacgtcgccgtcgaggcccgggatgccgttcccgtcgaggaagcggagcgcgtccacgccgtcgtcgtaggcggcggggtagcggtgctcgggcgcgaggcggtagttgacggagacgacgacgacgccaacgtcgccgcacagcctgcggcacacgccgtcgaacggcgccaccgccggcgagaacagcgcgaacccgccgccgtggtagtacaccatcaccggcatcggcgccgccgcctgcgccgccgccgcgggcgcgaacacgcgcgcccagaggccgcgcgcggcgtcgatggtgaagtcgaaggagcggacggcgccggtggcggcgtccggggacgggtcggcgcggacgctcatcaggtgttcgacgaggacggagtagagcgcgcggttgaccgtcccgtcgcgccgctccaccgcgtcgatcgccgccgagagcccgatcagctggagcctcaggcccagcggcataggcggcggcggcggcgggcggcggttgctctcgccgccggcggccacgtccttgcccatcttccctcccattcgcgagcttgacgaacactctcgttttcttctctcgctttttcggtgtggatttgtgagtcgtgatcacgcaacgctgtttccgaaatgggcacgttatcgccgtcccgtaaatgaggagtacagtgattgtactaacgtgtcgctgtcggcgatgggacacgttccaaaaaaaaaatatttttccatccatttcacatgtatcaatacaaaaccaaaaccaaaagaaaatttaaaataatcatcgcttcatcaaatcctaatacagttatttatctactcctaatacatttattctttacttcctccgtcccattttcagtgtagccatgattttttacgtccaactttgatcgtccgtattatttaaattttcttaaaaaaaattgaaaacataagtcacgagtaaagtgctattcatattttatcatcttataactacaaaaatattaattataaaaatttttcaaataaaacggacgatcaaagttaagcgcgaaaacttatggttgcacttaaaatgggacagagggagtatttttcacaaatttcggtgtgctaacggtaaacgggaaagttgaagtttggaattgagaaaaaagaactgaggccttattttgggataaatgggagagaaaaaaaatttgtcctcaaacagtggaagtactagtaagaaattgctttagtagaaaattgaactcggaattgttagaggacagtggctgtttaggtgctgaacctgtccagtcagtcgtggctgcgcctgcgccgcaagttcatcagtcaattgcggcatctggaaatccatggcaagaacagagctaacactgccaaaagcccaaaacacaactagagcataaaacggtggggttcggaggatgaaactccgactcccctttgatctctctctttcagcttattttctgcagttttcttttgttcgtcgttcaggtgcccagacgcaaaattcataccgtttaaattaaagccgtctgatacggatgaaatgatctgttataagaaagaggaaatgcaattttcagtgttattccaagatgagagtagatcactgaacagaagagcagaggaatgaactcaaatatggattctgatttcagaaaccatgagatggctaaaaggattgtgggatgaggtcatatgagtccgtagagggtttaactgaagatctctgaatattaacaggtgagcaggtgactgacaagatgacgccgccggctgttcttttgcgctgtcggtggcgagcaatcattttgtgcattagtttaaagcttgcatgtgaatcattttcatctaatataatacttctccattattcttgggataagataatccactaataaattggtcgttgaggatcgtgcctgcgccgcaagttcatcagtcaattgcccgatcaactgagaaccgcatgatcactttcaaatagcaactttccttacggcaatttaatttgggtgcatctttttttcttactggaggagtcaaaacaaactgaatcaaagttcagtgcaaactttgctgaaaattgaacccaagttcagtgtataatacagagtagcatgatttactgagcatttagaagcatataacattttttttgtgaagtttaacaggagcattcatccagattccagcctgattcattatattgagagtgctcctattgattcattgcgaagagaattaacatttcccaagcagtggcactaggcagttatgaaaccatcaaacatcgtctgccatttacacttttggtcttgccatgatttgaaattttaattctttgaacactacagaccaacaaacgagaggatatcagctgctgctatgaatcaacgcttctctaaactgcttagcacttggtacccctgcaaaggagacgcagtatgcgataggagtggggtccggagtttaaactccgaacctctttggtctccttttttttttcctcaaggtaattttctacaattttttttcatcgttcatgtgatcagacgcaaattgaacctgttaaaattcgtctgatacgggtgaaatgatctaataaaagaatttaataaattgcaatttgcagttatttcaacaaacggaaggaaaaaaatatttgatgattccttttcaaatggatttcgctgctttgcacttggacaacacctccaatctgaacttctctgcaggatgattaaggtctaaggagtaaggaacaacgaaagggtggaaacgagccggctcggctcgcagtggctcgcaacaaacaaggcttggcttggctcgactcagttagggaaacaagtaaaacttgagcacggctcggctcggctcgtttcctggctagcattcatgttgaaacacctcttcatatatattttataattattaaaaaaaagcaagaacaatcatcaacatgtaaaatttaaataagtttcaattcttcaaaatcttaatggtaaatttcaagttgacaaataatatctccataaaaaaaataaaataatcgatataaacacatgatggtctaggctcgcgagccaaaagaagttgctcgcaagccagctcgggctcggctcatttcagcaatgagatgaaaagaaggcttggcttggctcgttttgcttacgagccgagctaagccaaccaaggttgagccaagcccgagctgagctcatgagcctaagctttttttttttccaccactagctaggagtggagcgaccggagcgagcgaggagacggagtttgtgatgggaaaggggttggagtttcaaactccgacagaccgacatcctttggtctccttcttttcagttaacgttctgaattttttttcttcgttcattattttgatcagacgcaaattaaacctgttcaaagccgtacgatctgttaaaacagaaaacctattttgcggtcattccagtcttccagatgaggctaagcaacgaactgccgaactgctaggagttcttattcggaaaaaaaaaaacgaactgcgaggagtgaggaatacaggaatgaactcaaatatcgattctgatttcaggaaccatgagaggactaaagcctaaaggtagggggaagagttcgcatgaatcagtagaggttttaactgaaaatctcagaacataatggccaaatatttaaagtgaaatgctgataagtaccaaaaactacaagtttcagaattttaatttcattgtcaatttgtaattggtagttggaattgaacctgcctcacaggagaagggaatactatgcacaatgatgctatacttttgtaatctttgtacttcattttagatagcgtagcacctaaaaaaatcctccttaatatttatgtgatttttttaaacttttaattcagctagccatcttttttagaggagttggggacctgtcccatcacacgataatttttgttttctcagatggctgagatgtaaataatttccattattaaaagaaattgaaccatccccaataactgaacagtactagacagttctgaaaccatcaaacactatctgtaatttacacttgtcttgtcatcatgccatggtttgaaattttgattccttaaatcctacagaccgacaagcgagagaaaatcatctgctgctacgaaacatgaatcaacacttcgctcttccagtttgatgattctttttcagatggattttcgcagctttgcacttggagtgggggtcggaggactccgatcccctttgatctctttttttttcaggccatgttctgcattttgttcgtcgttcatgtgagcagacgcaaatttatacctgttgaaagccgtctgatacgagcgaaatgatctgctaaagaaaacaatttgctgcatgaactgaagagcagaggaatgaactcaaatatggattttgatttcagaaaccatgagtgggctaaagtgtagggtggtgaggtcaaataaaccattagtgggttggactgaacatagtgaccaaatattatcggttgaaataccgattaatatcggaaattagaaatttcagggtcaatattactgttaatagtaattggtactgttgaacttattagcgtgctccccaataaaatccattagacccctccccctgatgaagcaaatcagattgattggtccacaacaaggaagaaattaaggcctgatttcactaatgatttcgactgcatggacttttgtggaagcacgtgtgtggcggcgttttgcagaaattaaccaatcaagcacttggctagcataattcctttgttgttttcttcctttaggtgatccatcttctttgtaacatttcttatctttcatgtaattcaccaactcttcttataatatatatattttggtaaccctccattgaagctagccttttgcagcctctatgttcatgaatgtacgtacagtaattaacctgtatgagcatcagcatcagatcatcattggaatcaaagcaatattcaagcaacaaaccccaagaaaagcgaagggaatgacaatattatagttgtgcctcagcccctctaagtctaaggtttgcctctcagccaccctaaaatttaaatattaaaatttaattttgaagttgattttagagtttgtcgtagtagtttatttttgacaccggctttcaaattgttaaacatgcatatataaaaaatgtattcacaaactatttttttctttaataaatagttgtaggtgaaatgatggtagtctcactatccctcttgatccaaacaactccagcttgcaaagacattttgccagataattggcatgcatgcagcctaccattttcaatattttaaatagcgggctaagatatttagcggttagcttctaaaactgctatagcgggctaaatggagctataccggctaaattgtacatgaaagcaaatagctagaaccctctcaaacagctatagctgaagaccctgaccatttctcatctctataaatagaagtgcaaatctcgagctcctaatcacaggcagctgcagctagctagctaagcttggataacagtgcaagggcgccggacggctacttggtccatggcgtctctgacgatcgtcgtcgccaccatcttcctgctcagcctcacctcggcgagcgtcgccgtccatggccggagcagcaggaggaggttcgtcaggagctacgacgagccgtgcatggagatgaggctgtacctccacgacatcctctacgactacagcaacagcacctccaactccacggcggcggcggccaccaagccgacggcgctggccaacgccgtgccgtcgaccggcggcaccttcttcggcgaggtggtggtgttcaacgacccggtgacggaggggagggcgctgccgccgtcgctggaggagacggcggtgagggcgcaggggctctacctctacaacagcaaggaggcgttcaacgcgtggctcgccttctccatcgtgttcaactccacggggcgccgcggcacgctcaacctcatgggcgccgacatcatcgccgagaagacgagggacatctccgtcgtgggcggcaccggcgacttcttcatgtcgcgcggcgtcgccaccctccgcaccgacgctttcgagggcttcacctacttcaggctgcagatggacatcaagctctacgagtgctacgtatgatgcatccatccatggtcgtataatatatactccatccgttctaaaatataagtatttttagctatgaacgcttatattttaagacggagggagtaccaaacactattcattattgtcgatgcaaatttcagtgaagatgtgacatctttggtcagggagacaaatgatcagccaattgacaaggtgatctgatgctcctagcttcgtctacctatagatttatttgttgctgctcccatcatcagatcagaccaccagctgtatgagtatatacacagtttgtatgctaaattctttctaaataaacatccttatgcaaatgtgttgataatgaatctatctattatatactaaaagtccattaaactccctataaacactctaaagccaccacgtgagactcctacaaacgctcctagattgccacgtgccgctttaataaatcttacaaattctaagaaaaaagcaaaacatctagccatcaattttcatttaatttggtggatccaccaccaactgcagccgccgccccaccaccttcaatccctgccaccaccaccaccaactgccggctgccgccgccacctcacgccgaccctccgccggtggcctccccaccagatccggccgcggcggcccggatctgggcggtcttcactgtctactgcgcggccctccaccgccgacgggagagggagacgaagatgacgaagccccgccgccgccgtccttgcggccgcgcggctttgccgatggccgcttgggcagcggcgatgcggcggaaggaggaggggggggggggagcaggcggcgccggcggtttccgcctcccgtgtcgcccatgagggaggacgacgcgggagcgggcgacgctttttgaactacgccttcttggtagcatgtttaatcaaaataaaaatcttcttttcattaaacaataaaagttgacaagaacattgtatataaaaaagagagatttaattagattgtttatgagataggattttgtaggattattgcaggaatgactccaattttctcctaaacagttaatttatgccattggaatgattttgaaaataacatattataatagtatatgtcttacgattgcaaattttgttcccatttctacttttagaatttcttatatacaaaacataattgtatctatgaaaataaaaattatagttaattatatacatattattatattatgtttttaaatctggtttggcgcaaattaaattgcatggggaaaaacttgctaatctcatcaatgatttttgactgctcagatttgctaatcttctagacaagctcacctccgggatccggctattatgccgggtttcaggagattaagcgattggctaggcgtagatcacttttcttcctttacgactttaagcactccctcttctatagatacatgtaacatcgatctcattaattcacccactctaatttcttataatattttaatagacatgcgaccagatctgtcagaatttttttttctggtaaccctcccttgaagcctttgcatacctccatactgctcataataacatgttacaataccctgcatcagcatcagaaattcagaatcaagcattcgagcaaacagtccaaagtaaagagaagggaataacaatataaatatataaatataatagagtagcctttgcttatatctcactccctcttgatccaaccaactataggatatgagatttgctccgatccaacaaaaagtactttgagttaccagtacctcacggtaccaaatcattttcgatcattggatctaacagtacccattctgtccagttagattcaacggtcgaaaatgatttgataccgtaaagcaccggtaccttgagatacttgttgttggaccagagcaaatctcagaacctacagcaacacattttgccaggcatgaacatgcatatattattccatttcacacctctataaatagagatgcaaaactcgagctccatcacagctgcagcaaattaagccagcaacacttgctaagtggagtggagtagctagcttctccagctagttagtgaattaagctcattaagctgagttaattgcactaacttactactccaagatagcaatggcgacttggtccaatccctccctgatcgtcgccgccatcttcctcgtcatcagcctcacctcggcgaccgtcgccaatggcggccgtagcggcggcggcaggaggctcgtcaggagctacgacgagccgtgcaagaagatgacgctctacttccacgacatcctctacgactacagcaacagcaccgccaactccacgtcggcggcggccgccaagccgacggcgctggccaccgccgtgtcgccgaacggcaccttcttcggcgaggtggtggtgttcgacgacccgatgacggaggggacgagggcgctgccgccgccgtcgtcgctgagggagacggcggcggcgcgcgcgcagggggtctacctctacgacagcaaggaggtgtacgacgcgtggttcgccttctccgtcgtgttcaactccacggggcgccgcggcacgctcaacctgatgggcgccgacctcatgtcggagaagacgagggacatctccgtcgtcggcggcaccggcgacttcttcatgtcccgcggcgtcgccacgctccgcaccgacgccgtcgagggattggtgtacttcaggctgcagatggacatcaagctctatgaatgctacatctgatcattacatgcatgttttttttaaaaaaacaaattgaatttccatttttttttaaaaaaaggtgaatttccatctcgatatatagttgcttgatttgcgtgacgagttatatgcaccgacgagtgtgcaaaatgtatcccaaacacagttttattttccccctaatttgtgtgtgtagaatgtatcaaactattatcgcacttttatttcattcaataaagactaaccacataatcgtgttttgcgcgactttttatcctgtttaagaacttttgtatgtggtctattagtttaccttagctcttaataaggttttgatataagttaatttatttataaagtatctattatcctagccaacaatagaacttccttcgtcccataatataagggaatttgggtggatgtgacacatcctagtgcctctcgagggtcggcgccgaccctaggtgccacatcggcgcaccagatagaccaagaggccagggtggcagcggggaagatgccagcattcgttgctgcttgcaaaaatagttccacaaaaaaaatgataagtattccacaggttgagtttttatatcttaacaaacatactgtttgagacaccagaatccaacagattaaattctggagctctgtctccctattaaccatctgcagggaagtcttattctaccagtcgtcacaaaagttgatacaagctcgaaagtcgagatcaaacaaaaaaaaaccaaccgatccgtagattcgctacataagtaactatagttgccatgaaagtaaaagaaacacaacagctgatgacatttgcactttgagatcggcaatatcaacatcatgacctccttcaaccaagccccatctatcaacctgggggaattaaacaccataagacaagagaaaagtaaatagccttaataaagatagacaatggttgcagaataacctggtgatcttcttcaagtctgatcaattcaattgcctgctcaattcccagcttccctctgaatattgcgagagggattaccagggaatgggctgctgctgccatagcatcaatagatgccaactcaaagtcggtggtattcttcaaaacagtttctacagcattagctaacccttcatcttgctttccaccaaaaaagcttgtgtatacaacaggcttgaagccaaactcagtgtttacccagtctagtatagggtcaattttctccttctgtctttctgcacacacacacacacacacaagaagcataagaaagacattgctggagggaaatgaagagaagacatcgctaaccaaaatgtatggagttatatgctcacaacactatgaattcatatggacgtcattgcatacacagtcaagaggaaacaacttacgataaactcctacagtcagctcattatcatcaggtgaacggcagaataccaaatcttggtggaatttcttcatcaaattatcaattattttttttcgtgtcaatggaactcgttccagtgcagtgcaagcaagcttcataagaggcattgtaaaaggccggattccatctgcttcctatgatgtcaagaaagtttggtatcagtatatgttacataagaaactagaaaatcaaatacataaagaagagacttgcaaagaagttaaattcaaatataattctgggctgtgtagatgagaagcacatcaagtaaacagaattcgttgtaacatctcctgtcacttgtaaaatagatgatgtttgattgcagcaattcagccatgaacatatgttacagttgaaggcagtaatcaatattaattggatgcacacccgtgatgctaatataaccaaagaacaaacaaaaccgattacttatgacatgacagatcttttaattcacatatgcaatatggaagtatagagcagctgactacttcctaagtttacccaccgcaacatataagtacagacatacatacattttaagggttgccatgtgaatatgtgatgcaaatgcaaaggcgcaattgccttatgaagtttgcttttacttagctgctggaatcaacctgataaatttgaatacagtccatcttgtggtagtactattatagggatgataagataagaaccagacaacaaaataactctaaatgctgcattcttcatatcctactgaaacaataactctataataccagtatccgaattaattaggagtcctggtcatcttctttgctacttcccccgtttcacaatgtaagactttctagcatttcccacattcatatagatgttaatgaatctaggtatgtatatgtgtctggattcattaacatctatatgagtatagacaatgctagaaagtcttacaatatgaaacggaaactattctttaaagctgaacaatatttgtagttattctagctgctctagccgcaacagggagaaagaaaagaaatgtaatgccaaaaccacctctaattgcacgatctaaatcatcgatgccactgccactgaatagtacactatggcaagcgagattcactgattgaatagatttaaattgcacaaaatccttccgcaactcattacagttctgggttaaactgaacttacaagattaagatcgacctaagcgctactagtcacccaatttccatttcgaatcatttgatttaccatcttccatccgaatttgagtaatcttacactacagttgagcagcataaccaatcgagggccaatcaaacagaagatggggatcatgacctggtactcccactcggcggcgatggccatggcgagcgtccgcgactgcagcttgagcggccgcttcgccggcgacttgagggtgcggtagtcgagcatcaccgaccacccgttgccgtcgtcggcgcgccgcacggtggcctcccggtagaaccgcttccccaccaccgaccccgtcatgaacgacatcggcatcgccaccgacgtctcgtcccgcgtcgttaccgccgccgccgccgccggcttcttcaggtagatctcatctccccctcccccgcccgcctcttccctccctcccggagaggaggacgcctccgccgccgtccccagcagccgccacctcccccccgccgccgccgcggatcgctgcaggaggaggcggcggcctgcgagtgtcgccgccatgactggtctcgctccgctgtttgggcctaagctgctgttctagtagaggcaaataagtctgtttcgtctccctcatctcttgctcctgtaaatcgtctccctcaactgcaaaaccggatatagcgccgctcccggaaggctttttttgtcttcggaaagtagtgaaaatcaactccttcgatcgttttggaagtggtttctactgacatgacagtttgaccacggtttaacttgctaagtcagtagatgggatccacgtgtcagcgactttcatgtcacctcatcttcttcatcatctctctctctttcgggctcattcggtttaaaggatttttataggattattgtaggaattcaaacattaggatttttttcctatatgcctcattccttccattcctataaaatcctatcaaatacctaaggattatagccttacaagcttattccatatgattcttattatcatgagataagacctcttagaaaaattcctaagaaataagatgcatctaacatcctaattctttaccttccctgtacctttgatttgggaatcctataaaccgaattagccttccatctgtccccccccccccctctctctatcatcaggctcaataactaggcccatccgcaaaatcggcccgatgtttgaggcccaactaggcccagagaaggttcgagacgcgtggagcagcttcgtctccgcggcgacctaaaatcgcgaggactacgaccaaatcacgcaccttcgctctcttttccattgcagagccctcacgcttccgcaaccaccaccgcgtccgtgatcccatccacctccatcgccgccgccgccgcgtatgcgccgccggtgaccgggatccatggcggagccggacctactcgcgcccttcgccgacctccccttcccccccggcgacgatttccccgacttcccgaccctcggggatgacgccttcgcgctggaggatttcgatctcgacgatctggacttcgacttcgatgtggatctcttcccgccggatgcgccgccgccggtgacgacgtcgtcgtcgtcctcggccgccggatcgccggaagcggggacgtcgtcggccggcgacgggggttccaagaacgaggagtccgcggattcgtcgtcgccgtcgaggagcgggagtgacggcggcggcggcaaggatgggaaggatgatgaggcgaagcggcgcgcgcggctggtgcgcaaccgggagagcgcgcaccagtcgcggcagaggaagaagcagtacgtggaggagctggaggggaaggtgaaggtgatgcaggccaccatcgccgacctcaccgccaggatctcctgcgtcacggccgagaacgccgccctcaagcagcaattgggtggcgccgccggtgctggtgccgccgcgccaccgccgccaatgcccatgtaccctgcggtttacccattgccgatgccatggatccacccagcctacgcaatgcgtggctcgcaggtgccgcttgtgccgataccccggctcaagacgcagcagcctgcgtccacaccggagccaccggccaagaaggcccggaagaccaagaaggttgcaggtgttagcctgcttggattgctgttcttgatgatggtctgcgggtgtttggttcctgcggtaaatcggatgtatggtgcagcgtacactggggaaggcgctgcgattgttccgtcacatcatgggagaattctggctgttgaagggccacaaaatagtgtctcaaatggtgttgatccgaaggtacctcagaatggaagcgaaacgctgccagctttgttatatttgccgaggaatgggaagcatgtgaagatcaatggaaatctggttattaagtccattgttgcgagtgagaaagcctcttcccgtttgtctaactatggcgagaagggttctggaaaccaaggaaaggaggagactagcttagcaatccctggctatgtagctccgttagaagctggagaagtcatggattctgctaaaggaatgaatgaactgatggctctggctcctggagatggaagcatatacagggaggatgatgggatgctgccgcagtggtttagtgaagcaatgtcaggtaagaatgctgcataatgtcgcacgcacaccctatttaatttaaatgaacaatactgtatatgccttgttggtgtttgtaggacaatgtggcacttagtgcgatgaattgtttggagtataacacttactatctgctagagctagcgatcttaatagatgaatgtagtgcttattcagtgctggaagtagaagatatctgcatatattacatgttcttttgccgtggtaaagttgtaaacttattgtgggtttagtatgccactcgggtggatgattaccaatataccatgatacataggaggcgatcatagacttttgggtcagtggttcattgtttagtcaccattgtgaaaagctcaatgttgtagttttttccgttgcggtatgctattggagaaggtaccattgcagcatatataattaactgctcaatgcatatattttgttgactggaatgttatgttctgaattactgctaattctgtatattttatgatatttaatttactattgtacagtatactatttatgtacattagtttgacgagtaaattgcattgccggtacacgaacttgtaaaatgctcgttttggtgcttgaatttgtctggtgcatgcggaggaaggcaaaaaggacacaacatggctaatcttattaatttaggggctcattaggaaattatgtaaacatatatctgagaaggtttgctattagacatacacctcttcaataaaaatagaatggatatagtgatcgtagaaaaagataaaaaaaacaaacaatgatataagggttagaaatatatgaaattcatcactttcatgatgaaggataaagtagagaccacatttataaatattgcatgtcttatgtacactcactacacgtatgcacgtcacatcctaatcaacattagcttcgtaaaattaacattgccaagctattttggtcctcattcgcacgaactagacaagtttgtgtatcgaaacaagcatttcacaagtttatgtactaaattgcacccacctaacaagtttgtgtactaccaatgcaatttactcttagtttgaccttataaacttcctctggacaaaaagtcactgatcgaatgaattgattatatccttagctgcctctgtatagttgaattcaaccttacatgtataaccatcacaagtaggtatttcctttgtttgctgaaattcttccattacacatgtcctgtttatggacatatggcacaattgaataatatactggtttttctaaattgtgtagtgaggtagtacttagatttgtgcatatgtgaagcacttattctcttttttgttgatggattagtagagtgatgaaacatttgtgccttgtgatgtagctttgaccctaaccttttaattcctcggctgatagttgttataagtagtttgatgacttggtccttcatttactgaagttaaccctgtctattgattattttccaggtcccatgttgaactccgggatgtgcactgaagtattccaatttgatttatctccaacaacagctgatgcaaatggcattgtgcctgtctactctgggtcagtgactaacacgtcacaaaattatactgaaaatcttccttctggccctgttcagaaggtgaagaacagaaggatttcgtactcagaagccatccctttacgaggttcgacatccaatgacacggatcatttcaaagcaccccccaagaaccatagtcagagccatgctggtcgtaagccagtttcgtccgttgtagtctctgtcctggctgatccaagggaagcgagcgatagggatggtgaggggaggatctcctcaaattctctgtcccgcatcttcgttgtcgttcttatagatagtgtaaagtatgtaacatactcttgcgtccttcctttcaaaagccatagccctcacttgtaatgtaagcaagttttacaacgtaatctgtaacagaacggatctccaaatgagctgactttattgtgcgatgttgatagacatatagagccttttttttttctttttactggattaccagtttattgacaggaatgagtgttggttccttgtctctgtgcttgtgtttccatgcctttgtgatgcatggtcttgtttggaatgctgggatgtcgaaatttctctgaggttttcgcgttccaaggaggcataattcattgttgcatcaccgcatggctctctggttcttgtagattgctggcagttggcagtaaaaggtagtttctttttattactacaacataacttgcatgtactccttttccttttgttatctgtctttcaggtaggtgatttgcgtattttcttgaaacaagtggcattgttttgttctcatgccatgctactcttagcaggatgtcagggatatcattttcatgtcgatgtttatgatcactaccaattgtttgtttcacagatatgtcctcaccacttacttttgttggcttgtttctgttagtttttgcttgtacatatcgtagacctgttttcattgataggaagcaaaacctacagaaaattgttgcttcataagaggatttaagcattcgcagttttttgtaatcccgagtctgaataaagcaaaggtaacctttctacttccatcatggactcacttgaggtgtggttagagagtcttgaccaatgcaacccaggccctagagctgctgacattatccatcctgtcaagtcctgaatacacttttatctgctccttttcatcagaggccaaaagcctggtttagttcccaactttttcttcaaacttccaacttttccatcatatcaaaactttcctacacacaaactttcaatttttccgtcacatcgttccaatttcaatcaaacttccaattttaacgggtactaaacacacgtattacctacatattttctgtggcttctccaaaaagaggatcatgttgcttgatctgtgtgtagcgtgtgttgctcacttgtgtgtgctattaaagacactaaacaaccattgcggatagcattaagttgtgatttgacattccaactgatgattcattggcgccctcgttacctactggactactgtggatccttcctgtgatcatgtcctggtctttctgatcatgcacacctacttgtcttttgtaccggcttactccgtatgaatggattggtgagatccgttgttgattgggattccatcacctaattcgtacgtagaccactttgatctcgtcagtgagacctttgttgattttgtcagtgtttttgctggatggaacactctgttgtcggtcagattattggaagaaatagcagcgctcctggttcaggctgctgtcatagtgctgcctgaacttgcaacatttaggcccggatgcaaatcgtctgctggaccgcacctgcagtaggtgtcactgacatgtgggtcccacctacttcgggcccacttgtaagtggcacctactgcatatgcagtacagcacaggatctccgcactcttaggccccctttgatttgcaagatagagaaaacataggattggagaaaacacgtgattttaaattttggtttgcgtgatagagaaaacataggattggagaaaacgcgtgatttaaaatggtacccttctctaatcatatagaaatgaaacccatgcaaaaataatagaaggccccttaaatgccataggaaaaatgaagaaaaataataaagaaaaggtgagacctctaggtaattttccgattaaaatgaaatgtacaaatataataatatggaaagttttcttccttttccaagtttaatgtaagaaaaaatattttcactagaatttgaattctatgaaaatcttttgccaatccttagtagcttcagatcaagcaagttttgtttaactataacatttttagaacggaaggcttatcaattgaatgatcaagtaataaataataaatttgggaagcacccgtggtgacttcatgacaaccaaggttcaaatcctgatacacgagtcagggtgtgcatttgcaagtatatgagtgaggtatgcgtgtttgatgatatacacgtgcgtatatgtctaccgtacaataacgataaaaaagagagtaaaggtctgttcactttgatgccaggttgctaaaaaaaatagctatatttagtttgctgtcaaattttaataaatataaaagaaaacctaccaaaattttggtaactatactaaaattttggcattaaggttttttttacatcaaagtgaacatgccctatataacaaaatccttccgcgaaattcagttgaacagcatcgccatctctgcacaaaattcagcgaatcagcgagagaaggaccagttccaactccgaagtttacgcggtccacaaagaccaagtgcaccgaaatatgtccccccatgctgacttcgtgctcttcttttagggcccgtttagttccctaaaattttttctcaaaaacatcacatcgaatctttggacacgtgtatgaagcattaaatatagataaatagaaaaactaattgcacagttatagagaaaatcgcgaggcaaatcttttaagcctaagtagtccgtgattagccataagtgctacagtaacccacatgtgctaatgacggcttaattagtctcaaaagattcgtctcgtggtttccaggcgagttctgaaattagttttttcattcgtgtccgaaaatcccttccgacatccggtcaaacgtttgatgttacacccaaaatttttcttttccccaactaaacacaccctaatacttcgtctgcatcttgagttcaaagctgcctctgtgttagccctttgcttagctactaatcatcccacatatttcaaaccatttaaaatccaaatagtcctaataacctactgcattaacgtcactactagagatagtgagagaagataacaaagtgtgttctcgctgacgaaccaaggtgatttcttctatatatattttgcgtttttatatgattttttaagttcgttgctaggttgcatctgctatttttttgcccccaatttttgatggttctaccaatatccgaagcctcaaaaccctatctttgtcactctcctgcttgattctgcctacgcatccgaatcttggccgctttgtaagctgaatgtcgcctgggttttctcgagcggagtaactgggtttggatctttgttcttcttttggtcgccattttggagttgaatctcttcaccgcgtcggacttcttccctctcctggggattctttgtgccgcaagttcttggtgagccattgtttgagcatttcagggttttctcgtctgcgccttcctttcccccccatttttggtgctcaatcctgcttgaggtttttattttttatttcccctctatttagggttcttgatttccatccaattgttgtttgctgctctttttgaagcgtttcggtgaacagattgttgtcattagcacttcgtttgtaggttcactaagtttcttttttttcttggtttcattttgcaagttgttgctaactgcaagaatctgtaacttaccagaatgcagtgtcactcatccacaaatggtgatgcttgtttgctgcggacaaccggaagaagcagaattcggccgatatagtaccaaattgcaataagaaaatggtactgcatgattctagttttgtatctctgatatctgatagcaacaatatttgatcatagttttcgtattcgcagcatccatattcacttaaaagttccaagggagcaccgtttccaccgcgaccgattcttgtcttcctcattgcaatatttggattctatgtatgctacatctcctttaaccagataacactagagaatagatctgaggagaacagtggagaagtgcaggcagaaattcattgccgaaagcctcatcttcctcatgaggagctgcgttatgtgcactttccgaaacctgagagttatagcaggtaattttcctctagagtagaattattatctcttagtacgcccctgttatggatgtgcattttctgattcatgttgcttcaaattttccttcttccataggggagagtgttcctgcaatctggttcgatcctttgtgcttgtatctatgcaacggtcgggaagtggatggtttgagactttgctgaacagccaccctaacatcagctcaaatggtgaaatatttaacagggtggatagaagagagaatatctcatctatcttacagacccttgacaaattgtataatttggattggttcaccagtgcagcaaagaatgagtgcacggctgcatttggattgaagtggatgctaaatcaggtatatttcagcttttcttggtccatgtgaatattagagggttagctctctgttacattgaacttcagaaatcgcacacctttctctgaaacttaccatagtccatagttaccgacagtgtgcactagtcctgttcttgggcaatccagttcatatagtctattcgcttgctaaaattttagaggtatagctagaatttttaacagaactacagggtaatatgcttgcaattcccaatgatatgttctggctgctctttgtagttgtacaacacaaactggtcagctatgattattgatgttggcatttgtgtgttcaatctcattcatcaagcattattgcatgggtaaaattatgcctacaacttacaaagttatgcatggctttgactgccatcattgtgttctccaggggtttatggaccatcatgatgatatagctagttatttaaacaagaagggtgtttccgtgatatttctcttcaggagaaatacattgcgcaggcttatctctgttttggctaatgattacgacagagatgcgaagcagctgaatggaacccacaaatcccatgtacactcaaaagaagaggttatatccatgcaacagtttatgtcctctccttactattttcagttcatatttttcacattgaacatggtttcatactaggtgcacttttgatgaaatatgaccatagtatatttgaatgcatatgggaaatattgtatcaatattggaggaatgactatattgcatttggaaggagccattttctctacatataaaagggctcctcctttccgaacttgtacccttatattaggttatattatagaatatagacaactactggacttctggtatagatattttggtgaaacttaaatcctacatatttccattccaagagaaatgtaacatcactatcaatcatgttggcaaggaagaaaaaaaaaatgaaatgcttatatattttttctgagcaggctgagatattagcgaaattcaagccggtgctggatgtgtcaaatctgattccaaacatcagaaatgccgagaaatacatcagagattgcttggaccacttcaacaccacacggcacatgatcctctactacgaggatattgtccgcaacagaaatgtactaaaacatattcaaatgctgtaacgaaggatcaatgataaccctcgctttgctaaaatatcatctctatgaatgcaggcattgttccaggtacaagaattcctcggagttccggtgagaaagctggtcagcaggcaggtgaaaattcacactagtcctcttccaggccttgtcaggaactgggatgatgtgagcaacaaactgaatgggacacagtatgctcattttcttgacggtgcagattatgtcaggtgatctacatggatgtgagcgacaggattttttttttcatatggggttttagttgccatatgattgattcttttggtacaaatgagttggtaaaagaaagggataacgataaatagatcaagatgagagaccttgtgatcaaattgtacatgctttccactactcattaccttcagagctcaaattgcaaatatatgctcaaaattgctgacagttttgtgatggttattttgtgatcaaaggaatacactattttggttcacttggaagaatccgaattaacgaaatttgtagttttgttcacctatcaccatcattatattactcggtctataagccgtagctcaactaataactttgcaaatgaaaggctaaaccacaggagacagcaacagaaatgcagtctcccagttccatttttcaggtttcaacactccagtagcagtgtacactttcgaaatcaaataatgtttcctcgcaaaaaagaaaaagaattgaataatgcatcatgcatgattgccttctagcctaaaagagggaataaaaagcggggaatgtacccaatagttagtacacgaaaaaatggtcgcagatcaacaacggattaataactcccgtaaattcttgtacaagagcaaaaacaccactcaaaatcatgtttacaagttgttacagctacaacatcgttaagggcaccagctaatggtgtgggcatcttgacagtggcagatcattgacgccttcgcttaatcctctcaagggcgccaagctgctcattctcctgggcaccagagctttcctcctccctgttctctgcagctctcttgccgagctctccaaacaccgcagcgggaacactcttctccgcaatttggacatcgtcttcctcctcgtcgctctcatcgggcagctcaatgtcctcattgttagtagcagcagcctgttgttgcctgctgctgctctcagcctgtgcctgcactccagcactgacaaagttcatcatccggttagcaggagcagtagcagtgcttggagctggtggagccgtggaaggtcctggcgctagttgcctttctaggttagccatctcatcctcaggaacaccggctcgtttcagagtgtcaactgcctcatcgaggttcagcctctggtccctctgcatcaagtactctgggagtatgaaatgagtctgcacatgaaacgaaatacatcattttagtttactaactcacaagatgatcattgataataccaaactgcctataaggttggcccttgtgacatacctgactgcggctagcagccacagtacgcttgatgcgaagcatctccctgaatgtatcttcgttaccatgctgaatctcaaattcattccatttattccaaaattcaggatgagagtttggatcagcatagttggatgcgtggacataaatggcacgggcacgatcaatttctccaaggtttctttcaagttctgcaaatttcatgcacattgtcatgacatctctgtctgggagtccagattcaattgcttgctgcagcacaaaggaataaagttagaatcatttacagttgtgcatacctaaagtgtgactcaactaaaatctagaacatactatacagaaaaatagtatctggatttttcataagtatatgggttgttacagcgagtgcagaatgagttctttgattcatacgaacagttagcaaaaaaaaaaaaaaaggcaaggctgttggaatgtaataaaacccacattaattttgtcttaaaacagcaaaatgtaaaactggatctcaaaacaagcacacgatataaccagtattagtaagaaccaagataacacactcacctcatatatctgtcttgttcttggaacaccaaatagctccgcagcccgtgcaatatatatttcgtacatactcatcttttcgctgttaggaacagcccttacagcttcgtcgtatacattcattgcacgtttcgcaaggccatagtcttcctccagcttagcatactgcaaatacaataccttcttttcttgtggaggagcctgatcaaacaaaacaaaatgtaagtactgaagcaatataggaaaaacatcattttcaaaacagcatcgatgcaggaaaaaggaacacgaaataatcaaccaaaggtttggaatctaaacaagcaagcaagcaaatgcaaaatatcgcatgacatgatatcagcaagcagagacaaggttcttaaaggaagaagaaagcaggcgcaacaagaatcgccctgaacttattcgtatgaagcaaggacaaaatttctgattgccagttatacccaaaaagcatttggtaacatgttaactaaaacaagtcccaactccaactagattaaacatgattcaacttagcacattttatccggtgaacaagaacagtacttagggacacatgcattcagtgtttcaaaagttaaatgtagatatattcataactactttcatgattttacaaaattattgtgttgtggagatggtgtctctatccaaactgttactcttttgtgactacagcagcatgccacaaatattgcttacatgcaagcattgcatacaactatatgtaagaaacatgtgggtgaaattctagttacctgtttgacagcttcatcgaacagttctcttgcccgctctaacttgcttctctgataccttcttacaaactttgtgaggtaggtcacccaaatgtctttaacatggggatatttaaaaattttcacaccacgctcatacactttaaacgcatcttcgaaatacttgttttcctgtggaaagaggaaatgtcatgatattagcatatgcacgataaaatagtttactcgaattttggaaatgcggagttaacaaataatcctacctcaagaagatatgcataattgagaactatttggggagtggcaattcgtaaatccaatattctctcataaactgcacgagttgattccaatgttccaagactttcctccaggtccacatagaagctccacagtttcagggatttatgtactttcaattggacaggttcatccccctcagcagcagctgcacaggacatattgcattactgttagaaaatatgaacagtaaaacacacaacaaaaaataagatggtaaatatatatatatatatatacctcgcctcttaacctcaacagagggttctgcagtagcttgcctcatcagctcaatagccttgtcaaaattactgtgcctcagctccatctctgcccactcacaccaaatactggctaagtggtcaactgccttgtagttcacctgtgttgcttttttaaagatctcttcagcactatctagacgattatgtttctcatacatctttgcgaatgccacccatagagtatgtggttttccagctgccttcatagggtctacggttttcacagcttcaacatatgtggctacttgccttgtaggatccttctcaaaaagtttcaccctcctgcaaacataatcgtattgttagccaattccatcaagtatgagaatggaaaacacaaaagggaactgccaacatactagtacattgctaggctgagaaatgaaaacacctgccactagattgatacattccacagtatacatgttttgaattaaaatttaccacagccacttactgcactaaagaatccaaaacttgtcgctggaaagaaatatgtactacaaaaacagtaaattgcaactacaataaaacagtaaaaatacatagaccgtatacttacaaccatatgtaatagtccagtggggtcttgcattagtcatttaatatatcacctaaaatatgagaagggaccaaactttttgcagtaacagtacatttggtttgctggtttaacatgaattatccaaatcaaaattgttctactaggctggaatattgagatgctactaagttaagatgttgatgttgaaaaaataaacagcatgtacatgaagtgaactaaagagcaaattagtgtttactattgtcaaaacacatgaaaaagaataaatcaatgtgatcaatcaagtgagtctcacctgtgccattcctccacattatgcggattctgtcgcagcaggacactgctgaggagctctggccggcgatccaacagccgctcaaaccttgccagcctcaaatcagtatcatcctcatcattcagccagcaatctgcgaggaatttcttcgacagcttgtccatcccattcttcctgcccgcttcctcttccccctcactccccgcaccctcctcctcggctgcctccagctttgccgcaagcatactctgctcgaattgtgtgtacgcctcaaacaccacgctgaattcctgcaccgtcatcaccgaagcaaccccctcttcgaagacatccctcgccttctcatacaaggttcttctgacgtagtaatcggccagggaggtccacagcttgccaacctcatcggtgaacttgcgaatgccgccccgcagtatagcgtccaccttgagccccgcaacctcatcggcatgcttggtgaggatttcgcagagctcaagccagagctggtgctgggtcttacccttgacggagcggaagccgtcatcgttgagcacggacgcgaggcggtcggcggcctcctgccagcggtttgcggagatgaggaaatcgatgaagtcctcagcgtgggaggggtcgtactggaggtatcgtcggaagacgcggagcgaggtctcgacggggcagcccgggagcgaggcgaggcggaggtagagcggccagatgcggtcgtgctgcgtgacggggagcgcgcgcagcgcgcggtcgaaggcgcggcgcgcgcgcgtgagcaggcgctggtcgagcagcgaggtgaggtagagcacccagacgcggggcatcttgtgcatggtggcgagggcgcgctcgaaggtgttgttaaggaaggcgtaggcgtggtggaaaatggggtgcgggcgcgcgtggtcaaggcgctcccggaggtaggcgtgccacagcttgtagctccccgggagcgccttgagcgcgcgctcgtagaatgacggcgcgcttggcgaacggcgcggcggcgcgggcgacgaggtagcgccaccaccccttgagcttgaacggctcgcgcaggatctcctcctcgtacgccaggtcgtcctccgtcgggtacatctccggcgagatccccagcgcctccgccgccgccgcagacgccgccgccacggccaccggaccccccgcaggcgacggcatctctcgctagggtttagtgctccgccgcggcgaggaggatttgcgccggagagagagagagagatcgagtcgagacggagaggctggcttggcttggcttggccaggccggcgcgtcgttttgttgggccgatgagttggaacccgagtaggcaagggcttgagtggttttggtgggccttcaaggattttgggctgaacttttttacggaggaattgggcttatttggtatttgagtaattgggccgagttttgtctgaaccagagcccaaccgtcagtcatctgcttctgctactctactcaaatatttctttccccgattttggtatacatttgtcaatttttttgttaaaaaaactacaattatactgtatttatatttgactacagatatatagatagtcctttttttcctgaacagaaactttaagttttttttcttagagaagaaactaaagataaaatattactatttaattatgtgattacgtgtaagagttatttgctgcaatgcaaatgttgaagtatagtcgtgctacggtttctttatatgccacagaccaggaaaaacttggcaagagaaaatagggtgcttttttggatagatgtcgaatcatgccgcacctgaattaggcagactgactagtgagtagtgactaccatcactgatacaacaaatcttggcgttggacattatccgtacgagttcttctcaacaatattctcccttggtccaaaaaaaccaatctagatggggatgaaataccacctagaacaacgaatctgatattccatccccacttaggttggattttttttagacggagggagtagctgaacaacgaaaatgttagcccctctatttttttgggataataggcagtgatcccagtatatgctgaataaaagaggggcaaaaaccacaatgttaatgagactagatcctaggtggttgcgcgcacgcgaaggaacggacgacctcctacgtgcagcgggagggagggaacggaaggaagaagaacggcttcgtttttaaaatagtagagatatcacgtacaaactgccagtataccactaaggcgacatctaaatacatttcagcatgctcccataaaacttcattgtcaaggacaagaggtttggtatacttcgaagttcgaaagaaaaccaacattgttacattaccggacttctgctaattaaggctcaatcttgcacaacaattcatctatggaaagaaaaaaggagccattagctcataactccagattatttaatcaataatatgaaaactatatgattgatgatgaccaacaaaatcaatggaaagcctctatcagattcagagagctcacatcattcgtgtgcttttcaccttgctcctgaccaatcctccattccaggagtctatcagaattcagagagctcacatcacttttgtgctttcaccttgctctcgaccaaacctccattccaggaggcgcacgtgcatctgcataatctgcatattgccgaaccaactgagcacgatttcaggtgagcttaacagaatctgttcttgaacaagaaaaccaagaaatgtcactgccaaacttgccaggtcctgatgaaggcaacagaggaggaaccctgccttttgcctgtccacacagagatacacacccaaggccgtgattagttgcatttttttttcaaacttctaacttttccatcccatcaaaactttcctacaatcataaacttctaacttttacgtcacatcgtttcaatttcaaccaaacttttaattttggtgtgaactaaacacatcccaaatcgtctctgcttcttgctctccacggagaagggagatcaccggcgcttccacgagttgctcctcgccggctcgccgctggtcgcctcggccgccgccgccgctgcagttcgcgagaagcacttggggtgctagtgtttgggcccaaatggaaacaactgcacgaggcccatgtagtccggcccaatatgtatagccagtataattcgatcctttatatttgtggtcggaggtggtgagattaagctgcaccgccattttagattagtacgttgtcagcatcggtagcgccttcacttttaatacttacccgtgtctccatcgcaaaatataataagttttgattagataagatacatcctaatattataaatctagatagatcgtttatccggattcgtggtattaggatatgttctatctaatcagaacttcttatatattttgggtagaggaagtacttgctctatccactccaaagaaaagcttagggcatgtttactttgataccattttcaaccttaccaaattttggtaaagttgtcaaaaaaaagtggctacatttagtttgctgctaaattttggtaactatacaagaaatcctatcaaaattttagcaatttgccaaaattttagtaactatgccaaaatttggtaagattttttttttcatcaaagtaaacaggcccttaattctagttatagaactggatgggtgcttatcaagttcatagatagaattaaattattattgtttttataataacaggtctactctctccatctcaaaataactcaatttgtgatagtaatgtaacataaactagattcattgttcgagtcacttggaaggagaaagtatagctcaggaacggaagaaattcttggcgtgcggcagaggaaagctgtcattgccttcgtcgatgatgtgtgctgctaatgtccattgcacaacactgattaatttatcagctcattgacttcaatacattcaagtattcaatcacatcctaaattaatggatacaagggcacgtgtccagctgtcgttggttcaggagctgatggcctggtgctgatcgagacgctagctcagctgcaactgcaagaatgtaaaacaattaattagccaagctgactgtaatcactggttcagaaactgatcctgaagatctattcacatctcaaatactccctccgtcttgagtttttcttgcactgtttgactactcgtcttattaaaaaaattgaaattattatttactagcaaatatgtccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtggttttttaaaccgtttttattttctggcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacgaagtcggaatcgttttgattttttccctttttttggatcggccagatttttttttgcccggtttatttcgcccgatcgattttttttaccgcgtcacatataattccttttactttggatttttttcgccctttttttaccgcgtcgacggagtcggattcgttttgattttttttctccatttactttggaattttttcgccctgttttcaccacgtcgacggagtcggattcgtttttatttttcccctttttggctttttttgtataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaaatttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacatatttgttttttttccgcccggttttttttcgccaggtttttttatcggacttttctttttttttcgctcggtttttttctcccgttttttgacggacgacagaagcacctagagaattttcttttctccaatccaatacagatcggatctcttccagggaaatcagattttttttctccagggaatcggactcttttttttcgctttttttattcattaaacggtttgtctctcggacttttttttccctttttaagggatcgggtgttttttttgccagggacgggtgtttttttcgcccggtttttttttcactttttttttgatcggactttttttttcgtccggtttttttatcggacaaacttggttttttctgcccggttttttttcacccggtttttttgacggacgatggaagcacctcttattttttaagtagtagtagatttattttatgacttactttattatccaaagtattttaagcacaactttttattttttttatatttgcataaattttttaaataagacgagtggtcaaacaatgcaaataaaatctcaaaatcccttatattatgggacggagagagtgtatgtagtactacttaattagtcagataattcagagctgctgctcgaggtcgtcgttgatgtcggtcaggctgatctgcccggccggagagaggtcgtacgtcaccggtgaaacacctgatgacctgaatggtgatgctgctgctgtccagcttctccaacttccgcatccgtgtcatctcgacccatatttgctgtgtgcagcgcattgccaaaaaagaaaaaaaaaacagagagagaccaattgacagatatgtgcagcctgagctgatttgagttctaaactaacaatattcagttcaattcaggggcggatccaacgtgggtgagtcctccctacacccacaagacccatggataccccggagcacctcattcaattttttcgccataaatgataaactaaaggtctctaaatggctggaggttaaagaaactgtgtaattaagcccccccccccccccccccccgcccctggttcaattcaatctcttattcgaaaaaatattcagttcaatcagatggttttattttgtgagttgtgctagctacctcattgcggttgatctcctcgagtcgtcaatagtgagtactcgtgacggtttagtactgatcaatggtcgaagacttgaattttacaacttaatttaagttaattttagaggtttattgttgtactccatttttagtattgtcttttaaatcacgaataattaatacatgagtaaaaattgtaccgtgatttttttcttcatttatatttctatagcttattagctatagctgaaccaatcagagcataagacacactccctccatttactatcgatgtattaatcaaatgatataaattaattagttactccctccatttcattttaggttataagacgttttggtcaaagtcaaactactctaagtttgactaattttttttaaaagtaataatatgtttaacccaagaaaaatatattatgaaagtttattcaattatagatttaatgaaactatgctgatattataaatattactatttgtttatacagaattagtcaaactcaaaatagtttaactttgaacaaagtcaaaacgtctaacctgaaactgagggagtagttttctagaaaatgggataaacccagcctcttcatccaatcggatgtagaatttttttgagaattaatatcatttttatggaaaatcgcaaaagtagtggtcaaccggggaaaatcgcgaaagtaggtccctgtcgaacgggtgcagttcgatagggcgcctatcgaacggccagagcgcgactggcgaggagatcggaaggctgccgttcgacaggtcctgtcgaacagcccctgttcgacaggcagggctgtcgaactgcccctgttcgacaggatatccgtcgaactggcgcagttcgacagggtcgtgttctccatttatttgtaataataattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttttatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatatataagtcaaggacgatcagtgcccttcgcacgcttgctaggtcctcccttcttcctacgcctaatctgctcagtaggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttctccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgcggtgtgtggccctgctctggcgcacgcggagtgatatgaagtccccatgctgatgtgttcaacacgttgtcccccgttggcatgtaagggaagtgtgccgacccagatactccctgcgtggggtgaacataaggcagagtttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctaacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacctattttaacacacaacatatcaataatatgtactaactaagaactaatttaaccatacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaacaagcatcgcggcctgggtggacggggctttaaaccggcctgtcgaatgcccattgttcgacagggtcggtggagggccctgtcgaacgcccccggttcgacaggcctcgcggcgccgggtgatgggccctgtcgaactccctccgttcgacaggtgagcttgtcgaactccagccgttcgatagggatttgtcgactgcccgtcgttcgataggtgccctatcgaactgcacccgttcgacagggagctactttcgcaattttccccggttggccactacttttgcgattttccataaaaataatattaattctcaaaaaaattctcggatgtacaccaccaaagataattagttagttattgatactttcatgcaaacaaattaaacctaccaaatattatatagctctaccttgtcctctctcctactagttcgtaaaatcgtactaccgttctggggtcttgagaaaagaccaccatagaagtttctcattttgaatgggatagatgattttaaaggtgcaaattgcacagtgaggactgattcatcaacctaccacctacctgtgtcacatatttatcattttctcattcaaaccactcatactattttgtcatgcgaaatcccagaataaagtttacatcttaggtggtgtttggtcggagggactaaagtggggctaaactttagtccctctcacagaaacataaggggctaaactttagtccctccaaccaaacaccaccttattcctgtcttatgctaatttctggattttagtgagattgaagatgtaccgctaatttctgtcttatactccatccgttcccgattgtttgatgttttaccccctaacatttatgcatgaataattaacgttttgacgtattgcttgtataagtgccactacttaattctatgcttaaaatatttcctgtgtggcttactccctccgtaaaaaaagaaaacataacttaaaaatgaaatgtgacacagtcaactacaacgaatctgacacatcatatcctaggttatcttttttttttaaaaaaatggagggagtacttggttggtgccatttgtgctaattccctgattaaaatgaccacatacaaccaataccaataataatttaggataatttattaattttcacctttagctgatgtagctcaccaattatagaacgatcaacatattggacagaggaagtaaaacatatattcggaagcacattcatagggatataaatatgttgttgcgtgtgtgcgtataagtctaccatgtaatcgaaaaaaataaagaaatactgtattacgtgtgtagtgcatgtgagtttacggtgtaataaaaaaattccatcttaaaaaaagaaaaaaaatgcaaaacgctgcataataaaactagtactactagtactccataaactaaagatgtggacatcacggagaggtgggtcccacggttcaatcagggaggccaacacgcacatggccacatgggccatggccgctggtgttagctcacggcactcgtctgcgcgcaacacgtgtccccttcccccccgcctatctgttgcttggcggtctccatgtgggccccgcgcccttcctttccgtgtctcggataagtgggcccacgtcactcgtcccaccaccacctctaacccacacagggccccacgcagactagacaaaaccatagttattgagaccggactggtaatcgaaccggtgaggctgtcggttcaatggttcactggttcaaccggttggatcggtggtctaatccggttcaataaatactaaatacattgatcattcagtgtaaacacaaagagccaagtagtctggtggtggaggagtttaactaactcccacgtggtcgtgggttcgaatcccacccacgccaaccaccaccaggccggttcaaagcggttttataccccggtttaatagcggtttttaagcaaaaccgggcggtctaaccggtttatagccggatcgattgcatgccggtcttttacctggaccggaccggtggggctctggttctggttttttccggtccgaccgccggtccggtccggtcttaataactgtggacaaaacacaaacaagcaagcactgtagaagctaatatcttgggccggccaactgctcaaaagaaaagaaaaagaaaaaaaaaagaaaaactgatattggtagtcaaagtttattgttcatgctgtcttattcataattggtgctattacgagagaagatttgcaagtgttcgcccatttgcacggatgctttggacagtttgtctgacgaaaaacagctgctgcagctttgcctgttttgcgagcagagctttctatggagtattatccatcacattcatatatactcctctgctactccctccgtcccaaaaaaagacaaaccctggtttccgtgtccaatgtttgaccattcgtcttatttaaaaaaattatgaaaaaaattaaaaagataagtcgcatataaagtattcatcatgttttatcatctaacaacaataaaaatactaattataaaaaaatttcatataagacggacagttaaacgttggcacgtaaacccgtggtttgccttttttttttgggacggagggagtatgctgcatttctctctgcattatgtgtgtgttccctgatttccatgtcggaaatgccagtgacacttgcattcatctgccatcggtttttggaacaaccattgctgtctgtctgaaaaatgcagatgcagagcttatcctgaacgaaacgacgcagcagtttttgggtttccagccgctgtttcatcaagtggccgagcaagcagaagcagcggtttgtgaatgaaatccacgcgccactcatattcatggctgatcctgaactgaattcaatgtgtcccacagcttagcactagcttatcatgcaccgatcgatccagtcagtggcggagccaacgatgtcatcaaacccaaacgataatatgtatttcttacttattagtaatggcggagccacgttcaactcaagtggtgcacacgaatcccagatccaaaatttcttacttaagaacactaaaatgtgcagtgctacattgattttttttctaggcttttaatgatgagaaaattccctatctagcatcagaaaaaaaattgctcttccctctatagcacccaactttcaaaagttccctatctatgcaccatcaaaatttttgttccctatctaacacttccgttactcccgttagcctccaccgtcaaaacaatcatggacccaccctcaggaatttttttcgtcgctctttctctaggacagagcgcgagcgcgacctgctttccccaacccgcgtgcgcctctcagcaaaaccctagatcgccgtcgcccccatggatggagaccccccgggcggcgaggacggcgaatcagccgtgcagcgaggatggcgaccccctgggcggccattggcgccggcgggctcccccggacggccagcgccggcggcacgggaggccatccctaggcctgctcggccggctaatcccaggcgggcgcaggacaggcagctcatggccacggcggcacatgcaggcagctcccaggcgggcacggacagcaaccccctagatggtgcgggcaaacagtccggcatggcgatgaacacaacctttttcttgcttttgccctggatgtgaatttggatgatttggatggttatggttatctatggatgtgaatttggatgctctctaaaatttatttggttcattattgtgttgcaaacatgctgttgttgcagacatgctgtcaaatttctctaaaaattttagatatagaaaggttaaaaaactgtgaacaaaatgaaaaaaagacgtacagacatctggacactaaatgaaaaaaaataaagaacaaaaaaaaattgtgaacagagagagggaaaaaatgtataaaatacagaagggcaaaaccgtctttcctcatgcaacttaacaccgtcaccctcaaaactaacggaagtgttagatggggaacaaaaattttgatggtgcatagatagggaacttttgaagtttgggtgctatagagggaagagcaatttttcttgatgctagatagggaattttctctttaatgatagtgcaccacctctgtttggacgctagcttcgcccctgctcattagtaacattttacaagtattttcgataattaacaatggtgatctcactaagatatctgaactgtaaaaggctttagttagttagttttagttagtaatctgttcttgtcccactacaggcgctgaagcttttggttaccatccagactttgagtggactaagtaggtcggatgcgattaacaatttactaattggatatctgaagagagcgatcatgagtgagcatatcgcggtgcagtgcagtttgcatctttgttcaggtcgctgtccatcgattttaatttcgcacaagtcaaacccttttaaaacaatgcagcatagtgatcgccgaaagagagccatgctgcctttactgccaagttaattatgatatattattagcactagagttcatgccagttgacttgaggttgtcagattttaatcgatttggtgctgatttgtggcacggatcatcgcagcaagtcaaagcaaaaatcgaaaagtaagtttaaaaaattttcaaagttcagtagagtaatgggtgggctaggatcacaggggacacataatcgcgtgggaaaatccttgaatattcggcgcgaaataagggatccatcgatcagtagacgcatgatcttcatgagcttgctttgaagcaactggatgctgcccaaaagcaacatttccggtgcatgatctccagttaatttgatgcatgggtttcttgatctgacagtgtttttttcataaaaaaattggaagagaactggatctgatgatatgtgtccctatcttgagatgacgtgtatgtgtctgtcaatttcttgaaacaattttttttttgccttttttacattcacagaggcattgacttggtgtgtacaattagctgcatctgaaaagagggggaagaaatgtgtgaaaatctttttttttatctacctgatagttacacttgcgttgctgtctgaattgataattgcctaaaagtcaggtcatgtgtgctgaaactgttagatggatctccctccccttgagcccaacggctcaagggggccttgacccgcgccctgatcgggggcgcccagcccaatggctggtgggcccccgtcacactgtgccatataaagaggggtggaggacgggacggcataacgacacaaggaacgaggttcgtcgccgccgccgccactccacccaaaaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacactaacaatggtatcagagcaatcctagcgtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtggggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgatggcgccgccgtgtcgccatgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccaactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtattttttcatgcaaattacaatagaattttgaattgtcttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatacgacacagctgataaagcagcttgttacagagaggtaccatggaggtggtgtaaaataccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcttgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactacgcaaagaagtgaaagatccattagagttgccaatggagttgaagcaaaagttgaggctgttggagatcttcgcctagaactcgcgaatggcttcacacttttacttccagacgtttttatgtcccttctttgcaaagaaacttgataataagtgtatccaaattggattttgatagatatgattgccattttggaaatggcaaatgtgaactatggtataataatgaatgtattggtcttgtgttgcaagatcagctttatttctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccatatgagctatggatcctccgtgtgtgggggagtcctgcaaaggataaagtatttaacccaaaacagtaagctgccattttattggctaattctgaaagatcaaagggtcatcgtttctactgtccaaacagttatacaaagtttgtagaaacaagacacgtcgtcttcttggaagacgaaatgattagggggagctcggtaattcgagaaattgatcttgaggagaggcgggtgtctgtacccgctccgtcgactcaggaacctttctaatgttgtgccagcaatgcatgacgttgcggtaccaacacctgttgttatctctcctgtggcaacaatgaatgaaagtgaagaacctattctacaggattcaacagaaattattgccacatcagaggaggagctgcaccagcctcaaacatataatgtgccagaataggaggcccctagaaggcctgaaagagtcgcatatcgaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaaaggcttcacgcaacaagaagggattgattacaatgagacattttctccagtctcttgtaaagattccttcaggattataatggcactagtggcacattatgatttggaattacatcagatggatgtaaaaacagaatttctaaatggtgatttggaggaaaaagtatacatggcgcaaccgaaaggttttgtcatgaaaggaaacgaaaatatgggatgccgtataaagagatccatttatgggttaaagaaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaaagtaatccaggcctagagcactggaaattggtatagaaagtcttgcgtgattgcaaggaacaaaaggcctcatcatgtcttacagaaaagcagaatcgctccagatagtggggtattcggattctgactttgcaaaagataatacaaagttaacatcgggatacatgtttaccctggcagtaggagctatttcatggaaaagctcaaaacagacgaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtctgggatcaaacaatcagtcttgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaatggctcaagggggccttgacccgcgccctgatcgggggcgcccagcccaatggctggtgggcccccgtcacactgtgccatataaagaggggtggaggacgggacggcat

SEQ ID NO: 71123 - DNA, 11947 bp, Oryza sativa
gagtcattctaatagtcaactcacaatcaaagctaggttgacttggttacatccaaattagttacgggaggggagggatgaattatgaatagattagttgtgtagaacacctgggccgtgatttgcagatgggtcgcccatcagccatcccctaggtaagggactcaaaatgaacttattcctccccagaacatcaaacaaatctttcttccctccctgtgcgtgcagaatctttggcccatgacgtgatgccactcccgtcaccgaattccacggtcaagtcgctgccgtttttgtcaccactccacccgcaaaatctctacgcatcctcccgatgatcgatcgctatccccaacagtctcacacacaccaatgctccagtgcagcagctgccacagtagcagtagcatggccttgctctgctactatacaaccatacaagccatgctctgcaatgttcatctatccatccatgcgatagataacatctagtatctatctgctcgatggatggacacgtggtgatcactgcgtagggtttatttggggagcttaagattctaagaagcagctggttggtaaccagtttctgagaatatgaaaaaagctaggttttccttgcatctggcttctagttcattttctggattctacaactacaacttcttagaatctagaccaaaagctaaactatttgggaaagcttccgattctgggagaagctgcagcagctagaagctcccccaaacatacccgtacagtgccatgtggtggcacattggatgcaacgtgccatggcgaagcggagcaggtgtgagactgaaactattgtccgagagcgttcttgctcgccggtcgggcctcgattgggcaatcggacagcgcgtgcttcatcttcaattgtggcctctcacttgcttcctgcacatggcatggcctagctgcagtagcagcatgcagcatgcaggaggcagccaggtcgtcctcatcaaactgttcatctcctcctgcttccgtgctccgatgccgctaaaatctgccggtttctgcattgcttttgcacaggtttttcttcagtgttgttcatcgatccagctctgtgcccggcaggcaaaatcttgccacaatctctgcacttttgctgtgtttctatacttttgcaaaatttttgtcttggggatttggagaggtgtgcaaaatttttgtcttggggatttggagaggtggcagtgtagcaatgtgatgacaatgcattcatgtcgtggagaggagtctgttgacctgctgaattttcataacaaaactgagctgttgtcttattgaaaaaccggcatgtgttatatactactcgtatttataaacttgtactcggaagaaattattagcactgttgcatataaaaactccagcctccaattcagtttcccggtgtgatatcctttcacatctgttcaaaccagcaaaaattcagaatgaccaatccatcattacgaagcatttagcatgagcaccgcctgcaagaagaaaaaaaaaccaaaaaagaaaatcaaatttgcagattaggctgcacatgccagtgcaggctaatccattcacgacgatgatctacgccgcctttgcttactaatttttcctcctggacatgtgattgacacagatataagttgattcctgacacaaatgattccaacttccatttccaagtagtagtagtaggaatcaaacaatgtgataatgcaagagttagttgcttttaagcacaagttaagctggtgctctaaaatcttcccaggtatcatcatcgtcatcaacaacaacatcgtccccgtgagctcagccacagtgtggcgcagttgtcagctgtactggccaagatttctgcacatgggagctgctacctcctgtcaattgatgatccatgctttggccggcccacggatttcgtttttttttgtgtggcaatttaacatcctcatatgctagatttttcttaggccaatatggtctctctctctctctctctctctctctctctctctctctctctctctctctctctctctctctttgagcaatgaaaaagatttgatggggatatttgatgaaagcttaactgattactattaaatttataatgatcattgtgcgtcttctttctgctggaaggtattgaaacatttatagctttctctctctcttttgttgatgagtacgcaccaatttctgagatagtaacagtgaagaacaagcaacaaaatgtgagtgtgagcttaaccaagtgtgaaaaattttcatgtcaatctctctcacaatggtggttggtgaaaggctgaaaggggggcaaatgcgatgatagtccacagtagcactatcatccctgtcagttttcactcatttgtcaacttgttttcgctgaattttggcagctggaacattcacattaagacgttgatacctcgatcaatcagagcataatcatgccgtacagaagacattcacagatcaaatacgggcaagtaatctgatcagcttatcatctcgtacggcaatgcattcggacaaaaacgcgtaactcacggaacggatcaaacaaggtcagaaattccggctgcaattctcctctttactccactctgcaccacgatccaagaaacttagtacaagttggtaccaatcagtcaatcaaactgtgtggtttgatctgaagaagacaagctgacgacgacgatcagcttaccactgtgccacgctgccagtgctctgaattcagaaaacacagcaatctaacacagcaagaatgctgtgtactctgagaatggctgatcttggaaatgtggcacatgaaaatcaaccgaatcagcaaaagaatccaggggagaaatgcaaatgcaaggacattgctgattaattccctcggatcttggatgaagcatggcaaagttcattcagttcaacagattttgcattagcaagttcaaccatttttcacatgagattagccttgcggcttacatgtatcatcgacaactcatcatatccctagcaaaaaaaacaagagtaaatactgcattaccactagctagctacagaagctagagcttagatctagatggaaagaagctcaaatggagaagaacacaaaaaaaaagaagagggaaaaaataatatcccctaattcccaccaaacagcaggtgctaaaaaaatttgagctgcaggagaaaatgcggcgaaatccccgtcctacccccaccaacccattcggaggtggagttaaccctccctatgtacacacacccacacaggggtaggtcagtaaaatgccagcagctaaagcaattgggcgctgcggctgctgctgcggatttaccgtttcaccctggggcaaatgacaactatgccctcgatgggtaaagcgtaaataccgcgagcgagaagggcaaaacggggagacggacggggaaggggaagaaggggggggtctctagtagtagaccaggccgccgccgtcttcgtcgtcgtcgtcgccgtcgccggcggcggcggcggagaggcggaggaggagctggtggaagtcggcgacggggcaggggatgcggagcgcgcccgggtggccgtagccgtactcctgggcggcccgccggagcagcgccgcgaacgccggctggccgaggaggtccgtccgcacggcgtagcgctccacgggcccgccctcctcgccgacgcacaccggcacgtgcccctccgggacgcgcgcgccgcaccccagccgcctcgcgccggcgagggaggaggaggaggacgcggacagcttcgccgtccggtcagcccggagcggctggtacgcggcggcggcgcaggcgtcggccgcggcgacgcgggagaggcgcctgaggagacgcttcatgatggctgcttcacgtcgaggcttggcaatggcggcgccggcggcggaagcggaggcggcggaggtggtgggttcttggagaggcggaggagggtacagttgagaggacgcaaggtgtttgtactggggtggtggtggccatggctccttcttatataacggaagatatgggagttatgagttgccaaagtctttttgtgattttttttttggctattcctttcctcctctcctctctctctctctctctctccgggcctttacaaattcttttgtccagaatgggttgtaggattattaattttgtgcacctgctttggggacaacttcagattacccaatgatgacatattctgttcaccgttcgtgggaaatatgtataaccgctagttacgcacacgtgaagattattgtatataattaaatcgctaacgactaataaatatattttattggattagtatctcttgaaatcaaccgttgactttattcttcaccattgctctaatatccctacatcaagcaattaagcaattaaatatacctaatggttttttcagcaagaattttgtttcaataaaaacctaatcaattattttttttaggtggtagaggatttattggtttggctttgtaaaaatgcacataaaccttgcccataacattgatagcatattcaagctatcaagacacatccaatcttcaggtcaaattgacatatccaatcttcttccatttattttcttaagtaatgaatataaatctgacatttatattcacaagtggatatacacagccaaaagataaaaaaaataaaaaattggattggactaactcgatagttatgtcatcatgtatctactaatgcgtcgtaatctagttgacatttaaggtttttaacatatggagtatatgagttgtctcgagtatgtcagatttgatagaattcaaaattgaagggaccgaaaaccagcactagtagatgctcatcctatccgttgaaatttgtaaagcctagcatgtatatgtgtttcccacaaataaaagaaaaatgccgattgatacaaacctgggggacgatgggcgtgtgaggttagcaaaacatgcagggaaagaacgtggctagggggaggaggtacaagtgcgcgtaccgtacgagtacccggaaggtacaagcggcaataagccggtgaggtgtgggcccggtcgggccggtgccttaactagcacccggtttttctccggctggaccctgaccgaccggccagtcaggctccgggtcgggtcgggtcgggaccgcttcgcgtcatccgtgagtgagaacgtgccaggcggccgcatccttccgtaacaccggtcgtacggtgtgcgacgacgaggaggtgggagaattggtgggggtcactgctgcagtggggcccaccctactgacctggcacatggaagagagagagtgagtgagtgagtgagcacttgacttcgtcgacttctccttttggtcggaaatgcccacgaccagtgatgagtcaccttgtgaaaactttgttggacagtaataaaataacaaaagataccctaaccgtaatttggataatctttcgtttgttgttcttattttatttatctcattacatgtatgtatatattatcccatcgtttggcctaaagctaatagataaaaataagtaattctttatccctataatatttttagcgatttaaaatccaacgctgaaaagaaatcacgataaaaagaaaccctcaaaacaacacctaagttaaattttaacacaatgaaacgttccgttttttaattaacccacatgcataaaagccgtcgatgatgatcgacttgtttcacctgtgtttcggatgcagttgagcacacactaccagttataccaccaggctgaactagctagtgccttttttgtatggacttttgtgtggagaaatcatgaatggaggccaccgtcgtctgtacgtagtgcacgcgtgaaaactaaacacagcctagcgccagtgttaacccatcatcacacgcttacacgcgtggagtgcatgcgtaggacgtgcccaattaattaattaacctaattatacatagtatcaagtatatataaaacagcatattccctatagctagtatctgttcaccgtctcaccgaagatatatgtgctagctatatagcttcactagggcactataccaaacccggccacacaggacatgaagtttgcacggtgaacgattgatatactatctcatcccctaaatgtttgacgctattgacttttttaaacatgtttgaccgttcgtcttattcaaaaacttttgtgaaatatgtaaaactatatgtatatataaaagtatatttaacaataaatcaaatggtagtaaaagaattaataattacttaaattttttgaataaaatgaacggtcaaacatatttaaaaaagtcaacggtgtcaaacattttgggatggagggagtacaaccatatactccctccatttataagtatttgacgtcgttgacttttttaaacatgtttgattattcgtcttattaaaaaaatatataattattaattctttttctatcatttgattcattgtaaaatatactttcatgtatactacatatagctttacatatttcacaaaaaaattttaataaaatgaacggtcaaacatgtgcttaaaaagtcaacggtgtcaaacatttagaaacggagggagtatataattaagcggcatttgcacacacttcgcacgaaatactagtgcacaagatatagttcatgaggccattcctaacccaagacactagacatagtttccataaactccacataatcaagaaactagtactagacaccactctttcaatgccaaattttttattcatagtaattaatgatccttaaattaaataaacagtaaatctcagattaaatttgtgaaaataggatggacgttgttcccaatagcgtccaagacttggacacactttcgaagagcgtccaaaggtggacgctgttctgggcggcgtccaacctgctgcacctcatcctgctcggtttggatgctcttcggtgctctccccaaccatttgccacggcacgcgaagaaacgccatcaccggcttccctctcctcgggcccaatgtttggattggtgatcgatcttgataaatttgtttgcaggttggaaaaaccggccgctaatgatgtgttatggatgccttggtcattcaatatatcaaaactatccgaaaactagacattgctgtttattttgctttattctgtaaaattatttgtgtgctcaacatttgtacttacagtgctctactttcaaatattagtgaattccattcataccactacctagttaattgtcacaatctgctaaaaaatactgctgcaacatttgactagattgaaaggatatcgcttcattttttatgtggtcagaacttattgtattctgatatgtggtggtatcatttgaatatttttttgaatcgtctgagccaacgcaattgctgaacccgtagcatatatgtattcttctgtgcagccttctagacgctaataggagtaacaagctagagcaaatgactgcatcacattgacaaaattgataacgtgtacagtctgttagagaaagggatgaaggcaaagctatttgcacttcaatagctaaatacaggggcgcagaaaataattaaggacgcaaaacgtcaatcgccgatctttttttttcggtgatagatgaatggagaggaaactcactgacttctagtagccagcagcgtagacttcggcacccagagaccctaaatgcgcgatccattctggctggacacatgacgcgtgcgaaccaggttatggacgttgttacaagcaacgtcccgacctggacgcacatagctacagcgtccaatcctggacgttagagtcaagagcgtccttcctatataggtaaatcccatcccataattactaaatatttaatttaggcataactaattatcacaaataaaaaaatcggcttccaatgcaaacaccactatttcatacttaactttaatgctacttatctcacatggtgtcttgatgttgtgtagaaaccatgtccatgcaagacatggtttccttctcttttctcatttattcacttgccatatcatttttcattctaggtggcagcttatttaatgctatagatcgacatcataatagtcattgggttgggaatggcctgatgcacatatgcatgtttctcgatcgatggaacatttatactgcaaaggcgaaatcgatgcatgcaaatcagcaaaaaatgtcatcggagtatcaagtagagtggcgaatggtaatcatattctccacgttttggaggccttctctttttctacaaatgggcaggcattgtgtttgggggcatatcactagattcgagctatgccaattggactacgcatatgtgtgtcgtgaatgcatacaggagattaattgctgattgacatgtggtcgatcgaagagactaattaacgaagaagatttgcattgccatgtggtgtgactatgagacgtacacacactctctctcaacttttgtgagaacgaaacgggatggtttattttccttagttttgactcatttggcggcggcaggtcgatcgtacggccattgcatagcattggcacgttttcttcttggattcctcttgtttgccggtttggattaattgattaggtttggcagagagtgagagagaggggtaagctagcttagcttagggcacccataatggttatctatacgctctctacaaaatatctatgtcagcatatttttctatttggaaggtattaaatgaagagagagagcaaaactatctactaacttagagatagtctatagagaaaaacgaggcaatgtatgagagagctatagataccacctaggccccactgctggaaaggctcggcttcaaaaccctgtagacatactattaaggtgatttactattaatcgagtttattgctgagatatacatgttatatagagagtaccttactttaccattgcgggtgctcttagcttgacgtcgtacatgccatatgccctcctaatttccatgcaattgcggcgacgaaattaagtggtcatgcatgctggatggatgcatgagcacatggcgtgccgcgacgacaggagtggggctttgattgctagctgatcgatcgatcgatagaccatcaatcggcgacaaatatggcgtcgtacgtcgatctgattcggcaacagtacgttcgaatcgaactccatcatcatcgatcgtcgttgcccacgcaaaaactgtgcagtagctaagctaaaacctagcttaattaaatgtccagttgtaggacgactttactccctccgtcgtaaaatataaaaaatataaaattggatgaaacatttctaccataaatctagacaatctgttcatgcatatacgtgttattaggaaatgtcctattctatctatatattttgagatggggaaatgagtagtattacaaatcaaagctagcaacacggtgtaaccagttaaacgtgtaagctaataaggagaatattaagtggcatagtgtttgcttgtcaatttgctcataaacaattaaattaaatggcgcgtgacagcatacatgcatggatggatcatctcgaaaactaaacaacatgcatatgcatgcagatcgacattgagtaacctccagacaaaagctattgacgggaagacttttgcgcgggtaaagcaagtccgagcatcatgtggcgccggatgcatgttgaagttgaccagttgacctcataggccaagctaggcccaacaacatcgtgcagtcgtcctcgttggtccatgagctgcaacattgtactccttctgtcccataatataagtgattttgagtttttgcctactttgtttgaccactcgtcttattcaaaaaatttgtgcaaatataaaaaataaaaagttgcgctcaaagtactttggataataaagtaagtcaaaaaaagtaaataataattctaattttttttaaataagacgagtggtcaaacggtgcaagcaaaaactcaaaatcccttatattatgggacagggggagtagtaggtacgttctctgtatatatttgtctaggctttaaatatataaaaaacagtgaaaatgctttaacaccgtaaaatatactccctccgtattttaatgaatgacgccgttgatttgttaactaacatttgaccattcgttttattcacaatttttgtgcaaatatgaaaataattatgtcatgcttaaagaacatttgatgacgaatcaagtcacaatgaaataaatggtagctacataattttttttaataagacgaatggtcaaacgttggataaaaagtcaacggcgccatacattaaaatatggaggtagtatatattttacactataagcactattaatagcatatataagcatactctatacatcccataatattgcaatttggaaccggattggatattttaaaatacaacgaatctagacataagacatgtatttgtctgtttatcttgtctaagcatttttaaagataaaattaatcatgtaaaagtctatggtatcatagagtaaattacagatgtactcactccgtcccataatataagggattttgacattttgtttacattatttgatcacccgcattattcaaaaaatttgtgcaaaaataaaaaaatgaaaagttgtgcttaaagttctttggataataaagtaagttataaaataataataataattctaatttttttaataaaataaatgatcaaacagtacaagtaaaatattaaaattccttatattagataacagagggagcagtacatgcttacgcataaacacatgcccttcgatattaacgaaagaaaagatactataaccacgatgagggtaattcagtaaagtcacatgaaacagtaatactccctccgtcaaaaaaaaaaaaagacaaaccctggattttcgtatccaattttaacggtccgtcttatataaaaattttttataattcgtatttttattattgttaaatgataaaacatgattaatattttatgcgtgacttgtctttttaatatttttcatatttttttcaaataagacaccgtcgggcacagaaaacagagttttttttttttttttttttacggagggagtagagatcacgatgagcactgagccgtggcatactgtgcccatgtccgtacagacgccggtgtccgtcgctgggttttaactgcaccaacatctaccgactccccttcccactttgtcccgggtcgacgcggtgggacccacctcttgccggcctttaaacagcagacgactatggcaggtgggtccagatgccactccccgaccgtcggtccgtgccatcctgccctctagtacacgcaatttggagtataatttgattctgaatttcgaaatcagaccgaatttgacagaccgtccctctgcaaggtttgaatttttcagacgcatggcggcacagttacctacccctactccgtggatcggttcgtaggcttggagaattttgaggccgtcacgggcgcagatagagaagaaaaaacatcgtgtggcgcctgaatctgattcattttgcgtccatgaatccatgatgcatccacgtgttgtgccgttttggagagaagttgtcgcaggctggagctgaagccatctatgtgagcgcaagtagtatgatctccaatatgttgcccttaaaaataccatattggattaagtgatgaggtggataagagaagtgaggagagatataatgagccacccctaaatcaagaggcaactttcacataaattttaagaaaaatatgatagtattagagatattgatttttgtgtaatagaggtgatatattgtatgagttaactcttagttcatgagtgaataaaa

SEQ ID NO: 71124 - DNA, 1420 bp, Oryza sativa
agcacgaaaaatagtgtgactcattagaatatgattaattaaatactaacttaaataacttgaaattatattaataagtttttctcaaataacttttatataatttttttaaagaaatatatcatttatcagtttaagaagtgtgcgctttggagaataaagagagcataagttgtaaaagtggtgcaacgaacttagccaagtgtaggatggtccgatggctacgacatgttactacgtaccgtccttgtcgttacaccggccagctaactagagattgttgggcagacaagtgacaatgctaacggcaatgtcttactcaaaacaaaaggagaggagaaaccgcaatgtcaatgcctactaactggcttgaaaaagatggacaatattacacatatgtatcaataacgctcaattaactaaggttgtgtggctgatagatagcctgatatatttacaccgatcaaaggctcaaattaatcaagcacatgcatatgatacacatgatcgatctttgagcaaactagtcgatatatggatgcatggatcgatcgatcgatcgagtctccatcgatccaactatagcaacatgtgcagttttctggcaccaccactagatcgaccgatcatcactggatgatcatcattatattgtacgttgcattcgacggctggatgatgatcaaagattattaggtgcacgtaatcgatcgatctgcagtgatgaacgcaggttcaatcgtgcacatgtgccaatgatccaaagccgtcgctgttcatccgactcgaactcctcttgtcgacccgaaagagatgcttgaccggtgcagcccgacgaatgcatgaatcgtgcaccgttggatcgatcgatcgtccacgcaattcatcaccaatggcgtcagatcgaaagcaaccccaaatccacccatctatcgatcaaccccaaagcacggattaatttgtttgattaatttttggtagttatcaggctgattatgtactgataattaatctccgctgatccggccgtttcagcttaatcatatccattaactgttccggtcagaattatccctgtatttaagcaaaggatacagtactgagcatcattcatttgtactgtcttgaccgtgacagaaatgctttctcggtcaaataattgaattgctgtccattcaaaagggaaaagaaaatgtattttttgtgaatgcacgcgtgtgttgcgtgagaagctagacagtggccggtttaatcaaggtttggttaagttaatatcactccgtacttctcctcaatcctcatcagtcatccgaattttctatatctcaatcgatcgccatcagctgctagcaagtagcaacccagcaacctagctatagtcaagagccatgagtatcaaactgttacttaccactacgaa

SEQ ID NO: 71125 - DNA, 25711 bp, Oryza sativa
atagggagcactactaatactaataccataatttagggttaggaagcttatgcctcaatagaaattctgaagttgaataaaaactcatcttggaaaccatattctagaaatagactatttcctcacacttcaagtcttacacactaccttgcagggccagaccgcctgtaaattctagtatacatttctgcataaaatacaagacctaaaaggacaaggagtttgactgcatatttatcatagtatataaactaacttcctgtgaagttacagatcaatatgataatttggtacgcactaagcagttgatagcctcaatcaattaattaaaaataatatataaatgtaagttcagtatcatgcacatatcaacagccttaacttgtacattgatttagctaaattcacaactattatttacacccgaggtagccaactcatgtttattaactgccacactagcctcatatgtcaaatacttcagccaggaacagccattaaggatagcatatacacaaacaaaaggaacaacatgtttactgtttaatcaagttgtaactacaatgagaaaatcagtccaactttaggggtaagatataatgtgcaagtcagaggaacccatgtatgccatgacaaacctcatttgcgtctttgcaaatttcgttctcgttcttctttggccaattgaccctccagcatctgattgcatcaagttaaatacaatacatgagggcttttataatcattcttattcatcacgaagcttatgatagcaacacactgatacacaaacctttctttaccaagacgacgagcaagttcctcagccagagcctgccctggaggatcagcatctgttgccagtattatcctagacgcctgtttccatggcaaataaaggaattaaaatgatacctgtgtatctcagctacacagttctataaacaaattattctgagataataaaatgcccaccgggtcaagatattctttgcaattccacagatattggtacttcttatcctagctttacagggaacataagcaactgttaggtcgcagattagctaaaactgtaccagagatcaacactcaaactgaagaatataatagtgacaagaagacataagttgtcgtgaatcttgagggacaaaaactttggcaacagcagaaagtagcgctaacctgatctttatctgggagcttgctggatactttcggtggtgcaccatctggtacactgacacaattacggtagccagcttcttccattgagagcttatcaatttcaccctcaacctgccatgtcagtaaggagaacaaacaactaaaaatctgggaatatgaaaacattggcacaaatcttcaggagcaatatgcaaaaagaatatcaagtaacagattttgaacatacaatgataatatctcgtgctcgctttatatcgtccagaccatataaaattttctctgtgtttgcttcctggtatataagtgcaaaaataagaacaaaagaaatatagcataagctcatacaccctaaaaacgagtagcaccacaaacctgtgaaaatttcttagagacttccctgtatttgcagccaacgaggaccccatcacgcctgtaggtgaaagcaataactatctgcaaacaaaatgtacttacaatgctaacacaaagatgttgtatccaaagcagatctacggaaatgcatccatctataccttattactccagttacgctgcattacgctgtttctccgaagtgtttctggcgatatcattctctctgagaagtatgttacaagctgccaaaatgtgattgttttgtagaacacccatgtgcaaaaacttctattaggattcatcaaagaagaatgggaaaagaataaaaacaacaagaaacttttgatgatatttgtacagtaattggtaatattccagcctaaaaaacaatttcttacctcatcgcaaagtggctcaagatggaggtcctcctcacaaatttttctgtaaaccttattgactgccagattagcttcaccatcctggtccgtttcacattctgtattattttttgcttgtgatagtttgagaactccatcaggctgcagagagaacaatagtgatatcaggacattttattaacttcaatctttattcctatatttatttggtaaaggcacctcgacaaaacccttccaaccacaattagctctaaaacattgccatgcagcatttttcctgaagaacaaaaataggagaaacatcagatgagacaggccgtactacatctgaagaagtaaaagttgaagaagggtaaatataaaatctcacccatccattcggatcataacactgaggctcggctcctcagtagatcccccattgcactagtgaacatatggaaagtaatactcatcattgctgtctgatagctcagcatgtaaagtaaatggatcaccaaaggatcatgagcaggtgagcatgctataagtagaaactagtgggttttatgaaccagccaccaaaacgatgatactttatgatacaggggtaggctaatcaaatcagatactagtagaaaacaatggatttgatgccacaatgtctctcatttctcttgatgtcttaaaccacaaaacaattgcttcttatctagctagacacttctagcctcatctttccgcttaagcttatgcttatcagccaaaatttgaattttcaaccttaaatttgaagttgattttggggtttttttcatcaaagtttattcttcagcctttgcttttagatcgctaagaacacgtatataaaagttttattcacaaattatttttcgtttgcaaatatgccatttggcttattccacgaataagccaaacgatggggctcttcatgtaaaaaagggaaacatgaccaataattagagtaattaaaaagaaacgcacaatacctttgggcacatcattcgttgataagtaccaagcctccattgctttggacttattccttctttcttcagtctctcaattaactgtcctagtcgctgctcgcaaccctttttgtagttttccgttgaatgaactgttatccaaagagacacgacatcaacggaaagtatcaccgctactacatccaattgttatagatcacttgcaaatgctcaaactatgacatgtacgccgcctaagaagaacaagtgggcaccagaactgcgaaaacaaggcagacataatgccttggacgaacagttcactcaaactgtcacaaaacagtaaaagcgctccaaattaatgtgacaatttcaactaaaggagtttgaaagagtagaatcaatcaatcaaaacgatttacccagcacgattgattgaaatcctcaaggagttcctggcgataagaagttaagaacacagcatttgggaggattaacagctaaacgcctaaaagtacagtagtaacgagccacgaaattaatcggagacacgccattgagaagcgtattcccagagaccgatctcctagtaaaacatggcgaaaacagtatcgcgcatgttcggagctcgaaagcgagttgttccataccactcctggagcgaacggcgacggggctggcgggccgcggcgcgggttcagtcctgacgcagcaggccacctcgtgcctcccccgccggctcgcggcggagaaggcgtggagcagccggatacggtggccccccgcggcgagggcggcggcggggaggcggcggcgcgcggcgaggaggaggccggagtccccgccggcggcagcggaggcggccatgaggaggagcgactggagggaggggcgcggtggcatcacgaggtctagggtttcgccgcgcggggcatgcggggcgcggagcagaggaggcgagaggggaggggagaggggcttggggaagaagaagaagaagaaggaggagggaggagaggatggagtttggattgggtcgcggaggtttagggttttacacatcggacatgtgggccccaccacctagagatagatagaaagagattgggttttggaatagagctgtcaaaaaagctctcaagctgctcagaaaatctcagagctctcaagctgctcgagcttgattcgttacaagcttgaatactagataagccaagcttaagcctaggctgaggctcgcaagcctagcaagctcgagctcgaatagtttggcagagcttgattagcataagatgcattatatttaggaatatgttcttatggatcaatgtatacttatcactatgcttgacctgcttaagtcttaagacctcatcaatgcttctcaataaaacaattatccggctgctagtaatagtactactattcctattagatgtagtagctagcttttgttaattgcaacgtttcaaagccataaattcatgagaaaagctgcataggcttcattcaaaacgagtagcacccattaattttgactaccgataatttgcattaatatcttttatacaagagtaagttctttgaagttccaccaagtcaagctgtcaagctcaagtaggctcgaagctcgctcgagctcactcccaagctcgatcagtatccaggctcggctcgttgacagccctattttgaaaggttacattcttttctctaaaccctaaacctagaattgattgaatgatgattaagattttcatggtacgctttttaaactgtggaatggtatgtttcgtatgaaaactttctatatgaaagttgctctaaaatatcatattaatctattttttaagtttataataaataaaactcaattaatcattcattaataccaccttattttatataaaaaaaaacttaatcttcatcttcagaagaaaaaaacacaaccgaagataaaaaaaggacaggatttgaaacgtaggtgaaagcggatgatgtagttcgaaaaatagagttgcacggatacgtgagaaattcatagtacaaagttgtttttgaatttacaccaaaaggaaagtttgatttgtattttgaacttgtgctactctctctgttctaaaatatagggatcagagtatatctaagttcatagtaaagcgttcatgaaaaagtttatagtaatatatcccattcaaacaaaatctttttatattttaggagtaagggagtataaacgaaacgccaattcagaaactttatccccaaaaagattaaaaaaaagaaaagctaaatcgcgcgtgggcccaagtagtagtcctcctcctaactcaggctaaatctgggccacttctaggcccagtttaagccttagcccagccaagcccaacaacaacctcccaggcccaatttttgtcgtgcctatatattgctgttgaactcttatttgccttcttgatccggtaccaatttgaatcaccaatcccattgaattcaaagtctcctgctgtttctttgttgaccaaatgacaaataccatacctgcgaccgaaggtgaaagtacattttacgggaccatccgtgatcgatccttcatctagcagctagttgctgtaactttcccaagtcctcgtcgtcgtcttctcccagctaagcaattaagatgtctaaagctgtaggtttaaaacctgtaaaagttgcaatcaatcaagctcgagaaatcttggccgatcgataaatgtactgtacagaacgtatagctaatttctgccgtctcgatcgtcgctttggctggagtagtagctagactttgatgatgcacatccctggttttccaagagcaaatagagtacatctggtcaataggaaacgtgctgtcatgtagccactctattgattcaaagatcatggccgcggacgtcgtacacgagagcggagtcgtcgatctggtcgtccatgctgaccatgtatgtagcagtacggttgcttcctcgttccaaattactttatcatttttaacttcatcttagttagtcagacatttctaacttcgagtctcaaattctaaaaattcacctagtttaacaccgtagatttatacatgtttttggattttctgaacgtacatattgttaaaatatataatttcaatcggtgatactgcgtcaataaatttgcacgttgtatattaaataaatgtcgatcgacgatgtatctatactttcagtaaagttatagtccaataaatctaaatctcaacatgcatgtcacatcgtcacccactagtaacaattgcatatctaaccttgtacaagcatataacatcatctataatttatttaattatacaaatcaacatgcaagcgtatccaatcatcacccctcacattatttgcacgatattttaacaaatttatctattattttataatatttaacatatatttatcaatatatttcacattaaagtacgggtatcatttgttcgttttacgataagtattgataaactctaatgttttattattatttttccttttactcatagtttgactgtcgagaaaaatgtattaatcaagatgaagtatgttcgcgttgcatggttggcgtacgtgttgacaagcatgcatgcatgaatcgatggatataaactactattgtactagtagtggtcaaacaccaacttgtttgtgtctgacaagaaagggaagagaaaaacaatagcgtgttcaaacatcgtcaaaggccaggcgtctcggttatacagacaacttgttgagaacacggacggaacgcccagctgattattcagaactacatgcaattggcaacttgtgcatggctgcatcatgcatatgcttcgcacaatagatgtgcatggagatggtgacttgtaagagggagaacgcgtcatgctgtcatgcatgcatgttgatttgattcagtcctgaatcatgaactcctcacataaacgtattccgatataaaattgatggtaatgattataagattttaactgaatcttgtcctaaagaattcaaacacttatgatcaaagggtacatgataattaaatgtttgaactataatacggagtatattcatatttttgtggtgggcgcagtcgaatttcgagctattcttttatagtttctaatcttacttcatgtattattgtattttcttcgcattgtttgttgtggatgacactgatcgatatatcatataccaaagtctggtgtggaattgaattaaaaaaaaactacaagcctttgctattcaaaatatatcccaaactttaactggcttgctcttcttgcatgcacatatttatttttcaaaatgcaataacacaatgcagctagataggaaaagaatgttgttttcagctttcttttcgtactttcttcaaaaaaatacatatatttatttttaccctcaatttacccaggccaatcccaacccaatacactagatatagtttccataaactccacatcatcaagaaactagtactccactagacactacttttctaatacaaacaccactatccatacttaaaaatttaatgctacttatctcacatgatgtattggatgttatgtagaaactatgtttatgcaaaatatggtttccttctctttcctcatttattcacttgccacatcatttttcattctaggtggtagcctatttaatgctatagacaccatcctagttattgagttggaaatgaccccatactcgttatacgtacgaaaatccattaatgacagcaaaatcaatagaatagaaatgcatgctgaataattcatgaattattattccaatggacatttctgacaggatcatatcgattgcaatcagcacataatattaataaccataggtaagacatggatgaataccaaaggagaaattaaagaccacttgagaagtcaccgagtctatatctcgatcgatttggcattcatcagcactaactaagctactgaatagttaatcaacatcctactataatttttcagaaactcaattgaagagaagtcgatcgagatctctcatctctcatctcatctgcttaatttgctcaattaattcatcaattaatcgagctgagatcgcggttaataacaacggattaattagctcttggcggcggcggtggcggcgtggaggacttgctggaaatggctgacgtcgcagggcacacggaggatgccctcctgcttgtacccgaactcctgcgccgccttctccagcagcgccgcgaacgccgggtgccgcagcgcctccacccgcaccacgaaccgctagccgccgccgccgccgccatcgccgtcgccgccgttgtcccccaccatcaccggcacgcacccgcgcggcacgccgtcgccgccgccgccgccgcccgcgcggtccgagaagctcagcctcctcatcagcccgcgcttcacggccgccgccgcgccgccgccgccgccgtcgccgccgccgccgccgccaacgcggtcagagaagctcatcctccgcatcagctccctcatcgtcgacacgttaagcttgtggggttaccaaccggcaccgattagggtttctgtgttaattagagaggattatttcatgcatgcgtttgctcatcatcatcaaggatcggggcgccatttataaggaagagagatccatgggatggaatggaatggagtggcttacattctatcagaacggctgccacttgttgctagtagcatgagcgtgtggaataatgatttcactgatcagtgacatagacaagctagagagagagatgtggcatggaggtaataatggattaattaagcaggaattgaatggagagagaagacgtttactagtctgtgcatatggttggcgttggtcctggggttaaccttatgaagttggggttcaaaaatgttggctatcatatatgagcatctttgaaagttaagaccgtggaatttagtgattagatgaatgcaataagtagtggcagtaattaattatttaattaacctatgtaattgagatactcccttacggcgggcaatgcaaaaaatacttgataattatattatatcaaataaaaaattgatgtctgatattagttatacggatttaacgtggaaaaccctcttatactaaccacccctccctaaaaaatcacaataatttacgatgactgagaactcaacagaacttacgacacacttcaatttacgaatctctactaataaatatcaattgattagattcctcgcgaaatttcaatttcaactagctagccagatcagctaatcaacaaattcactctctcaactgcactgattataaaataatcccggatatccctaaatttggattgttccacacctaaaccccatgcagcagctaaaagatgattatatggcacattatttaattcaaaccaggaaattcttcttcttccttccggtggtctcagggtcgaaccatttaatttgtctggttttggaacgtgcaagctggtattccatggtgggcttgaaattgttgctgagtgcgacagtggaagggcagagcgaggatactagctacccctgttgacaaacacacacgcaaaatcgcttttaatttttgtattatcagacgaaccaacaaatcagccagttaacattacattatttggaaacagaagatgaataagcctgaagaccggagtaatatttctagatgacatgatgatgcatgatttggaaatttgctaatctattctaaaacaagatgtagctagctatatatagctagttaggtgttagaattttatatgcggaccaaccggcccatagcctagaaacgtaatgctacgtatgcatgataagtggcttagcatatttacatgcatgatttaatttagaggctggttctgtttgatcgtgctctgagaattttcacctagctatagctagatacactctcaggcgttcgatcgatttcgaaggccagggcatcatccaaacacaatatgcaaacagaaccaggcctttggaccgaccatagtattaattaatcgcttcattttctttatttaatttatttattattgttatctttttttttcaaaactaatggctaatagataaatgatttgtgataattattcgaggatagaaacgaaggaattaatattataaagttaaaaatagattaattcaaactatcttttaagaagtatacttttctaaaaaaaatcgtaccatttagaatctcgggaagcatgtgcatttatcacatcgctccattcgtcgaaagagaacaacatgtggccatatatacgcatgagcgcacacgagtgcaaatatgacttcatatatagcgcaattaaacatatatactaaagcaaaatatatactagaatttgaatcctagctactcccccgtcccaaaaaaaggcaaaccctgggttttcgtgtccaactttggctgtccgtcttatatgaaatttttttataattcgtattttcattgttgttaaatgataaaacatgattaatattttatgcgtgacttgtctttttaatttttttcataattttttcaaataagacggacggtcaaacgttgggcatggaaacggagggagtagtttttaaaaaataacacggaccacaagtatcggtcggagtggtccactagctagctagtttgatctgaaacaaggcacgtactccctccgtaaaaaaaaaaaaaagacaaaccacacaatcagtaggctcgatcgctttcgagtggatcaaccctccgaccaacccgcgcacggacgtcggcgtcagatcacggcgcgtgcgacttgactaacgaccttaacctgatgagcgtggtcgccgcgttcaacaactttgcaagctagctagccgcgatgcatccaggaacaagccggtagggcggggcacaggacgcgcctagtactacggctactactgcaggctgctacgtacaacgtacgcaatgcaattctctcaagactgcagcagcttaatcctatcttactataaaattatcccccactaactacttaagcttaacatgcaaagatgccacatcattatccactaacaataatcacatttaaacatcatgcaaacatgctatatctttatatatttttttaatttaagagcttttcaaatacaaacatgttaaattatcatctaacgtaattcacagaatatttcaatgtatatttgttatgttttatgatatcctatatacttatatagttcatcctcacttagttagtgtttaaatgattaatctatggtacaaattatctttctcctttttccctctaattaagtcatatcacatcaattgtttttagcctttagatgattaatctacggtcaaactatctctctacctttcttcttccataaagtcataccaccttattttttacgtttgaatcaccattccacatactatttaaatttaaattatcataaaccacattaatttacttaatctgatgttatctagctatcttacacgttatttttttaattgttatcatactaaattcccgcagcaatgcgcggggtttcacttagttatcctataagtaaaactcatttaattttgatcaaaagtttataaaaaaagtttgtcataagtaacactagattagttttattaattaattagatcccaattgaatatatatatcatatttttatatatttgttttgcatgtagaaaataatgccatgtttttgtttttctgatcagacgtgaagaggtttgacttcaaataaattagacatcaaacatctaattacaacatgaaacaaacggagtgtgtactacttatctagtagcttatactatacttctatctctgttccaatttaagggcaattatcagttttcgtgttcaacgtttaaccgtccgttttatttaaagttttttttaaaaaaatagtcacacataaagtattattcatgttttatcatctaataacaataaaaatactaatcataatttttttcaaataagacagacgatcaaacgttgttaaaccttgtaaaactacaacctttttgtaacggaggtagtaagatttttatttttagttttgcaaccctgccagcgtaatcaactctagctaatacggccagactcggacttcttcatatataaacagtagatttagccatgttacaatactactagtgtcttcaaattaagcataattgaagcacataattatggggttgtcaatttaatctttataaatatatgtactatgtattaatacatttttagataatagaaatggttacatttccggtctctgtcaacaatcacacacacagccaatatatgagtttagcgttgaagaaaaaggaaaaacaaaattgagtgatggaacaagcccccatccatccaaaacagaacagaagttcattagttaccaatttcatgagggctagcaattccatgagtgtacatatatagtaccactgcgcatggtatcctactacttttgatagcatcaaataccaagtacgaagctaattggtagacatgaagataacccagcaattttttattataaaaaattatatcatttcggtaataccaaattgaccatatagtacactaaccacaaataaaatcgattttttttggacctggccggtattaccataaaccaatttccaaataaatacatacgctggcgattgtttaactcgtggcttagatacaccattagaccggtaattcatattcgctagcttgtgggcaccgcaagtggtccccttcaactacatacgaggtgtcttcatgtgtccctgtacgtatatatatacgtctttgtcttcgtgcaccaccatacgtacgctaattcgaagcttcctttcatcttcacatggagaacgaaaactgctagctagtctgctacaattgattttttccacgccattcgttttctcgagatgtcgttttaggggcagtttaatttatccttttttttctatctagtaggagtatatgcgcatggaaaaatcctaatcagtgaacgctctctagcatgaactccgcataaaaaacgatcaaacatatcaacagcttaatttgcattttctttagttccttttctatttttttccttattatattatatagttttatgttggaattgaacaggtgcatcggttttctggagaaaggaacactcaccgcttctttatcagagtttgagaagaaagagaaaaacacctcactcaatattgaataattttgtttcagatataaacatgctatctttaagagaagtttgcgatatgataggaagtttttattgaattttctaattgaaatatctttttatatttttcgaaagtttttttgttacaacgcaacgcagcagctgtaagtctgtaaccagtgctttgttattggctacttttttacggagatattttttttgttgatattggttacttaatttgatcatctttttgagttgacagctacattaattagcacagctgtacgtaccggtactgcttgcaaatggacatcaataaattaattaatattactgcttaaaagaccatgcctagtttgtaataatttccatatgcaatatacaagaattgaccgtagaccaacgggtgtgtattattttcttatcaagccgtagctgacaaccaatcgaaaagaccatgacgagtctacgatgatgtcactctcttctctaaggttaatttccaacaagatgattaggtgaatgataatcgtcttagccatccatccattttactgtttccttctagaaaccacatgagtggccactgtacaattctttttccacatgacaggatgcatgccaattttgactcagcctgcggtgaacaaaatccacatttcctgatgctagtaaaagttcttgaaaataatgatatcttcgttgaatcgaatcgaatcaaagacttttgtttgtccttttcaatctgcacgcttgcaagactggaatttagtacagctggttgcagcaaagataaattaatcaagctaagtacgtagagaaaacatttggccaattgtgcttagtttttgttgtcagggcacaaattagattagctagcttagaagagatcgaccgatcgaagtggcatggtcagtaaaaacaggcttaatttgcattttatctttctgaaacttcagtggtcaagctttttaactgactgcagtacgcctgcctggcctttttttccgaattcgttgaagggtgacctcatgatttatcacatctttgtccatggtgacatgacttcttgaaggaaaaataataatataagtgccttctattgtaggtgcgcatcaacttcgtaaatactttcactctttttaatcaagtgttccgttcagtctttttccagttggtaattaactatgatcaattcattcaaagtagttcttggtgtgtttgaagtgtgattatgtgaaaatgcctctctctttttcttttctttttttttgcagaaaggtggcatgacttgcatcaaggaaaggtgttaagaattccattggcttatgcaagatcgtgtagaaaaggtggcagaaaagtgatttccatggttatacaagataacaagattgtgtaggaggaacttctgcacacagttttgtggtagtcttggtgatgcttaatttggaaatgttttgcaattgctcgtgttattctgttctattaccatatacaaactagctaggcccaaatagagcatgtcaaactccttttttctttaatctcgatgcgttccaactgactccaatattgatctataatattatatgaagcggtgttttacttttagaatcagttgacaagggtattttattccaatattatccgtgacttaacatgaattgatttaattgttagaatatgtgtggttttttttagcatgtcaactatttttatttcttaagggtagctgggtatttgtcccaccacactcttttattttatttaagtaaaaactaattggttgtgtgcattgtggtagagaccggggatcaaataaatcttcattagataaaaacttcttgtctatatgtgttagttacttgggcctaggtcaatattttgcatggattttaggaactagatatcttagatgtcttagttacacagcagcttctgaaagttgttccctatagatcaaagatcacaaattctcaataatcaatagctagccttgcttgaattgtcagtaacatcgaatgcaaaatctaattaagtactaaaacaaaggacataataattaatcgaacaccgtgtggtaggattgacacgacatgcacgagagtacattggcaagcagaaaaaaaaagaatgatgaaaatacgaaaggttaaagaactaaattgaaaaaaaaaactggcgccacaaagatggaaatttgatcatctcaagagggaattcctctcaagaggcacaatgtcgttcctttcaaattacaagtctaataagcccacctgcacaggaagcccatgggcctttcctcctgggccgttttctttccagatttagacacgtccatctaaagtcaagcccacacgcttttagcataacaagcaacatattagcccacaaagtttgcacaattgacgccaatactttatacacatcaataacaacgtgggtgaacttcttcatctatacaacgtgggtgaactcctgaagggagttaagatgccccctattgtgtaacaaagataaaatttcccaattcaaaattaaaaaaatcgagtatatgtcagtctccggctgtggtcgttagcagccgtcgcttcctttggagaattgttgggagtgtagagtggctctgccccattctgctgttttggagtagacttaccgtcgtatcgactttttttttccttttccttccttgttttgttatcattattttcttccttttttggcataggccggtctagttgagtgcatcgtgtaacaaaaactctattcttctaatatattgacgtgcaatctttttgcgcgttcgcgaaaaaaaaatgtcagtctatatacactcgatttttttttaaagtgaatctgtggtaataaaaataacggattggctataattatggcgatagatttttgtcataaacacagtcgaattttcagcattaagattgacacgaagattcgtgctcacagggcatcagcacacacgctttgctgtttttttctgatcgttttattcaaagattaccgaatctgactgttttattcaaagatttatgttgcatgatgattagatactcctatacaaatttacacaatagtttacatcccatttacacaccacttacatatgtaattttaggatttacatacgtaattttaagatttacatatgtaattttggaacttacattgtaaatacactaaaattatttatgtaatttagagacttacaatgtaaatacatacagactattttttagtgaaaaatatggcgcaataaatatagctagtcccaaacttaatccagagacgcttcacgcttgcatgcagccgtcgaggagaaagatctaggtcgacgtcgtcacggcgtgcatgcgacttgtcggacttgacttgggcgcgttggcctgcaaccacgcgcatatgtacgtcgaggagaaaaatctagccagctggacgtgcgtacgtagtgcgtgtacactacggcgctactactacttctcccaagactgcattgccctttgctatctgctaaagctttgcttctaaaatactcccgctcgacaaaattcgacggctaagttgaaatttcgaacgaatcgatagttaggacaattttctggtttaaaattgggtacttttaatttcttaccgaggcagatgagatgatcatccctcgaggtgacataccctctcgtttcttgtatgtcacctaataattaagtaataaaaaatttgaagaaaatggtaactattttttatttttgttacaacttatatacatcaaattttagcttctatgtgtgtggagtaatatatctcatgctaatctaccttatcatttaaaaatcatttttttaaaagtaataagtacttagatgactggcaagaaatgagaagatttgaatcccctcaagggatgaagaatatttttccaattcttgtacaaatgaagtcgattctttcacaaatgaagtcgagtttgcacaagctaacatgtgtgaattcttttatttttttacttagactttttgttagagtttgcatgagttttcactaaggcctcgtttgattcatagggaacaatagagaaaaaaacataggaacaagaatcctacggaatttggtactattcatccctttgatttgtaggaattaaacatagaaaaagcatgaaaatatttcctatgaccatgatttcaagagaattccataggaaaattaacatccaccttgagctcatttttcttttcctatgggtaggatcgaggcaaaatactattggaagataaggtttaaccctaataaaaccattcaaattttgattgctattgacttaatactcaacattcctatgtttttcctttataccaatcaaatatcattcctacaattttcttatgtttttcaatcatctgttttgcatatgatttcctatactattactgagtttttcttattcctacattttttcaatcctatgattcatatgagctctaagattgagttttcaccttgcaccgcatatttagggtgggtacagtagtgggagtacaccagctcagctactggagtactggagtgagtacaccagctcagctagctctgtcagatgctcatgagatttctctgtttccagtactaaggcctctcacagtgcggtgagttggattggtgtttcacagtgccagcttagaaaaacgcagacgtggagggtgtcgccgtgcccctgcaaagcacctcgcccccacgcagagcgccgcacttcctcctctcggcgagtccgcgcgcgccgtcgcgaggcgaagttccgcgcgctgtggagcacgtgtccgtgacgagcgcgtgccctcgcggcgaacgggaggtgcaatccccgattcgccctcccaaaatcccctcccgccacaacattatttctcccgccatagatcggattggaagagaaaaggcaataaaatcttggagattggaagaaagaaaagatcggattcgacaagatgaaaaagaaaagcaaagcaaattcatcacagcaaattcatcacggcaaaatcatcccagcaaaatcacgacgacgacgacgagccggcaaccacgactccacctccccggccgcgcgcgcaccgacgaggagaggagtcctcccacgcgcgtcggtcgccgcggcgtcggcgcctcacctccccggtgtcccgcttgccgcccaggcgtccgccgcgagggaggagagcacaacgaagaggaggaagaaggtgaaggggaggagaaacgagcggcgcggccgcgcgggcgacgacgaggcgcacggcgacgaggaccacgccgttggccgccacctccaagccagagggctcgagcggactgggccacgcgctgtgttgagttgtgatccaaattcatttgcacttaataaaggctagcttctgccgtagcggatcatcatcccttttagggttccactatatatatacctcttgtaagccgccgtgcggcgatgtaacctcacctcagatatagtgaagatattttgctggctggcgcccgtggttttttctctcctgttttgggagggttttccacgttaaatcttgtgtcttttgtgattgatctattgttctttatcgtttgttcgcctatcgtttcctaacacgctggcctccggccgccacgcctgggcggacgtagacccccaccctctcggcctggatctggggcgtggtcgtgtgggagcggaggagtaagggcggggcgaggggaggagaaggagtcggagtgcgggaaggaggtgggggaggaggcgtgcgacggaggaaacaaagagaatcgaggaggagaaaggggtgtcgagaccgagcgctggagggcaggtttggaattatttccttcacctgcccgtgccctcattttggcagggtacatgcactgtggactcggttacctctcccactacatttatccaattaaactactgtggactcggttacctcccccactgtatacaactaggggtacttgcactgtagaataggccgtctttaggccaattttttgggttaggggtacgggccccatagcttgtattgtgaatggaccaagctgtcgcgttggcattctgccacgtcatcaccgggccacgtgcatgcgtccgttatcctccagcatggacgtacacgtacgttggatactccctaaaataaaccaatcttcaggggtgaaataatagtttattttaaaacggacgaagtacgtgtatttgtacacgatatgtatatatagctaaaataataggttgttcgttactttgcgttggaaagttctccacatcaacacgaaaaatggaatagctcattagagcataattaattaaatactagcttaaaaaacttaaaaaatataatacttcatccgttttataatataagtcattctagcattttttatatttatattgatgttaatgaatctagacatatatatctatttagattcattaacattaatatgaatgttggaaatgctaaaatgacttacattgtgaaacaaaggaaataataagcttttttcaaacaacgtttctattttttttaaaaaaaatagtattatttatcaatttaagaagcgtgcacgttgaagaaaaagtgtaaaaatgatgaaacgaactcagtcaagtgtagaatggtctgatggctatgacatgcatgttccgtccttgttacaccggccagctaattaactagagcttgctgggtagacaagtgacaacagcaatgtctgggaaagtcatttcaaccctcgaggggatatcggctcatttcatgcattccacctaaatagtcataaaaaaatatgaaaaaaaaggcaacatagattaatataaaatatatcactctacaaacatacaagtttaaattcaacttctacaagttgtaacaaaaataacaaatatagttgcgaatgtatgataactattttcagtttaatttgttatttatgttgcaacttgtagaagttgaatttggtctatatttgtagagtgatttatttcgtattaatctatgttatcttttttaaaaaaaattttgataactatttatatgacatgcaaacaatgaggggatgttccctcgggcgatgaaccacatccgcaatgtcttactcaaaacaaaaggggaggagaaactgcaatgtcaatcctactaattggcttcaaaaagatggacaatattacacatgcaccaataacgctcaactaaggttttgtgtggctgataaatagcctgatatatttacaccgaccaaagggtcaaattaatcaagcagatgcatatgatacatatgatcgatctttgagcaaacgatatatgcatggatcaatccagcggcagatcttaaaaaaaaacgattcgttggtgttataacgtatttattagtgttatagcatacttgttatgcttggatcatagtgttataatatatgaataaacagtttcgttatagctaggttttgctaaaagtcatcggtatcgccaccgaccattacactgtaaatccaccctgtatcgatcgattgagtctccatcgatccaactatatatagcaacatgtgcagttttcggtcaccactaggtagatcgatcatccctataatcatcattgtacgacgttgcgtgttcgacggctggattaattggtttgaataatttttggtagttaattatctgactacattttcccaattcttaccaataaagtcgagtttgcacaagctacatgtgtgaattcttttttttatatcttagatacacttttttgtcagagtttacatgagttttcaccaaaattgagtttccaccttccaccgcatatttagggtgtattcagtagtaggagtttggaactctccccgaagcaccgcatatttagggtgtattcaatagtaggagtttggaactctccccgaagcacacaaaatggagtgttgtatcagcgcatctatatactaatataaaaaggagtttgcccctcccaatcctattggtgaaatcattccatctatctcatccgttcatcctcatcccatctaatctcatccgtccgctgtacaccgtagctagtatatctcctctagcgattttgcccgatctcatcccaccagcaatttcggtccccatgcggtggctgcgcggcgcaaatccccgcgcggtgactccgcctactcactctgcgccttgctccccgcgcgcatcctcgctctacgcctcctctcctcactatggtccagcgacagtttaccgccggaccaacaacctcacgtcctcgttccgcgcaacgccggacctccttcatccttgcaacggaccaacgacaacgcaccatcgcaccgccagaccagagccgaggcactaccgcaccgccagaccggcaccgaggcaccatcgcgcagctgcccaccgctagaccagcgcacgccatctcatccccttcagccggggactgccccagacggtggggtagtggttccccctaccgccggagccgttgcggcgcacgccacgccggcgccgagtttgttcgacattctgtcaaactttcttcgagatgcttaggaactggtgatttggggactacttcaaggtggaggccattgggttagcctgggatcatctcactcaggttttcttttttttggatccttttagattccctttttattctcatgcaattgtggccgtgctgtgtgaatctaatgtctcttctaattgggactggaatcatgagttggttgggttggcattaaactgttttgagctagcgaagtcttgataaataatacttcctccgtttcacgatataagtcattctattatttcacatatttatatttatattaatgaatctagacatatatatctatctagattcattaacatcaatgtaaacgtgagaaatgctagaatgacttacattgtgaaacggagggagtagaagagttgttacttgtaagagatgtcttattttctgatcttgtcgagtacaaataatagataagagacaaacaatagatgagttgttgtgctcgacaatttgggaagatgtctgagtacaacacacctagctttatcccctataaatacgtttataccccccagcctgaaaagttaaccatgcaggcatcaaatcacacagcactaactcatcaagagctctacatatacatactaattaaacctaaatacgtagcctgatcagtttaggtttgtcaaacgccatggatatggagatgggtaaattgcttcatcgcccatggaaatggagcttaaactcgccgctactgctgctgctcatcgtccccgtgatgatccacgtacagctgaagctacgtcgtcgtcgcaagaacgccgccgccggcacgaggctgccgccggggccatggcggctccccgtcatcggcagcctgcaccacctcgccatgaacccgaaggcggtgcaccgcgcgctggccgacctcgcgcggcggtgcggcggcggcggcggcgtcatgtacctccgcctcggcgagctccccgtcgtggtggcctcgtcgcgggacgccgcccgggaggtcctgaggacgcacgacgccgcgttcgccacccgcgccatgagcgtcacggtgagggactccatcggcgacacggtggggatactcttctcgccgtacggcgagcggtggcgccgcctccgcgggatctgcagcctcgagctcctcaacgcgaggcgggtgcgctcgttccgccccatccgggaggagcaggtcgcccgcctcgttggcgccatcgccgccgccgccgccgctcccggcggcgatcagccgccgccggtgaacgtgagctggcagatcgccggggcgcttaccgacctgacgctgcgcgccatcatgggggagtgcggcttccgatggcgggaggagttcctggagacgctgggcgaggcgcagaggaaggcgagcaggttcggcgtcgccgacctgttcccgtcgtcgaggctcctccgcgccgtcgggagcacggcggtgcgcgacgtgagggcgttgaacgccaagctgttcgagctggtggaccgcgccatcgagcagcaccgggaggcggcggcgacgactgcggctggcggcgaccacgacgacggcggcgacgacgacgcgcgtgacgacaacgagtgcttgctgaatactctcatgagaatccagaaggaaggtggtggcactctctccatgtcaacagtcaaagccgttattcttgtaagttctttttttttatctaagactttaatttaattttcttttaaagagtcacatggattttttttatctatgactttaatataattttgttttaaagggtcactgggattttttacaaaaatatattcttactagctattccctagtgatccatccatccaaagtctcttatattttcagatggacagagcatatatatgaagcaaatataaaatattatgtgaaaactatttgcaatattaatctatcagtacaattttatactctaaacacagttgtcatttaattagggttgctatagcacggaatcctatccaaatagtatactctcacgtatatatcatatcttaatacctccctggtatcacctgatactcataggtatcaaatttggtacctaaccggtatcacctaatatccataagtgccaagtacggtaccacataggcctcgcctagtaccaacaagtatattataactcagataccatctgaacctctggttttgtcgccaccttcgtcgagccccttcacattgcttgcagtcaccattgccatcgatcccctccacctcgcttataaccgagtaggatttcggcaatttcttaactcgtagagatatttttccgtaatttgaggcgaattcctaacaacgtatacggaaaccaaccgtacacgtgaaggtataccttatcggtattttccataagtcgtaggatagagggtatgccttatccgtaaccctgacaaggacctttgccaccgaaccaatagccttggatgagctcctccaatctgtcgacgaactcctccactgccatgaaacctcatgtgtggcgcttgctcccccaatctccacaaggtccaccactgagcccacccggtggctcctaggcgcttccccaccagtgccaccacaacccgaaatgttccccttcgcgagtagattcagctggtccgctcccaccgtcttattgtcgagtacaccggatttaaaaggatgtaggcggaaaggagtaaattggttggaggggatgagggcaatgggagtcagggcaagggaagaaggttgattacgatggtggacaaagatgagagatcaaagggctccaacagccaggggaaggaggagttacggcagcaatgttgcactatgggaggatggaggcgaccgcacttgcagcgctcgagatgccgaggggaatagaggatatataagcaagtgggatgggatcccgttaaatagcgtttttgtaattcaattattgacacaaatccataaatcttgatattttgaaatcagaacatgctaaacaatcagtaggagggtaataatattctttgcttatttacatatcatgtggtatttaaaaggggccgataggcgagccatgcatagcacgactgatggtagtacgattggttataattcttggacctctaatgccagttgtcatagttactccctttggtcataagataaataatgtcttggactgatataaccagtcaaaactttgattattatactttgaaaagtacatagttttataacataaaaaatagtatatatgtatatcactcttgaaaagtgcttttttaatctcataaacatagtatcctttttaataaacttattctaatacaaaattattgtcaaaatcgcacttcaaagatcgttaaaaaagtcaaacttattctaataccaaaagaattatatatttgtgcatgaatggccgtctcgtgctttcatgtcttcaatgcacaaaagtggatgaaattaatccatctaaccttgcaatatgctaacgtaccctccttaatttcaacatgtgctaacatatacgcatgacatgcattggccaggacatgtttgcaggtggaagcgaaacaacatcaacaatacttgaatgggccatgtcagagcttgtgaagaatcctcaagtgatgcagaaggcgcaagcacagatacgacttgctttgcaaggaagatctagaataacagaagatgacttgataaatttaagttacccaaagaatataatcaaggaaacactaagactgcatcctgtagcacccctacttatgccaaaagagtgtcaagagtcatgcaaaatattaggatataacattccaaaagggtcaatcatgttggtgaatgtatgggccatcggtagagaccacagataatgggatgatgcggaagtatttttgccaaagcgttttgagga
